United States Patent 11,401,555 (GENETIC POLYMORPHISMS ASSOCIATED WITH STROKE, METHODS OF DETECTION AND USES THEREOF) - sequence listing, part 4

SEQ ID NO: 348 - DNA, 253231 bp, Homo sapiens
ccaaggtcaaaagaaaggggccactgtgggatgggactctcccagacctagagaacaaaaataaccatatcaaagtgtgcttcagaaatattttgtcctcttacctccaagccaccagggctctgcaatgactgccttggaagcagaactaatgacaataataatagtaatgaataaaatagtggcatgggcactgtttccccagctcagaggaaaatctctagtctagttgcacttggctagggtcaggggttccctgccatagcacctcctttcctctaagtgtttggggcagagtcctgatttcctgattcagtgaatgagggcttggctgcatgggttggggagaatgggaacggagcaagttttcagggcacagatggtcctgactcatgcaagatggccagtgggagtcacctggatgctaaggcaagtgtcattttgaagccactaagcaagacatctagagaggcacctctccaggctctgtactggactcatgcaggtagagatggtgggtccattcctcagggctccctggggctggcaactgaacctgcatgttctcccagaacctgggaggcctctgcagtgggctccatctctgtctggtggtccctccccagttccctcccagcctgtggaaactttggccaaatttgagaggtagtggagaggaaacttccagatgttttgggtcgtagactgggactaacaactttgcacttaaagctgagtatttgaccacctttgtttcctgattcctctgtgcctgggctagtttcccccttggcatatttgggaggggtcaagtcattctttaccttccctccacagtaatagctaacgttggctgagatagactgtgtgcctggtgtggacaatctcatcaaatccctataaccttcctcagcgaggtatggtggtgagcacctgtggtcccagctacttgggagtctgaggtgggaggatcactgagcccaggaggtcgaggctgcagggagctatgattgtgccactgcactccagcctgggccacaaagtgagacccaatctccaaaaaaagtgtgggagaaaagaagacacagagcaagaagcagaacccaggaagctggactccagagtccctgatcttactgcttggggaggtttgcccatcagtcctagcagaggggtcctgagcgaacttgaatcctgaaggacttggggcattcctgccagcatagatattctggggctagataagacagaaaaatatggaagtgaagtgggatgctcagttaatcaacatttctgatggggaactaaggactcaagggaggattcatttctatgatgctgttgaatggggtgagcggggcttgtgccttcagagcatggagcaggagggttccgaggcctgtgctgcattcagtgacccctccccacacgcccccaccatcatcccaccacagcccggccacttgctgtgctggcagcaggccaaaagcccagcagcccctgcgagctgtggccagtgcagacacccaagtctgtcccagacgagtggaccccagccttcatttgaacaagatcctcagggcattttcagaagtgtgggtctacagtgactcgtcagatatacctgttctctgagaactccaccatccagctctctctgctgaaggagtgggtggacggtttggaattgggacattttcactgacatgggccctgaagctggggggacctgaaccaagatgggggtggccatgtcctgccttgagcaaggaagcggaggggggaggaagggaatgagagatagaaagagagagagggagaaagatagagggagagaaacttgactgtcttccgtcagaccccttatcatgaagccccctttttgcccgggtgagtttgagtaggtgtctgtttcttgccacagcaattcctgactgaggggcctccttgaatgtcttgctccaattcctgactgaggggcctccttgaatgtcttgcttctggggactggtgcactagaactaggagcccatgtatgtcctggagacgagaggagcacaaggcattagccaaggagaggctggggcagaaatggctgaggttatagaaacaggagcctgagccaggacagctacatcactgctcctgcacccattgtgcagtcagtaatctgagaggcctggctggcccccatccagagccgaggatatcacagataggcttctgagttagggttagtcctggagggaggagtccccctgtctatccagagagcactcagcccatagtagctcctaatttttcttctccccatctttctcccttttcttaatgaaaatagctggcatttatgttggcttatgatgtgcctgccctgtgctaaatatgcagtgtgctttttctcgtttaatccccacaagcactccatgagggggcggctttcacactcatgcattttacagatgaggaaacaggctcaaggatgtgaagttgcttcttcaaagttacacagctagtagctggtagagctgggactcatacataaaatatttagttaagtctgtgaatgaatgaatggatggatggatgagcagatggattgatgggtggatggatggatgggtggatcaatgggtgggtagatggataaatggatgaatgggtggatggatgggtggtggatggatggataggtggatggatggatgggtggatggataggtggatggatggatgggtgggtgcttggatggatgggtgggtgcatggatggatggataaaaggggggatggatggatgggtggatggttgggtggatggatgggtgggtggatggatggatgggtggatggatgaatgggtggatggatggatggatgaatggatgaatgggtcctctacctattctttcacccccactgtgggcctcatttctaccaggtctcttgtccatatccccccactccttgctggacctgcagcctaacctgaccttcagggtgctcctctccagggatggtcccgaccttgcttctcaatggctgacacctgcaacccagggcctttcttcacctcctacctggctcagaccaaagtctcctcctgggctgtggctctaggttagaccagagctcccagacaatgtggcctattgggccccgacctcctctccattctgcagagattactgctggggccgtggcttggcttccctggcacttgtcagctgatggaatgggaggtgcatattttaggagacctgccaactcatgttgcctttttttttttgacttctccagttttctcaactctcctaaagcagggatcctgggtcccataattgtattacgtgacccctttctccctcgggccacagctaattggaccacaagcggccacttgacccaagctggtgcaatcatagccactttcctggtaattaggcctgggacacttaagcccgtgtcaagggtggtggacatttggactgaaaagtcacgcagagtcagggtctgagatgtgtcagggtttgagggacatctctcattcaaaatagatcatatgtgttaagagcttagcctaccacctgccacatggaaagtgctcaataaccatgagctatttttaagatgatgtcataggagaacatggaaggttctggttggaaaggggtctctaccaattcaatctgtttgaatgagagttggaggcagaggtgaggcagaggccaccttcccactcccttttgggctgtttctgtcatgggaacatgaggtttttcagcagcttcagtccactactcatctccaacttcctgggtgccgaggagcactatgatgtggggtggtggcggcccccgtgtcttgatggagacttcttggaccctggattgcagctctagggtgtgtctttccctcccagctctggcacaaggctcagaggtggtcatgcactggtgggtcagttctgtattattctgggagccattcctggaggaccaagttggccaggctccctcatctcttccactggttttataaacctccatactgaatcccttcctgctggaaatgtcccgccctgtactctgattgtatgagcagtttccgtctccagagggcagttgacatagagctttctcatttccagtttgaaaaagctcaggccagactgtggccaagctgggataaggtgtctacccgacctcactagctgtgaccaaagggacagggccacgtgagtaagtatgtggcaactcccaagggagtgtgtggatggagatgagggaggggtgttgccaagggaagggaagacagaggtcagacagtctcaaggacagaccccacatcctcaatgtctgaaccaggagcctggctggagccacccgcctgctgggcaccagggtctcttgcctgggacacagtcatccctgggggaagatgacaaaagttcgtcgcccagcaccttctcattctaaggagagaagagaaacagaaaacacgcctcaagggagccctgttttctagaaacattttatttaaaatttaaaaccatattacttcatacagcaaactgtgcactttgatatatcacagtgtcttaaaaaggaaaataatcagatttgtttggaaatttatttacatcagcctagaatgattggcaagtaacacagttactatgaaacccaaattgttacaaaatgtttacaaaaaactatattcatagaaattctgcatgtccacaaagggcatcccctgaatggcccagagaccagtgtgtgggaaccatgttgagtgggagtggggggcgtccaggcactctggtctgggtggtgggacaggtctagggtctcagaggcccatggtgctccctgggggctcagcccagagcctgggaactgaggcccctaccatgggaggcccaaccaggaagtcggcccaggcagaggtgggctgggggcttggcgcacagtggtaagaggacccatgatccctacggaaccaagacaggatgctcctcatggggctggagtcaggcgtgcttggtcagggccccagaggcagacccagagttcagtgcagaccagcctgacgcctgaggctgaagctggggcaggctgctgactgcacggaagcccacctcagatatctcctcccctgcatgctccagagatgctcagacctgcgaaagaggctaaaggaatggaactgcagagaacagaccgatctgggtgagccagggacagagatctgcagcctcctggggagggggcactctgccaactgccctgccaggatgccgcaggggagagaaaggcagacagatggagcctgggctgtgctaggataggagctaccttcttgcctctcatctttcacccctctggctctgaggtcgctccctgacagctggtctctgggtcaaatggggctggggaggttgtctgaggcaaggcaaacccttggctggcatttgactgaatctatggctgcttcttcatgtctggaggcctcagagtttcaatccataaaatggagacaatctgggaggtgatgtgaggtccactgttctagaaggcaggaggacaggatcagtaacaggggcatgggaacactgtatcggcatgctggccatgccctgggggcattctctttaacaagtgctttccctagttgtgagctgtgttgtgtgcaagttgtgactgcttctgcatgtgggtgagaatcagaggcagaggcttttgctacctagaatagccccgccttctagggtatcctagatggagcctgaaacctacctgtgattctgcaggcaggtgtgagaacaggcctggggagtggcctgctctttcccagcccttctgctcctgatgaattgccccagaactagaatgtaatattggcacaggggctgagtactagcatgacattgcttctcagacacacccagctgtcctgcctcagacaggctcggatggagatgaggtccgttggccattcctgcccctcccacaggaggccctggcggtgcaggactcacctggcagcaccatgtagctctgccctcttcttcagggtctggagctctgatgtgtggagggccttcgccaccccaaggggctctctgagacctccgtcccagactttgctgctgcagcccccatctctcatctggtcctcacccgtgctggctgggttctgtacactccgtgtgcagacgtgcaggaaagggttgtatacacatgggctacaggtcatatatacactgtgcatatatatatatatatacagtatatatatatattttacattcatatatatattgtacagaacattaaccttctacctaaaagttttgtgactcacgtatgacctcagctctgaaatttttactccagggcaaatccaggactgaagggaaggcctgatttaaactgccatggggacagagggcacggcccttccatggcagccagcagccgggccacttccagatgtgtccacttgacctgcaactttcagatgtgtctaatccagagacctgcccacagagttgggctcatttcttgtatctgtccatgaggctgggcccatcccagatgataagtccatgcagctgtttgtccaaacctctagcccctttgcagatgggtatccacacaggaccactccagatgtgagccagagaggccagcctactttcagatgtttgtgcatgtagctgggagtggctcagggagggaccaacttcatgctgagtgatgaagcaggagctgtgacccaccccccacacccagtacccctggaaaagtaggcagaaagggagcttttgatcgttcttggtgagtgcacgcctggtggaggggagcaacttctaacctgtttggccctttaccctggcctgggccaggattcccatcttccagggcctagggcatggcaggggttgggggtggagccagagtgtgcttccaggttagatagagtctcggctgtgaggagggggtggccctcttacccctcagacactcaaagtccagcacactggccaagggggcgtcacccctcgcgagagactcttgcagcatggggccacttgaacattgacaacgctttcaggattttcttctgtccagagcagagaaaccagcagcaggacaaggggagagtgattgggagggctcactgtccttagtcccagggcctcggcaggggcggtggggttggtgtcttcttaccactgcccctcaacttggccagcttgagcaggtggagaggaggcacttgcatttggggatgcagtggggacattcttctgttcagggctggcatgtggcaccacgcagggacagtccagcatctgctcaggcaggttccttcttctgctccatccaagcaagctttcatgcttcccatcacctctcagtgcctgcgtgtgtgcacacacactacacatgcatacacacacatacacacacacgcatgcacctgccccagctcagctccatgcccactggcaggacagacctaaacttaaaaaaacacaagatctgcctcactgaaaacacctccccactccgtcccacctcacagatgtagcatcattttcagtgccccgggagagacagagctcatgcttgggcagctgtggtccccactgcactttgaacactaggctggtctctaggacaaatgcaggatattggccagaagccaaatatcagccacaccgacaacacctgaacatcaggacgcaaggtttgcctgggagaggagatgaggcagcatgccctcctgcttccacacaggagtctaaagaccagtcggtacattttggggggtttctcgaattgaattctgcctctatttatccactattctttgttcgttttataaaaattctcaccacttcttcttcctcctgtcacaatccacatatatgcatagcctctgaagaacatgctcatgtagcatcacacacacaacacatgtgtgagacaagagcaagaatgaggcacgtgctctgaaactatactggacaaagtaagacggcgcttaatgattgtgtttgctgacagcaaattggcaaataccttcattagaatcctgttacctgggaattacaaaaaagagttttcccttcaaacaggacatgatgtccacagcaaaggcatcagcagcatgagcccctgaagggttgtgcccccgtctcctggcaagtgtgcccatgcaaccttggaacctctctgtgacaaatgatctctcccatgacagaagtgcaaacagaccctggtgcccggccttcctgattgtctgtctttgcttccactgtgacctggaacatatgtgtgtgtcccacacactcggaaacttcaactccacgtggcttcttgtctacagcatgcattgacccatgtcacacgactctctggtcctggccttccccccgctccccactgtgcacacatgcctgtacacatgtgttcacatgcactcagacatggaccccttggtgacatggcttctccttttacgcatatttggctagctgcaggtaagatcctgatctccatcctatgccattcagtgtacatgtgcacacacacacaccagcatgcacacacctatgcatgcatgcatgcttacatatgcatacccaccagggccccattatgacatggcttctcctgtttttacatatatggggccttgctgcttcacatatttgtctccctcgtccccaattcactcagatacacatacgcacgcatatgcacacatcagatccccaaggattcacctattattgcatgccctggactatgttatatgtccagatctgtcctgtgccccagcccccgaagctcacacatacaaacacaaagacacagacacacatgcacacgccctctgtaccctgaagcttatgacagcatggcttttcctaacattacatgcatggggctttggtgtatgtctagccctcctctccctcgtccaatgtacatagccagtcagagctgctaggattctgggaacctgctggtttggtcctgcagctcacagtctggaggagggacagtgtttatcacatgagcccactgtggtctcctgctttgctagagattgcccttcacccagatgagaaagcccttgagatccaaatgaagctcttccctaaccgggcttcccaagcagcatgggacagaggtgggaggggagtggctggtatgccccagttctcatccagaatccccagaacctccctcccctgttcaaaacctgcccctccatccttggccatggtaaccctgctggcccatcatgttctctttaaggacactttgttcctaatccttcatgtctcattcttttccaagactcttaaagtcacagacctctagagcattcatcacagcaagctggaactcataggtccaccccctggctggtacccaacctgctgctacttctctgctgtcttccccaagccccacaatgccatagctgctctggacaacagacaaggggccaggatggcctcatgtctctgtgtggggtctttggttaattctccaggaggcagcttcttcctccccacccttggggcctctgccagctatgatattatgtccctggaaactttcttttcctggggagcatctctaggtttggtaagtccaggagaccagaagttcttttggtctcttctggtttccctcacctagcccaaagttagtctgtgtagtaggacactaactccttttttgaggagggacaacttgactttcacttcaaccaactcttctttcaaaaagacagagtgaggccaaggtcaaccagccaggaatggggagttgttgatgagaagatggcaaagagcccaggtttccaaatgtgaacagggtttagacaacagcttgctaaccaggaaagtgagatccattggcacaagagccggtgggacttccatggaatctgcttttcctctgctgggcttcaaataccggctgcatctttgggcatcctttgtgagaaattcagggggtcctctctcctctggctagaaagtggagaagaattttctgtggccactcccccacttatattcttagagacctcctagaggattaggaaccactgggtcattgtccataagaatccaaaatggcggcctctgtttgtgcattctcttctctcccataccccaaactcctcttttcccctgtgtagctctgtcttcaactctgccagaacaggggctgccaggggcagcgccaagttcagaagattaggaccacgtgaacagccccagagggatgaagtcttccttctgcccaggcatatgggatgggtatccctcaccatgagctcccattggcagccatgctagaacatccttaaggcgccgaaggcttgtgtctctggcctcacggtcaagctgtaggaggcctgggctcttgtggaagaaatggcaatataagagctgtcttccattttctgtgccctctgcagggctgcggcagaaacttctgactctggaggagagttgaggggcaggtgagtttggcctgagagaggcatgtgcttcctttggccttggctatctcggctggcagctttagaaacccacagaagatctgaggaggatgaagcccaagcagctggcctgagagcctgctggcttcctggcaggtaagggcaggaggctcctggcccaacaggcaggtggcagctctggtccccaagcccagtgcggggacaggggacgttccttccaatctcctttgctttcctctgcccagcccccaggcctgaggtccccaccccagctgtgcctaggggaacacaggggctaaggatgtgctgcaggccatgctgtccttgccgggaagccggcggtcattgaatgtgtgcatgttgatgacggcgtcagtcttgaccatcatgggaggctgaggcttgtgcttgactcgacgctggcaggtaagggagaaacggatctcatcggccacggtgctgcagaaggaacgctgcaggagggtggaggagaggggtcggaaaaggggcacagagtgatgcccggtcttgcaactccagccagttcctcccctttctcccagagtctgtgctaaggttacccgtctttctcacaccttcaccccacccatccctctgccacctgcaggatgattagtttgtgcagcagtctacaaaacctgacattcttgtttggagactaaggtaggtggggcatcatcttaacctcatttatacatgagcaaactgaggttctgaatggcatgcacattaacgtctgaggagctctggtttacctgtgccatttttcttcactagactcggagggcaggaaccagccagtttcatccccatgggcccaactttcgagccctgaccaaagcactagctttggcccagggtcaggactgaagaaacatttgacgaatgtatggataaactttctcctggaagggcttccaactaaggggaagaatcagtgtcttcccactcagggaagtccagcacatgtttctcaaggtggaaaactgggaggcaggtccctctagggctgttgggtggcagtgaccttcttttggcctgggtccctgcacatagccaagaggaacatcaagagcgcagcgtttcccgcaggtatctgatgatggtggcttccagaggttgtcctgcagcttgcatggaaggcagtgggggatgctgatatctcaacttacctagtgaggccagggcactagcaccaggactacttgtgtgcaggggctggggactaggctttgtattcttgctctgcctcctaccagctgtgaccctccaggcttccctttcctcacctactacatgcagaatgtcatccctccttgcctccttttcttcattccacaaatacttaatgcgaccctactatgtgccaggcactgttccaggtgttaggcatgcagcagtgaagaagacggataaggccatagcccactcagggagcttgcggtctaacgatgagatggaatagataatgaacacgtgaacaaataaataatttcagacagtgacagccattaggaagagaatcaagcagtgaaatgggatagagaggggctggaaatgggggcaggtgaggaaggctacttgaggaggtaacattggaactgaaacaagaatgaccagaagatgtcaagaacacaccctctgggggaggagcattttaggagcagcatgtgcaaagggcctaaggcagaaatgtgcttggtgtgttcaggactgaacaggagtggagcagagtaggggaggagagtgagggaaggaagtgggcagagaagtggagtagacagatcctttaggctttttggtggaatgaggagctcttttttattttcatttttttattatttattattattattttttgagacgaagtctctgtctccatgctggagtgcagtggcgtgaccttggctcactgcaacctccacctcctgggttcaagtgattctcctgcttcagcctcctgagtagctgggactacaggtgcaagccaccacgcccagctaatttttgtatttttagtagagacggggttttacagtgttggccagggtagtctcaatctcttgacttcgtgatccacccgactcggcctcccaaagtgctgtgattacaggcgtgagccaccgcacctggctgggagctccttttaactgtaatgggaattctcagagaatttgattgttgttcttttttgatgtatcataattttgtatcaacagagaaccattctctgttgttagacatttaggtgtttacccctccctcccatctcttcgtgttataatttacacttcagcaaatttccttgtaaataaaaccatgtctatctttgaccacttacacagtgtacatttctaaaagtggaaattgacaggccaaaatgtatggatgctgtggaagactctgaacataccgtgaagttgctttccagaaaagtacctgcatagacttccctcagcaatgctggacagcgtcccttcggttacacccttgcaaattccaacatcgagtattatctttccccctcctctttgttgactaaggcttgctggttatagaggattccatttcgttttttacggatatgtaagttgcttgtttataatgggcccttctatatataatttaactgcaatatccttgaacttctctgtgagttgtgcttcccccagcccagcggccctcatctcgggcacacatttaaatcaccctgtagggttttgtaaaagcataatgctggctccaccacagaccaattaaaacagagagtctctgggagtgagtccagggcattagcacttgaaaactttctccctgtgattctaatttgctactgggacccagaactactgcccaaccatgcttgaattaatcagaaggcctgagcctagttctactgtctatatgcttgggccaaccctgttaacttttcctttttaaacttttgattatggaaatttccaaatatatgcaaaggtagagagaacagtataatgaaaccctatgcaaccatcacccaccttcaacaattaccctggagggttttatgcaggaaaatgatatggtttgaattaagttttaaacaaggtaccagttgctgtgtgaattgtggatggtgttggggaagcatggaggctggagggccagtttgaaggctgcggcataatccaggcaggaggtgatggggcttggcctggggtggggcaacggcgatggaaaaaagtgccaggtcaggacagaggtagagtggcagggcttgctggccgactggatgcagggtgagctgttgtgaggctgagatgagacaccactgtgtgcctggcacatacaggagtgaaatcagcgcgaatctccatttcccatcctgtgcaggctccaagctctaaggcttacctgctctctctctgctgttttgcggagcttgtacacaaactcgcccacggccaccagcacagagaggaccagcccggcggccaggacaatgaagatgcccccgatcttctggatccccagggcactggcctctttgttttcctcctcaggacacccgctgccccgccaccacttctccttcatgatatgcagcttgtcctcctcctgaagctgcaggatggcgatggtgatcttgtcccggtatggggagcctgagcagggagaagggacccctagccatcagtggcgtgtggcccattctgtgtttggctctgccaacaccctggtcaggtcaccaccactagccctctggatcagctcatgaaagggggtccctatccctgtgagtcccctttaaatcgacgcatggtatctgggtgagtggaaatgtcctgtttgagcagggaggttgtgcccattgtgtatcagtccctgtgggctccctgaagtcccagtgcccctgagctgcatcagcaggggcaggggcaggagagggaaggcaggaatggcctctgggaactgtccccaaacctcgcgtctgtcccagctctcattgctcaggccagggccaccctcacaaggcatgcagctccatccctctgcttctgggctgagaaaatgtcacttttgtccaggtgcggtggctcatgcctgtaatcccagcactttgggaggctgaggtggggagatcacgtgaggtcgggagttcgagaccagcctgaccaacatggagaaaccccgtctctactaaaaatacaaaactagccaggcatggtggcacatgcctgtaatcccagctactcgggaggctgaggcaggagaatctcttgaacccgggaggtggaggttgcggtgaaccgagatcatgccactgcactccagcctgggcaacaaaagcgaaactccacctcaaaaaaaaaaaaaaaaaaaaaaaaagaaaagaacagaaaaaaaagagaaaacgtcacctttatcagccccatggaatgagctgtgagacggagtgtgaggggacgcgggggtggagccctccctctgcccacacacccacccctcccacaggcagcccctcgctcacccatgggcgtgccgatgccgtagcccttggagtcaatgaggcccccgatctgggtgaggttgcagttcctctgcgtgacgtactcgatggtggtggactccatgagcagcgcgtagtcggccgtcagggccctctggatgccctcctcgttgttcttcaccagcgccgatggcttgctgctcatgaaggcccacatcttctcgaaggtggagatcttggatttctgggccgtgagggaaggggtgatgcacacaccgttactaggcgcaccagggaccaagcaccgcataccctgcacaacgtgggttggggccttgaactcggtctacaatcttcagagaaaggaagtgctacacggtgctcagatatagaaattgaggccccggggcaaaggtccccaaacacacagctggccaatgataaaacggaaatgtagactcaggcctgcttcctggaaaccctggccatggcacaagtggtcttcaagctgactttttaaacatggattttctttctctaaaatttattaaaagttagcacgttcaggctttgttctaagtgctctacctgcattaactcgttgattcttcacagcgctcacaggaggcaggcaccatcacaagccccattttacaaataaaaagattgaggcacagctaagtcacttgcctaagtttacccaggtactaagtagcaaagccaggcttcaaacccaggccatctggctccagagtccatacccctaacccctcagctgccctgcctcacagaaaccactgtgagggtggagggggagagacagctgctcatcggggcaaagctgagtgggtcctgggcctcccctttcacttcaaccaatggaggcctcttttatgtcctgtttcaggggaagattttgcctcagacatgttctacttcattactgtgaggaaggagcagggtgcgaattgcagagggggagaaaagtaagggcagtcagggtaggtggtctgcaaacccccttcagctacaccagagcccagggctgtagggtcctgggctggacactgttgcttgagcagaatcagaatccctaagaccaggtccagttggtaggatgcaatgcctatgctggggagacgcagagaggtcactggggccaggagagaggagggcaagggctgagtgtcccttgctgcctggggagactgtgcagaccagggtgcacggcattcatgagatttcttgggaacttagtgctttgccaactgcctgctcccagcagggatcagccctgtcctggctgatctcaggggaacaggtggttctgcaggccccactgagcccggctggttccaagtctagctgtgtctgtctgtgatgtcaacctgcctgactggcacccggcccagctccagtatgcctgatgtcatgggtgcaattgaacaggctggcgcaggactggggcatgggcagggggatggggaagaagccatgcctgctgggagggagctaaggagcctgggaggaaagtgtactttctattctccaggtgcttcctagatctggcaagggctgtcccctcctaaactggcttctagagacccaaacatgtcctgaggaagagcaatggggacaggaaggggccccaaagccacaggcaggaccccttagaattacatctgagcaccatatcagttgagtgccagtgatgccttctttgggcacagggctgggggcaccttcacagataagcagccactccccaacctacaaatttacctgccccaaagccaaaggcatggaagggcccagatgcctgcagctctcactggcctctcccagcccctcctagtcctcagcctgcccttctttcagccattgctactctccagctactccagctctgcatgactctcttacctctgcaatccctgcctccaaaccttttgtgctctccgctctcccacttcctcagctattcttccacctcagtgcttcctgtggcccaggctgtgccccacgcaatattcttgcccttaaaaatcttcctggtgttcagctcttctgcctcccccaatgtttcttattttctagaaaatttctgataagcagattctcccacctccaacctcttttactccctctgttcctttcttactctgctacgctgtctccccagattctcctgttgtagaaagcttctagatggctcctacagatccccatttctggtattcacacctttgtgtaatcccctcttcttgaatgtgagctgaaactagtgacttgcttttaactctccacaaaagtgatgggatgtcatgtccaaaattaggttacaagagactgtgactggtactctctctggctcgtctcactctgatggaagctggctgtcatgttgtgagttgccctatggagaggttcccagggcaagaaacagagggcagcctctggccagctatcagtgaaaaactgaagcccttagttcagtcacctggggggagctgagtcctgccaacaagcatgcagtgagtttggagaacatgccttgaaatgactgtagcattagccaacaccttgactgcagccccatgagggaccctgagccagaggactcagcgaaactgcctagattcctgacccacaagctgtgagatagcaaatattgttttaaaacatgaagtttcgggtaatttggtatgcagcaatagataacttatacaccctctcaaccacatagtcacataagcgacttctgctcccagtatggttgctttttcagataatcatcaattccaactattcttctaatcaaagtatcctagtccagtcatctctgctttgccagatacacgtgttcctgatactctaccatcctggttattggaacctaaatacttttctccctccagtgattgcagctcttcagttcctttccatccttgtctcttctgctttcccagttctccctctactactagaggtgagaaccaaaggtagatgaagcaatcagacctcctaatgcatctgcccatctaatctatccttccaattacccatcaacccatccatccatccatccatccatccacccacccatccatccacccatcatccatccatccatccatccaaccactcacccacccatccactattgtatctgatcatgctatcatccacacaccatgtacatactagttaattcaactaatctgactatccacctatctattacttatctatccatccatttatccatctatccaaccatctatctatccatccatccatccgtctgttctcttacccacctatccatcccccaatcatccatccctttctccttctcacccatcttacccacccactctcctatgtcacccaccctctcagtcatccatccaataaatctcaagtcctgagaaaagtaacttgacaatgaatcactcaggaagccccacctactccttctgtctcagaatgggataagcacttcttctctttctctaaactcctccttgtatcctccccacaccccaacactttattcctcctatatacaggcctgcctgacaccaaaccatatgctctttccagtaacacaacaccatagatggagacagaaatttcagttgggggctgaagggagtgttgaggcagatgggctctgaggaaagacacaagaaaggcaccagtgggtaaaggaactgaatgaggaagatgggaaaggacaccagagagcttgggccagtgaagatgcaaggtgaaaacaaggcatgaagctggctgtgacgttaattttaagaggttcctggttctggagcctcctggctccagcaccaactaaattattacctccatcaccttcaggtagatgtgtctgaaatctgctttcctagaatggtccccactgtccttgtcttctgtcttggggccccccttctcaaccccatctcctcatggtctctgcttccccttaagtgctgtccttctgtccttgagcagttgagtgattctggggcacaaccctgtaaaggttccttgtggcttgtctaagcagggatagataaatccagagcccttcatggactctcaggtccctctctcccatctctgggagagttcccatcacaggcctgagttcccatcactggccagagctatcatcaccaccctagggaacgaagtctcacatacctacagctcctgtgtcatcctgcctgtcccggccctggttggaaccttaataaagattgtttcagggctagtcacccaaatcaactaatggaatcatctggaacaaccaatacacggcggtgtgccaggacagagatgctttttttatcagcaaaattggcaagaaagtaaatttcaggctcacgactttcaattccagcctcctcaaagaagcaaattgattttccctgactgaagatacttaatcttgagaatttaacatttctgtacaagagaatgtatgtaagtctatatatatatagcaattccaaagggagctgaatttcagagaatgtgtgcagagatgcagtagcaatgggattgcatacaagaccttggttgttttccatactggaaagaagacctttttccatattaattggctttcttatctctgagtgtggaatctttggccttactggatccatggatttgagcagtttatcatttttcttgggtcatttctgtggggacaggaggcctctttggagtccatggcctctgcccactgctacaggctccctggtaaggacagtctagctcctagttcacctccccccatcccggcagcacatgcctgaggcttgcttgtggggggctacaggctgggggtggaggtagtgagaggggtgagctccactgcactctggtgtcacaccagcttggactcaaatgccagctccttttgtgaccacaagcaagtgacatcacctctctgagcttcactttccatatctgtaaaacgggtgttgtaagagtacgtgctacttagggttatcgtgaacattcaacaagacaaggtgtgtgaagcgtttaacacagagcatgcccctaaggctccataggtggccggagtcactctttccctttaaggctccttaattctctgtaaggcccagttttctcatctagaaactggggagaaaaatctctatagtgctgagttgctatggcacttaaaggggtaaaaactcaaatgctgacagggtccaggcagggtattgaagtaactaaagaaggctggggggagtctgtaaactggagataaacattgcctctcagctgctgagaattgctgcaattgatgttttaaaaaatatacatatataaataagcgatgtgtggcccctccaaatcacgtctatgggctgcacaggcctgtgtatcaccagtttgcaacaataaacaataaaaagttagcattcactgcatgcctactttgtgccaggtaatgctgtgaggtgaatacatgaattatcacatttaatcatctcaatggctccataaggtgggtgccctttagctggtcatctccagtgtgctccagttaagtaatctgccccaggagggaatttcggggcaagaggaaagggtccagcctgcctctttggtttctgttcagccaactggagggctgtgtggaagagaaagcctttgacctaagtcctcctgtatgcctggctctgggctaaccactgtacatacaggagctcaccgaaccctcttgctaattgctgcatggtgaaaataagtatctgtgttgtacaggggagcaaatggaagcccggataagtgaagtgacttgcctaaggtcaccagcagagacatcatcccagactcaaatcctggtctgtctgactttaaaactgatgtaacttgatgacgacaggcggcatcacactgaattctgcctgggcattacattttggtccccctacctgcttctgcttgaaggcagggctaagactgtatgtgagagaggccagcagatgggtcaggagaagctggaagctgagtttggggagcatcttcctaggccctccagctcaaggaagggtctgtcatgcagctgggaggcagggtgtggaccaggtgacctctctgacagcatgcccaggtcagatgctaggaaccgaggctgtgcaagggggatggcctgacaatgaccaggggcccagggaacctggcattctcgggctcccagctcccactcctttcctaagccgctatccctctcatctgttatgtgctctcccacccccagcactgaaaaaggtctaagtgcttggagaagctgtcttccgatgtcctctctcttcaaagctgtgcagccctccctgcaaagaacacgctttcccaacgttctcctttacattttgcctacatatttttatagccaaacagtgctttcaaaggcctcttttttcatctcctaattaatttttatcttccaagacggagggaggacaacacaggagacgctgtttgtgatgtctgctgctccctgacaactcttcaaatgaaattcctctggaatgatgggtctgcagggtgggggcgagggatcgagagccccccgagagcccagcatcccgcttcctgctgttgtcgtctttggacagaaacaggttccctcccttgtgagttctactctcagtcagggcgtttttttaagactgtgtgcttcctaatcaggaacatgctaaccacagaaatcaagttcatctgtcctgcactctggaccttcaatacaggctgcccactcagttcctagtcctcgatattatctcctgcacttgtgccacttggctgccgccatctttaaatcccatcctttcactcaataacagtatccactcaacacgtattattagagcaactacgacgtgccagggctgtgcagggctgggtatgtggtcaactgactgtggcttcacttttccccaactgcctcctgaggactgtggctgggtccttagagaagccatatgaacacagtgaccaagagcataggcactagagccaggttgcttgggttcaaatcccagctctgcatttcactagctgtgggatgttaggcaagtcagttagcctctctgggccttcctttcgtcatgtttcaaatggagatgataataacaatctacgttccagggctgttattgaggatgttataaacaaatacaggtaaaatgcttggaatggtgcctggcacaaagtaagtgttcattaagtgttactgttattgttgactttgccaatgtctcctagacatctgatggctcctcctggagctgcctcctgttcaacagtagtgcagccttgccatatactctcatggtcaggggaagaccacctctctaggagaagaccctagagtggatgtgggagagggcactgtgcatgaagacagcatgtctgaccttgtaccccgctccaccactgatctgctgtgtgataatgggctgggcctgtttctctgggttaatctcaggtctccttccagctctaacctgcaaacattctgtgctaaccagaaggctatcacctggcccggggggaaggtctacttaggaagtccaactacagagggcagaggggtgacaaggcagggaattggttcatccagggaccttcagcgggggcggggcggggggtggtgcttctagctcatcatctgaggtgggggggcagttaatgtatctacattcaggctcttctccaatatgtaacagtcccattgctgctgctgatgacagggagtctgggcaaggagagcttcacttgaattaaggcaggagacaatgtggccaggcataaagaggaattaattgaccatagggacaggaagaaagtggagttagttatgcagggggtgtggagttgttgtttctgacccacagactcctgtgagcatgggcccatgaagccccagcatcccagacaggtgacagcatttgtatgtctcttctgccctcctcgctgtgccatttgcacggaaggtgggtgagggcagaggaggctgtgggaggtgctgcttgatggtgagggcagcagctcggtggggagctggggctagcttcttggaagccaatctgagcatcttagcatggagggaggcagggacatccaatcagcggcaatgagcctgcaccaggcttatttatgccgtttcactttgatcgggagccctgcttagagatgggttcatgcgttatgcatgagagatgctctggcacaaagggctgggccacagcctggggataggcaggagcaggcaggcatgtgtgcacatacacacacatacacatgcagacacatatgcatgtacagttcattatacacacacacacccagagacacattcatatgcatgcatggaccattatacacatacatagaccccccccccccacacacagagacacatatgcatgcatgggccattatacacacatacatccagacatatatacatgcatggatcattatacatgcacacacagatacatatgtatgcacaggccattatacacacacacactcagattcatgcatgcataggccattacacaggcatacacacacaaaggcgagtatacacacacatgcctgcacaggccattacacacacacaggtccatctgccctccacttatctagacatacccatgaggatatccaagcagacagacaaatgtattttctctgtacccatatacaggtagaccctcgggtacacacttgtacacattcacaggcacatgtccacatgcccagatcacagagatgcatcacacatatgttcagcacacatacacatagatgcagacacgtgtccaagcacaaatacacacatgtccccacacaggcagagttgtgcacaggcacatgtgtgcacatacacacacgtgcacattcccacatattatatgctgctacatgcacatgtgaagccatgcatgtatacacatcctcacctactcactcataggcaggaacacatacagagtcccatagtgttcccaacatgcctttgataatgccgttgtcttcccctcactctaaatacacagcagtgacctcttaggcaagtcaaccaacatccctcttggcaacatccaagagggaagctcctttcctcactcactgtctcttcactacaaagctgtttccaacctcaaggagggacatggtgggggctgggcagcggggaggggagaaagtgccagggggctgcagtgcccaggaggtagaaggctttcccacccaaccccttccttctctcttcactcaggccccactggaggctccatctatcatttggaggcttagcctaggaggaggcagcggctgggagatggggaattagagcccagaggaaaggaaaataccccaggcttccattccaggttgattgagagcagttgattaatagataaacatataaataagtgggcctgcagccacagagttcctaaatcctaatcatttctgggaaacctttggaacagtggttctccaagcacagaacctggaccagcagctgcagcgtcactttggaactttttagaaatgcacattctcggccccatctagacctcctgagtcagaaactctgagggtggggcctgcaagctgtgtttctttctttcttttttttattttttgagatggagtctcactctgtcacccaggctggagttcagtggcacgatcttggctcactgcaacctctgcctcccaggttcaagcctttcttctgcctcagcctccccagtagctgggattacaggtgcacgtcacctgtaatttgtatttttagtagagatggggtgtcaccatattggccaggctggtctcgaactcctgacctcgtgatcagctcacctcggcctccaaaagtgctgggattacaggcatgagccaccgtgcctggcctgcaagctgtgtttcaacaagtcctccagatgatctgaatgcacacccagatctaagaaccactggcttaaaacagggccctcgaggaaggtaggcctgggtcgcacctggttcctccagctgggcatccctggacaagccacttagctgctctgggactcagtttccacacgtgtaaagtagaaataattcgagtaccagcctcccaggatttgtcatgaagattaaatgaggcccagcatttagcgcagctcttggcctactgtgagatctcagtggcagtagctactgctattactactttaatttctgggagaacctttgcagcttctggttctcagggccagccagagtctcctaagccctcagctactccagtagaaagtggaaaacattagggcactcagcaacacttcacagagcaggaggagcaatgaaatcatggccagatacccattagagcagtcacttgagcaggtgacagggattttatctgctgacaccagcattcctagagtgtaacatgctcagtaatgtctgtaaacacttgttcaagttctaagcctcctcccttcctctcaagatttggccctgctgctgtctccccaacctcaggttagcttctttgagatggacggcattgaggtctgaagccaagggcgggaagcccctagggcctgtgtgtctgggtggctcttcccctccttcccacttctccaggcccctctcttcatctgtctccctctgatgacttaaggaatcataacacattcacattgctcatctcaggcacagaaacttctaggatttgtgtcgaggccaacccagttggcccacatcaccacagctccccaaagtcaactagtccaaacacggtggggctgagagggcttctgacccattggccatgcgtggttagggaaggacagagaccccctttcctcttctgctcagtaaagggtccggagaggatcagctcacggtgctgcaataggagggagagggcctcaccttgaagaaggtcatggtggccccatccttgacagccccatactcgattttggtttgcttggccaggtcatcagcagagtcaatgggtgattccatgcgctccacggtcagaaaggcagccaggttggccgtgtaggaagagatgatgatgagcgtgaagaaccaccagatgccaccaatgatgcgtgtggacagggctttgggcatcagctcagaccctgggcgaagagaggagatagtcagtcccttacaacatccagactagcgctgctcaagtcccctgggtcatggattcctctgatactctaatgaaagctaaggccctttcccaagaccagtggttctcaaaagtgtggtccctggactggcagcaacatcatcacctggaacttgttagaaatgcacattcttgggcccttccccagcactcactgaatcagtaatttctgagggtgggaaccagcaatatgttttgagtaagctctccagatgattctgacgcaggctaaaatttaagaatcgctcttctagaacaacatatacattcacatttcacaggctcatcaaaacctcagatgcctaaccatggaccacttatgtggtcccagcttaagaacacctgggagtcaggacccttgggttctcgagtgaatcctgctcccaactctcagtgtgatcttatgcctgatacttcccctctctgggattctgcaaaacatgaagaattgtccttcctctgtcccagcctcacataaatactgtggtgctgcaacgatataatttgagaagaaattgcattggaaatacaaatggtatacaaatacaagattgctatgcagtgctttgcaggaggggaaaaaaaaatcaacactttttgaagctctttgccgaaatatatgacttttcttccccgaccttaggtggggagcacaatagagatgacaccttctaactgaagtaattaactaggtggctttcaagagatttaaattgcaagtgactcctgaactttccagaatatttggacctgcaatctgaaaaccgtctgctttgatatgatgtttttttttctcaaagaagtcactcaagggagagtttttcaaatacataactatttttctccctcctaatcaaaaccacatggagaatacatcaagggccagtgctttgaatagcagcaggaggtggaagaggagaagctattactgcattgaggggcttccaggtctttcccaactgtcaccgaacaaagacgatggacaaaaaaacaaggtgaggctccaggacactcattaatagcaaggacagattgaggcacttcccttgaaagctgcctgtcacttcctagctgctagagaccactggggctctgtgtcccctccccaactggccactcccagcctccccaggttgctccaaaccaggctttgggctgctcttagagggagagcagcttatttgagtcacttgattgctgagttctgccagccttgccagacctctgcccaagtccctgccctggcctctgccatggccaagaggtttctcgcatgtgggacagatttgcttttttcctctcctccttcattcaagtgcccagcacagagcctggcatgtagtgggtgcccaggacacattgggataatgccatttgctcattcatttggtgtttactgatggatatctactgaggaccagggtttgtgaaggttatacacagatgactgagggacaaggacattttctctgtccctggaagccccttccctgcctgccccctaagcaggtccctcagtgaaactctaacagcaaaaacttgtctgcactccctaagataagagactctggacatgggactccacctgcagagggagtgagcacatggctggtggccagcaggaccagggggcggtgtcctttcctggctggtggtcccctctccctgtgcctgccctcctgctccctgctgtctctgcatctgactcctggcagttagagcaggtgctctgctgcagatagttccaaagcacattggccctccctccagaggatgtaagagaattgcatctttttgtgtacctcatctttgaagcactcgggctgaagtccccaactcagccatgatccttcctactcccaggcacctcacagccaagcggccacggagtcccatccacagtgtatcctgaagctctcttagtccatttctgccttccactcccagggccaccacgaggttcaggtctcatcacctcattcctgcagtggcctcccacccagactccctgcctctggtctccttccatccacagcccaacttgctcagctggattgtgtggtgatgaggccatgggcagggtcagccgcagccagcagggtgctctatgtccacctcagctggagcaggaggtgggggatgcgtcccgcatgccctgggctgggtggttttcttagctttagaccctgagccagctccagccagagtgaaggtggaagttaggggtctggggcaagggcacacacctgggtatctcgatgtctccaaacttctgccggctcatcagggtctgaggctacccctagaggtgtgggctggctctgctgatgccaaagaggctgaagaccgcttggggaaagcagaccctggaaggggaggccctgggagagggtgcataccttgctgcatcagggatcccattccaaaccagaagctgttaagcagagtgaagttattttccaccacctcggagccagggttgcaggggtgagcatcgtaccactcataagggctgaacctgccacaggaggagagggacagtcagcctgggaagcaaggggcatccacgccccagcaggcagtggtttagcaaacacagctgtgccagccgcctcagcgtcaatatcctcatggttctgctgggaggcagggcaggggaatttcttcttgttctttattgttagtgcccttttctggttataaaggtaattcaccagcatctcgtaaaattaaaagtgcacatgcccttcaggctcccagttctgcaactcattatccatcccagaaaaagcactcttacgggagcatcaagagaagcacacaagggtgtttatcaaagcattgtttgcaattgcaaaaaaaacctggaaaccaccaaaatatccttcaataaaggaatgattaaataaatgatgccacaactatactgtgaaatattatgcagctgttaaaagagaatgagatacttgagatgtgctggtggggaaagatcttcaacacatattgttgaagatctaagcaataaaaatattaaaagcaatgtattaaaagcaatagaaaataagaacaatatgaccacacttaaataaacagactcctaaagacataactattcagtgctttatgtatactcatatgcaaatgcatactaaagggtctgaaagggtctctagataaaaactatcagtgtttacttctggggaggggcatcaaaatagcagaaggaatttcaggagcctattgctctatctgcattacataaatttttaaaagtgagaacatgcttttgaattttgggtataataaaaaaccttaaaacggaaaaaaagcagaagacacattttataaaatattcagacagtatagatgaatacaatctgaaagtgaatgtactccagcatcctatcccccggagagaacaatgcgttatataattttttagatttttgtctttgaatatacaaatatatatatgacagggaaaaaatgattacttaaagccacctactgccttctaaggaagaggagtcctgattattgaattgaagggagtttttgttcactgcgtgagttccagttgaggatatgtatgtttaaagaagctcgagaggttggggggaccctagaaaaagtcccaggctggtggacattttctctagatttgtgggggaggttttaggatgctgagaggacacatctggaaggagagacaagtctagtggaattttgtttcattttttaaagtgcaatgccctttaagtgtgatgttgtgacctctcttttctgtctcccttctaaaagctgtaatatattatacattgattaccagtggtcatgtggaaagaattttattttcatgaagcgggaagatccctcaaataggaaattctaaagaaaggtttcaaaccaagacagggatcttcaaaggaaatgaccacaaactggttagaggctctaaaatccacagggaagagatctagaatggagaaagcagagattagaggctattgtgagaagggtttttggagagagcctttggagagctgggtgtccagagcccccgcttcctctaccacatctagggagaggggcttcccagggggcgaggcagctcagtgcctggctctgtaactgagcggatggacctgggaagtgtgaagggcaggggtcgggctgatgggtgctctgtcggtggaaccaggagagtccctgctgcacaacattggcctgcaggcccagacaccaccgggtcccaggatgctgggtccacagtgcttcccctggaccagatggacccatgcagaagacagatccagcccaggccgactttgactcccatcctagaaggcaatgggattccaacagggagatgccatggggcacaggctgctggaggaccaggggctgtgtggggagtgggccatgaagagaggccttgccagagggggccactggaagagcacccacctctgaacaacctggaaggtgggagggagacaacataaagctgatttctggtgagatctcccgagtcctgctctttacatgtaccaggcacacatacacaaatatataacatatatgatatttttaaccccaaaaaatcccctatcataccactatactgtccgaaaacttggtttttcatttaatgttaccaacctcttttcaggtcagttcttccggatctacctcatgctctgtgaccactccgcaggtgtttctaaccatgccttgactgatgggcacttaagctgtcctctctttccagctgtggtgcactctgctggaaaatcatccttggacacaactctgtcggccctgatgcccaagggtggccttgtcttctggggcttggctgcaaagcctttctagatttgggagaatgctaaagtgtggctcaatggtgatgtttcaacaggatgaagttccaggggtggaactgcttatcatgataaaaataaccgcttctagaatgggcttcttggctatcaaatgccgttacaggttggggtcctcatcgcctcccgagaggtgaaagcatgcacggtgcccattttacagatgtggaggccacgaggatcctgcagtcagtgggacagagcgtccaggctctaaccctcctcggccacaggagagaagaggagtgggatggtcgcaggacgaggagggaaggtgtcatctggagttaatggcagatcttggatttgtagcttgcggttgcaagggcttctccagtcttgagagtaaataggagttagaagttgacctggagacactctgtctccacagagaaggctacactccatccccagctggagtgtggaggaggagacagggcatccactatggccaaagctcttgcttccttgggatactcaacccagatttggctgcaatgtggcccccaggaagtagatgggctgctcaccctcagccctgcctcctgggtcaggcacttaggatcatcccctgtcacgagtgccaactgtcctgatctctgtggtgagaaagcaccccctgctcccttcctgtttcctcctacctcaccaggcatgaagcagaatatcttggtggcagtgaaaggccttgcacaatgcctggtcccctggtgtgggccaaacaggtcaggccaggccagcgtgcaagatggacagtcctatgccaacctggagttgccccagagtggacctggggacctgtcctcccttcccaggccccatttcttggaactgtgggcagctgtgtccagatctccagcagccagcatggtcaccaggagtgaaggggagatggccgcattcaccctacagatatgttgtgcttgaccctgccagtgttatacaaaattaaacggccaggcgtgatggctcacgcctgtaatcccagcactttgggaggccgagacgggtggatcatgaggtcaggagatcgagaccatcctggctaacacagtgaaaccccgtctctactaaaaatacaaaaaaattagccgggtgtggtggtgggcacctgtagtcccagctacttgggaggctgaggcaggagaatggcgtgaacccgggaggcagagcttgcagtgagctgagatcatgccactgcactccagctgggtgacagagtgagactccgtctcaaaaaaaaaaaaaaaaaaaaaaaaaaaaattaaactagtggccacacagaaaaaccgtgagatgtcacataaaaatccaaatctctctctcaggatcatgagctctgcaacactggcccggcatctctgcctggtacaacctgttggagctgagcagcagctgcccccttcagccaggtgagctctccggggtgccttagtccctaccaactctccgctgcctatcactatgcctgcttcactccctttggccctggcaggtacttgcgtttgtcatccttgatataaagttggatttgaactttatatctggtctgggtttgaagcccaactggtctgggtttgaagtccaatttgaactttatatctggtctgggtttgaagcccaactctgtcaaagaaaagctttctgattctgggcaatgacttaacctctccaagcctcagtttctgtttctataaactggggataattatacccacctcaagagaggtgtgagtggtggtgtgagggtgttgggcgaggtgacaagtgcactctgatgctcttcctagctcggcggccaaaactcttgtccctctcctctcttctcaggggtctcctatcattacagcagctctaggaaacccatctcttctagaaagtctcccagcctaaccttgggaaggaggctcccaccttccgagcctggaggcagggtgggaagaaggcttgctagtgaagggccaggaatgagagggggatgggacacacatcaaaagggcagagcggatgccagaaaagcccgagaaggtgggagctgagagacccctggagccgctaaaatcatgctgcgagctctggagagtggctcctggctttcaaaggcttgttagaccattagagacaagaggcataaatgaaggcctctctgtggcaggctcagcggctgctgcgcccaccaggcagggtggccatggcagcttcaggcctctggcagcacagggcctggggagcagggacatttcatcactcacagccttccctttggtctctcacagcgtgggaggagggagcggaagggagtgaagtggggggagggcggcttttaaagaaggctctggagaaaaaaaaggctgaaaacgccaagtcattggatctcaaattgcctctccagagaagtctctctttgcactttgttaggatttagagaaaaaaaaggaccagatcaggggctggggctggagcccagagggagaaggcagagggctccgctggaaaggggtggggagcgggccccagcagccaccaacccggggcaggggcggaccaccggacggagatgtgggtcatagataaaaggcttggtgacccccatggtcaaatgctgtaaggtcacctattgcttgtatgaccttggcaagtggtgagactttctgagcctcaggtgtctcctctttaagggaggctggaagaactaaataagataacagctgtaaagtgcagagcacagtgcttggcgagcactaggtgttcgccaaacactgggcgaaacctgtcccatagtgacctcctcctaccacccaccagccagggtgcgctatgtctactttatgtgaacaaccaaatgtgcaagcatgttgctagcagggagcccagacagggatgtgtgtatgtgtgccgtgtttctgcatgtggggatggctgtgagtttactgggcactgttccccctgctgttgtggcttggatagacacaccctgttttccaagttctaagccacccactgggccacccaatgtcctgagtctgctgcaccaggtgcctagctcatgtggtgccactttgggcaaccacttgacctctacgagcctgccaatgggacctgaggtgcaactgcttcatctcagagttatagacacagacgagggtgaggaccaggtgattcaagcgtgggggtggggagggccaaggcatggaatgttccttgagggatacaaaggaatctgagccatagggagtggaagaggagtgggtacagcagtggcctgagccttgggctttctgtgccaggggctgaggagatgaggacctgcctaacccctagaccttcaaccttgggcccgatgtctggccaaggaattgccttacctggcgatgacgaagaggacacagctgacccccaggtaggcgaggagaacatacatccagatgtctggggacaggggattgaggaaggagaagacgctggggttggtgccattgggctttcgatacaggatgctcacaccaagtgtcatgaagggcttggagaagtcgatggccttctctcgaacatgggtgatggtcaggggggccacggccagatctgccttctgcaaccagacagagagagaaagacagactatgagcaaagtctcagaatagcgggagacagaacaccattgctggaggagagatgagggtgaagtcagttgtcccagccccaggtcactaaccgctcttctgtttccacatttactaaccctccttcagggccagctcagggtgctggggagacaatgatgaattcaacttaacctctgctctctaagagctcatggtcttgaagaagagggtggtggaataaacatgcagagaatggaactctattaaagctgtaacccatgtgctcccttctcaaaatggtgctttgtcaaataaatacagttcagtaacctatgaacattcaaaaatagcttgtgctttttatttgtgtctttcaaaaccacaaagaggacacagaatgcaccacaatgcttatttaattctgctttcctctcccatccacttcttgactgcttcaccacattctggattttctatatatcctaaaagccctccaaatgcaagttgggcaaagataataccctcctttggagaaactagacaggcaggctgggcgttgtggctcatgcctgcaatcccagcactttggaggccgaggcaggaggatagtttgagcccaggggtttgagaatagcctacataacatagtgagactccatctctacaaaaaattaaaaagttagctgggtacagtggcacgtgcctgtagtcccagctacttgggaggctgaggtgggaggatctctatctcttgaggctgggaggtagaggctgcagtgagctgtgatcgtgccactgcactccagcctaggcaacagagtgagatcttgtttcaaaaaataaaaaaaaaaaaaaagaaaagaaacaaaagaagcaaatccagggcctttattaataggaggtggtgcggagtggaaaagaagggggtggggtaattctaggaatgctgtgttaataaattttagcccatcacaattttaataagcggaagaattaaagttcaattttttggtctgagattttcctgattaaaaaactagattccctcattcccatcccatctttccaggaccccactggcatcctcccccatgaggccccaatgaaaccacttcctgcttaccacagtccctccttcagccccatgttctgcacattccacactgtttaggatgtcctcttcttatagtctcattcccaccactgtctgccttcctctgcacatcttgcctcttccagaaaccctccctcgcagcctccatctctaaacttccatgaagccagctctgctttgcttgaatggcagtctgtgctccatgcgaccttgtgtctgatctgcttatttgcctgtgaatttctgagtgcggctggagctggggcggagtctctgcttcttttctccatccccaagccccatctcagcctctggaatatttgttaattaataaccttcccctctgagaggctgcccctggggcttctgtggatatttacatctcagaatgtgaactaagttatcacttcccttcctcaagtaggagaggacagaaagggaggctggggcctaacaacagaaaggttaaagacctttctggcaaggggggacctccctctgaaacccctttccaaggcaatgcctccaggtgtccatccattaacttggtccaactccattcatccactcattgtgtcatgaactccaacagacaccagggatacagagctgacccaaacagacatgacttctgccctcatggagcttacagtctagtaggggagatgggcattaatcaaactgtttactaaagggtacctgctaacactagctctgacttcactcatcttagaacaggaactagcaatccagtcaaaatcagatgtcaaggagggaagcgctagtatggatggaatcacagcttctggacagctctgcaggtgctcccggctgggagcagctgggaaatacaactttgacactgcctacccaatgtttctccttctaaaggcagcccccacaccccatcactgacacttggagtccaaggatttgatgaccttcagaacctgggaaagatagggaggaggagcctattagaaatggtctttcttttgtaaatgtctgaatgtgtgagttggaatttgcctggctgaaggcagaaggaggaatggggcaagctgccgccaccccagctcctggagtcctttcagttcagggtatatacaaaagaaagcagaaaaaaaaaaaaaaactctcagggagggtgtagagtggtgagcaagagaccgagtccctggtatcatggagcttccagttagtgagcccctgctggggctgtagataggatcccttggtggggtgggagcctgagtgagataccctgaaaggttcctttcagtcctcaagttctaggattctctgtaatgttgacgtgagagagatgtagaaggtctttgattccagaacttggcgtccccaagtcctgtcccttcaaagtccagtcatgtgctgcctaactctcttggtcaacagtggactgcgtattcaatagtggtcccataagattataatactatttttgctgtgcaccttttctatgtttagataactttgcatacacaaatgcctacagtattcagtagagtagcatgctgcacaggtttgtacctaggagcaataggccataccatatagctgaagtgtgtagtaggcactatcatctaggtgtgtggaagtatagcctatgatgttccaactacgatgaaaatgcctaatgacatttctcagaatgtattcctgttgttaagtgacactttactctatattgctttgggaggttctgtcctcactccaaagtcattatcattgctcaaaatgcctttggaactggtctctggaaatggagtggattcttgggaagaacctcaaagtcaatggcggtgatgaatcttcctttaacttttgatggcaagttggataagagagttatggctgggggactgagctgtttgtagccaatgattattccaagggctggtgagaaagctaatcacatggccacaggtgattggccttctggccagcccttcccccagatcctctcagagcctttgaaacctccctgccattcttcctgctctttggttttaatggggtcaggagaccaaggcatccgcagcattctatacctacggtggcaagacaactggccaatatgaccttcactgggagtttggatctgtgttctcccttgggcttcaggaaggctggagttctccactgcgtttctggttaaggcagaaaatactacatttcaccgttagttacgatttccctgagaaaggcattattttgtccaacttcccttgaaagatgggaacagatgtcaagcctttgctgtttcggttcattactcagaatgaaaggcccaatcttggcaggctcttcccacttgtgcaagttttctttgaggatgattcataaaatcataggctgtcagagctggatgagagaacttcaagtctattcgaggaatacatctattccaaccccatggtttttattgttttttgttttttttttttaacagaaggaaactgaggctcggagagaagctccttggtctttgctataatatttatagcaatcatgtcctgaatgacatcaaacccttgacttgtgcaacactttcattggtctaacgagtgttttgtcagccctcctgcctcaccaaggacctttctgtactatttctaaacctctggaccaggcaggatggtcttcccaggacattacttcatccccataagcagctttccacttaccaagaatctgttgggaccctcctggcttctcctcctcccagtgtcctctatccttgcatgaggtcacctggcccccacccattctaccacacccccagctccccaaactgaaggtaagaacaatttaacctgctatagctccatcttttgttcctcagtctccagatgccctggttgctggttgaatcctgccttgtactccagactaaaacctggacatcttcctaccaggaatggggttgggactgtggcctcagctctaacaacttgtcactgatcagccttctcttaggacaggggtcctcccaagggtctgagatctggcctctgactcccagcttgctgcctgtgtctggtgtccctgctggaagctgcctgcttggattcccaagtatagttcccaccagcttcctcatctccgttctccacctcttagttgggatccccatcagacaagccaagcatgactcagtgtattgcgtatgctgcctatgcctatgccatcttcccagtatccccgccaggtggtcaacatcctcgtcatattccagatggggacaagtggcttaatcaggctaggaggcttgtttaaactggtaagtggctgagccagtacttggacccagttcattgtgatctcaaagcccaacattttaccactctaccatgcaagccacatgtagtggattgaattatgcccccccacccccaattatgtgcaaatcctaacccctggtacctatgagtatgatcttatttggaaataaggtttttgcagatgaaatcgagttaaaatgaagttatactgaatgagggtgggccccaaatccaacgactggtgtccgtataagaagaggaaaagaggagaccgggcgcagtggctcatgcctgtaatcctagcactttgggaggccaaggtgggtggattgcctgaaggcaggagttcaagaccagcctggccaacatggtgaaaccccgtctctactaaaaatacaaaatttagctgggcatggtggcatgcacctgtaatcccacctacttgggaggctgaggcaggcagaattgcttgaacctaggaggcagggattgcagtgagccgagatcacatcactgcactccagcctgggtgacagagcgagactctgtctcaaaaaaaaaaaaaaaaaaaaaaaaaagaaaagaggatgcacagatacacacagagaaggccatgtgatgctggaggcagagaccggaatagcagatacaagccagaagcaccagggactgccggccacaccagaagactggagagaagcatggaacaggttctccttcagagcctccaaaaggaaccagccctgctgacaccttcatttctcatttctgacctccagcactggcagttcatggccatttggtgtggcagctctagggaactaacattcctgccacttagaccctgtgcaggatgcatggggctccttccacagcctgctgctgtccccaccccagcacctgtctcactctgaagagcaagcatcatggctggacccaccctgccttgtcctgagcccagtgttgcattcccagagacgtgaacttgactctggcccctgaccatggggcttcccggcatatacttcacgttgcctggcttgggagccctgcagctgcagaaagctgctggtacacccttgccacctccaggtccctctgctgcttccacagctgcctaagtaaaccagcctcactcctgccatgcatacgggactattcccaggggactctgctggcatcctgcccacatctttggtatgtggcatcacagaattcaccttctgctctttccccaaagtggtgggaatcaccactttgaatctatccgtatccatggtgctaattaaagtaggtcaggacttcctaatacccttaggataaaaaattcttactagggttgcttacagtcatgcgtgatctagtccagtgctgtccaacagagcttcctgcaacgatgaaaaggttctctgtttgcactgcccaatatggcaactgcgggccacacatggctgtcaagcatttgaaatgtggcttgtaagactgaggaactgaatttatactttaattgaattttaattaattaaagcttaaaattaaataaccccgtgtggctggtggctgccgcattgaaaggcactccaacatttcttacactgtcctccccatctctcttcctcccaggctttctgcagcccctctgatccatgttcatccagcccctcctcttacctccggatgctgcacatgaactgttctccacctggaacctcttcctccccaaactctttgtctagtgaatgccgacttctgcttcagatctcagcccaatcatcacttccacagacacaagcctcagaggaaatcagaactccctggcgactgctctactgctctcatcgcaccaggcacttgtcactcccagcactgatcacagttgtgattttagaggcattggccgattctctgggtgtttccaccccctcagaccacgagctcaggagagtgaggccggagcctgtcaccttttcactgttgtgtgccccatggctggcacagtgtctggcacatagtaggcctttcatagagactctgggaatgaatgagtaggatgttgctggtttagacgaggcacccagcgagcgtgtcctctgggtcagctgacagagcacatggccgtttacaagaggataaagcaagtcacagacggtgtctgctgctgagccacagcctccaagcttaagaaaacactgtgtccctcaagggccttggacatgaacctgacaaaccaacaccctgaagggtccacaaatttgaacagaggggaaacaggtgctagcccattcataagtgtcaaccgatgggtcaactactagtacctgtgattcattcaccagcttcctgagctgacagcagcctcactgcctaacagtgaggaaagatgtgtgtacccttcctgggcctgagaggacagcccaatttctgaggcccagcaagctccatccctatgcctctgtcctttgggaaggatgggcaggtcttccctgcttcatagaccccataggggtccccaggttggaggcaccatggactccgtgtcccttcagtcaagttctctccccacacctcataccctgacagttgtattagcccagacagggcagggcctgacctagcacagcccaacggagcggaaggcagtgggcccccctgcccccaaggctaggtcctggttacacactcccatagcccccgcactgctcctccgtgtctttatcactatgaaatttttatttgtaagtcactgtgggacgcccagctcctctgccaggatatacagcccaggagtgtggggagtgagcttgtttcactcactgatgtgtctgtagggattaacgcaaagcctggcacaatgtaggggctcaatcaaattttgctggaagaatgagcatcaaaatacccccaagagtcctgcttaccccttaccccagcctaatgggctgagctctggcgtcgggtctcctgcactaactctcgccagttcacctgatcctgtcccctgcctgcctctctccagagtttagagcctgctgcttgtgccctggccccggatgaacccacctgaacattgctacccctcttccttctgacctgtcagtggaccctagcaccgatagccctcacctgccctcattcccacctcagagaggtcctggtgaatcctcagctccacagagctctccagtcactgccctgggcaacctggctggtcgggggagggctgggctccacctttggagcccatctctttcccctgcccccaggtgagctcccagcatgtccagctccaaagagccctgctccaggctggggcaatgggattgggcggaaccatccctggcattgcagacagaggttggggccaacacatgcaggccagaaccaaggtctagttcctagttgggaggaagatgagacacagcgggggcaatggtagtgtgtctttgataacagatcttcccgtcacacctgccaacccacctggaggctgggaaaccagagttcatagtgccatggccataactggggttgggggacagcttcccaaatccatgtcctccttcacccaaccctcatcaccagtttctgctgcataaccagttgcccttcctggcttcccctgactgctgctggtgaaggcaacagggcatggctagccctgacctctcgagtctccaagatcttcccccaaagtttcctgggatgggtcacagtgactccccactgctctctgatctacaggacctgtcagcccaggccccagtctgggaaccagggaagctcttccacccagcccagaacacttgctctcattgaatatttatatctattcctatgttcatagataattgcccatttcttccactagaatgtaggatcttgaggatcagggaagggatcctgcctgttttgttcactgctgtgtccacggctgctagcatggggcctgacttgatagatttattgcagaaatgaataaatcagtcactgggagcactggaggtttaaaagagatcccccagcaagcgctgtctcaggagtgccatcctgcagttggtgggggcagggaaaggggagcaggggtcgggggataacaagtcagagagaatatctgtggatgacctgccagctagctgtcaatcttaacacttggcactgtggccatcgataaccttggaaaacagcaccatgaaaagcccacatatatttaaatagatggggaacaggtgctagaaaattcgtaagtatcaaccagtgggtcatgtctctgtggttggcacacaggcctcctgagctgatggatgtctgacagtgagaaaggatgggtgtgcctctcccaagcctgggagaactgcctggttcctgagtccccacggggaccagcctgtgcctatttcttaggaaggctcagtggaatttccctgcttcagggcgcactccaaaggatgcatcacaatctctatcgccatctccaaaagaatcctgtccccaccccctgcatgtccacaagggtgctgtctgtccagggctagccctagcacagtcctgccagtgctccgggactccacgcactcagctgcagccccagccaggccctgaccaggtggagacttcagcagcctctgccatccacccagacatgtgtcttagacctgtctgggacatctcttcctcattcttcaggtagcagcctaatagtcacttcctcagggaagtttgaggccttttcctcggggtatactcccaaagccctctatctttcccgttgcagcactgatcaaaatcttaatgaaatatcacttgtctgattcattgtttgcccccggagggtaaggaccatgtctgcctgggtcaccctcactccctagtcactgctctgggtctggcacagtatcagttgggtctgggctcagacccctctcaggcagcctttcagatcctctggctctggccaacctcatgcaggtccaatctgacagcatctcaatgcctgcccaactggccacctctggcctccagccctgtggtttctcatagacgctgctgcaagatcccaattggttcccatggccaccaagccaaacccagaatgcatgggagtcaggagctggtggataaacctgttttcccttcctctgtttaccccaagagatggtcctgagacacactttataaagtttttccagggtgcagactcacagactgagacattagtcaccctctatggcaaccagctcaataacacatccttgtgttgccttcctccttccttctccacatcccttgcccttggcactcattctttccctggcatcacaacccctaattgagtaatggcataatcccctgcctcaggttctgctctgcaggctcccaggctgagacattgctcaataaactttcgtgcaattgatgaaggaaggaatgatcctcagcaggggagcttgcatgtttcagctgctccttctgacctcggtttcccccaatactcccttcatccctcaagccctcttgctctcttacacctgtttgtccggacctggacccctgccaggctctttccaagcctttccccaggctggtctctgctcactgaattctggagctgacagttctgcagtgactctcgatggggccccaagtccctcctgcacccctcacctgcttccctggtctccccagacagaccctggagacatcccgagctcccccagggctccacagtcattgctctgggcaacctggctgctccaacaggagtccagctttgcagtttcccctgccctcaactgccctgtcccctccaggattctgacttgccctgggggagctcccagcatgctttacttgcaattgtgctggcccagcccaaaggaggtagcttgggcagagcatttcctggccacacaaacaagggtatgaggctcctcctgacacccatgcatgcgggccagaactcagatctgcttctggttagaagatggtggacatggtgggcactggggtcatggccttgacataaggccctcctctcacacaccatggctgggaagccagctagtcacgaccccacaacaaccatgcctctgggcaaagcatgcaagtccatgtgttcacccacgtgtccctcattcagcgaggctgctctgtgtgcgtccagcccatgccaggtgttgggacagcagccaagtttagcccatcaagtgctccccgtcggtaagaagagtcacacagggaaattggcacttctagctgtgccaccctccctggtctgcactcagtgttactgggaagcagagcggatgtgtgggtggtgcaacttctccataggaaagtatacaatatgctaaggctaccagtgatgactctttgtctccattgtgttccatacttcatcttggtccagccccatctatgaggcagggaaaacttcttatctggccatccatactgcagtgagatgtgacaacttagagagaaaagaatccatttcccgtggcctgcagagattttatgcatccccgttagcctccctcttgctctgatgcagggggctgggagagcagccaggacagaattctgggtctccgagggtgaaatttgagaataggagcactcaaggaccctgctggggctgaccttgtacccccaggaggtcacgcttgtgccaactcgtggatgctcattcctcatttcccttgacctccttgaggccactgaccctccccccctttctagtagcctctcttccttgggcctccttcaccccatgctctcctgattctcttccttcccctccagccttgccagcccaggcatcctgtggcttccaccctttcatctgtgccattcagggtcccaccccaggtcctcatctctgctctccctgagcagctgtcgtctccacctcccaggctccctgcaggatgtgctgatgactcctagagctcagcctccagccctgctccttcctccaagtgcccagccacagggccaccatctacagggaccccaatcccaacacatcccaaatggacctcactatgtttcccaaatcctcaatttctccagggggcttttgatgtgagcaggacaccatcacctccttaactgtccagagtagaattccatgccctgtccgcaactcctcgctttcccctacctcctctatccaaccaatcgggagcctcatcagttctcctgcttgtctgctggctgtgcatctacttccctcctttcctagagcagcactcgccctgtttgggtcccagcgatggcttccatactggctcaggtttggcacagcagcagagtgaccttcctcaagtgccaagtcgatgtcaccccctggctccacttcagtgggttcagattctccatagccctcgggattaaagtccagttcctcggttcagcacccgagactcttcaatgcctacctctttcccccttctccagcagcagctctcctcttggctccaggctctccactcttggggttctgcctctgcactccccaagtgggctcctgggcacctggtgccaggacacagaagctctggatggcagatggggactcccagtgtcagaaaagtccagtgccccaagtaaagtaagaaggtggcaccttggtggtgcctcagttccctgtgtgtctgatcaatgtgagtcagctcctcgaggctccctgtttggatccagtgggggtaaggtctaggtcctggactactgtggcctggcaggatgaccacggctgaggggccaccctcccaccaccatcacatttaatcatggacatactttagacagggaggctgtccctggaaggaacagtgatgagagggacagcttctgtgtactgagcatttactgagcactgggaacttggcgaagcattttggtgccatatctcattaaatcttcctaccaatgccaggcaggaggctcttttgttatccccattttgtagacatggaaatggaggccggagaaatggaataactttcccactgtcagctgaaatgtgctagactcagaatttgaacccatttcggttagattccagagtcatcaaaacacatgggaataatttaaggtacggatgtgagtagaagatttttgaaagaggaaacagacaagtaggcagtaaatatagacagagggaaatttagatgagagatgggggatggagggtataatcactgctctgtctgatcgtgtttattgttgtccctatagttcaaggtgacttgcggcaggcgagtgtgtcagcagaaggcgatgcatcctctagccaccccatcttcctctgtaacccttggaagaccatgtggcacgggacagaggcgagcagggagtatctgggaagggctttttaagtcctgttggtcagaggctccacccagggcctccaaatgggccccggggggtggacacttacaaaggtgggcattcatcatctttacgcctacattcagatccctaataaggaagtaataatattgccaagcctttgcatgctttctatgggctagtgagaagactaattatctgacgacactaatatatggttatgatgttattaaaaatggcaccaagctaggattaataggctcatcaattgtagggaattgggcttaacaaggtcccctgcatgtctcgtcaggcctgtaaccctgatgaatactgggcttcccaaagcaccgcctggctgctcggaggccgtggacgacactccctccttttcccagctgagggtcagcttagggagatcaggctgatgctgggcttctctgatcacattcccttgcaaacagctcttcaaagctgtggggccactggagatgttgtgagtggtgagggtggcccagccctgctcacctccgcacccagcctccaccttccacgtgatcttccttctcccctgcccagcttgcctctgcaaatgacagcctcagagcctacccagagccccagactccaagccccactcataaacgcaggggaatggataagatggagatgcctctggggcctgctgactaatttccataataattatagttattactaataacggtgacaacaccactcccttccgtttatattgaattctataatctagaagctgcttccccaccagttgtctcctctgaggctcacaacaagctgtgaagaatgtggagcaggtattattattctcactgtcaggttaggaaagtgcagctcagagagataaggggacttcctgaagccccctccccagcctccaaggaatagttgtaaggataaaaataaaaataataatagtaaatactgacatggtgatgacatgtaatacactatgttgacttagtcctcctaacaatcttatgaagtaggtcctattaatatcttttcccttttacagatgcagaaactgaggcacagagaggttaagaaacttgtccaggaatgcacagctagcaagcggaagagtttgaatcaaactgagctcgagttcatgctcttgaccatttgagtctcctattagacttccacaggagcccaatttgctggggactaggaagtgactccactgggccaggctccagccttcatgccttgagctccagcctccctccccacttgcgacctccaaggtctctgtaggcagctcccctcagaccgaggcaagggggcttaaccgaagtccctgatgctgtctgctcccatcctggagaggtgaagtcataacctttggctgatactctgtgggttgcaaagatctctgcatgaacctccctctgtcctggcccctggggtcaggatggttctttgcagaagctggaacacagggctacgaggcagggaggctccaaattctggctccaccacttcatctctttctgcctcagtctccctatctgtaaaatgggtgttaataacagtacctacctcactgggcttttataaggataaatgagagaaggaatctaaggggtccagtatggatcaggtccttgaattcagcagcagctccttgatagaaaatgcttcagtcaagttgagggccctgagctggaaggcaggtcatgtttattgtgtgccaggtaagcctgtggaaatggtgccttatttaattcccccaacaaccacaggagctacggtagttgctaatgactcctattttaggcagggcatggtggctcatgcctgtaatctcagcactttgggaggccaaggcaggaggattacttgaatccaggagtttgagaacagtctggacaacaaagtgagaccctgctctccaccaaaaaaaaaaaaaaaaaaaaaaaaaattagccaggtggagtgcctcgtgcctgtagccccagctactcaggagactaaggcaggtggctcacttgagcccaggagtttgaggctacagtgagctgtgatggcaccactgcactccaccttgggtgattctgtctctaacaacagcaacaattactcctattttagaaataaagaaattgagccttagtgagattgatgaacttacccggtcacacaacaaaactgaggcttgaacccagacctgctgggccacagcctgggcgtctgagaactatgatgtgtttgctcacagcatcttaccagggaccctcttactgaacttactctaggcccagtcttctgccactatgacaacaatcgcgtgaggaaggggtgtcaacatgcccaatttacagagggagaaactgctcagagaggttgagtgacttgcccttgttcacaaagctaatgaggaagaaccgggactcgagcccagggcctcctaattcctcccttgtggtggtgtctccagcctgtggcttctccctcttcctcccaatgtctcaagaagcccaggtacaccccccaccccctcacctgcctgcttgggctcccagctgtcctcagtcctctcctgatcccaggcagaggaagaggctgactccctggtgcttccagccaggccctgctcatcccttcttcccagctctcagcttcctggactcccactagacccagagttactcaatgcagtgacgggtttctctctgtgtccaagaatttggtgaagtgtctcatgtgggtgccttgccccatagctggggcatcctctggtggtttttaaaggagcagaagataccaagaagccacaggcctcctccagagcaagttcatcaaagatgccagtggggccggctctgaatcagatggaggccagtgcatctgtgtgtgtacggaggagaatggcgttgggagtatgagcaaggcagcccatgagagctggggtgcacttccttcagctgaggccccccagtcctcaaggttgcagcattcatctccatcactcctgtccccagggcctttttctgccaggctgcccagccctgtggtgcagacagttctaggccaagtctccccagggtcctgagccctcccatgctcccatccatgcttacgtggtcgatgagctccttgaccatgccgttccactggcccttgtcatcctgtgccccgtacttgccgtcctccaccagccggatctcataggagaaaccaaggatgtgggccagctcctttagcaggtcgatgcagtagccctcgaaccggtcattcccgtatagcgtcctgtctgatttccgaaacatgacgaagggctcctcctgcagagacagatgggcagggtgtgacgaagactgagcagctagggcggaggcaggcttgcactggagagtcagggctaggacctctgctcatgtttttataaaccccttggagtggcttagacaaagggcccgtgaagtcaggagcgggaaagcacatgtcctgagagccagctgggggcctcatgaatggctacctggtacagggcgggagctcagtaggcacttactgatttaatggcccagtggttacagagctagtgagcggtggagcagggctttgaactggagacccatcccaaggcccatggtctctttgctgcactagtaatagaggctcagcgtgtggtccctgcacctgcagcatcagcatcacctgggaacttgttagaaatgcacattctcaggccccaccccagacctaactgaaccggaaactctggggagagcccagcgatctgtgttttcagaagccttccagggaattctgatgtccactcaagtctgaggacgctgctgtaaaaagcccttcagaaagccgtctgctctaacttctcttccaactccaatttaaaagattagatttacatgctcctggatgccgttctctctttccaagaacctcctcagtcccctgtgttaggatcccaggggagtgattactggtaacagggacagctcatcggtaggtggctgtgccgggcactggtcaattagcaaatgagtttatgcccatggggggcctagcacagagtccagcagagctcagcagacaggagctggtatcgcctcatttcaccttaatgtcagccctctggggtgggtatgaataatcccattttatagatgcagaaagtgaagttcatgaggatatgtgagttgtgcaagcacccctagccggcatgagagaagatctgaattcaggttagtgtgaccccagagtgcgagttctgtgcctgaggcccatggtgctcctccctcaggggcaggcgatccccaggaaggtgcttgtgggtcagagatgcctgtcccatgccagaccccccaccatccaccccctccacctgccacaggcttctttctttctgggtgatagggagcctgggaccggatttgaacagagcatgactttgtctgatttctcatttagaaacaaacccctggcaaccctgcaaagaataactgggagaagaggcagaagagccagtggagagaggcgatccacttcatccagtcgagatatgcagtgtgaggaactgtgggctccgatgcagcaagtccgaatccaggtcaacacgcaagtccacgcttttgccggcaccgtctatctggcttcactcacaaagccccatcccgtgtccatgatggatgcgctgaactcccagaaaattcaacacaattgagttcctactctgcaccaggcactgatttaaactctttgtcacagactgtttgacttaagcctcactagcttgcaagatagtaacactgtccttatgtgatagatgaggaaattcaggctcagagaaggtcagtaagttgcccaaaatcacacaggaactgaactacagtgatgggatccagttccaatccttcccagtcagctgcacctctctctggcttggctctcctgtctgttccctggggtcagaccttccggagttaatctgcttttccagatccccaaatcaggtaaagggctgccatcccagagcctgttcctggacaactctagtcttcttctgactcccctgagcctccttccttcgccccctgccctgttcctgcctatagctcctaggcctctttctgtcagccaaacgtccccagacctgcctcagcaccccaacgtgacagaatgtctcaagccttcagtggctgtgtgaccatggttagctgacagaatgcaggaaaccaggaagctcatgtctgcatgcccagattaaggcacatgcttaactatggaggtgcctcatccttcactcaactggcggggccattcccttgacctcatgagccccagggtgggatgggcagtggaagacccggtgaagacctttgtcagaggtcctaggagcagatgctcaccagtagcctcctgctgggctcccgctgtggcggcaagcttgagcctttggccctctctcccagcagtgctacttctctaaatcccatcctgccccatgcttgatccactggagcttttcaacagtcccttgggatgcttcagggaaagaactggtgggggtggggcagtctctgaatccccaagggattcccgactagccagggattctgagtctaactgggtaggaagctggaccctcggctaggcgccatgcttaatctcagtgcctctctcactcgccttccaaccaagcaggcagctcaacaaggttggagaagagtccacgtggggcctgggaaaagtgctgaggctggaggaaggaggacatcggctggtccatgcactgccttcatgcaaattcatctctgggcaatgctcctgcaccctggcatggggcctggcgagcagggtcttttggttgatgctcttgtgcaatggacaagttgcaccactgcacctggtggccctgactttagctgatggaaaggatcagagagaaggtaccatctttcccagaggatccaccaaccacacacagaatcctaggcaaaatttacctccttctgtaaaatggggaaaataatagaacctgccttacaaggttgttgtgaggataaaatgagtcagtctacgaaaagcactcagaatagtgcctggcaactgttagctgccaatattattattattattaatcattatcatccttatctttttcttgtatgctatttggcgggttactgcagtgacctttgcagcctagaggccacacccaatgcatcaaaggttaaaactcatggttgatagcggaaaaccatttcaggaaaggtccctgagatagctcacttcctgaccctgtcttcacgcccctccctggcctgatcctctaaaattagcacttcatttgtgaagccaccacagccccagaatctatacatctccatataaatacgctgccttcagagcagctgtaaaatgccattaatttcgggaagtgctttgcggatggcatacatatttaacagccaaagcccagagcattaaaatggtgctcgccttagtaatgtgtctctagacctgcaacatttcctagggggtaattctgaactccgccaactacttattcatggactatttcacaatttattactggaaatgtccagacagccaattcacaagctctctcggctgctaatcgattgctcagtgaaggtgccctcaatttcataacttcacgctcttctattgctctgggagaacagccataggaacaggggtaatatttctcttcaacaagtcacggaaaacaggggtccagaaaaataaccgtttctgactttccgttgtcagggctcttggtccggtttctctccgatcacttaccccagcgtgcaagccaggcctagcgctaagcctctcccagtgtgacagggtccatggagttggaagagggagtcttgggggttatccccaatttgggaaggatccagggattagctacctgatatctgggttctgaagctcctttctgacaggtaacgtcagcccatagccacacatgcacgcacaagtatatacaatgtccttggcacaaatgcaccacattttcagatgtcctgtctgcctagcccttctcagacacagaggccaaggaccttggacctgaggccttggcttcaaccagttagaaccagcacacagtatcaggagtcctattctcccagcaggaggggcctagaatcgttcccagcctgggatagttctcccagccaacactctagccccaggtttttcccctctcctgctgctgggtgctgagtgttgggcttgcctggcaggcaattgagcctatgtgggtcacgatgtgcacacggcacaaatgcacccatcactgagtatccagatacccgtgtgtagctggtcctacacccacccacacacccgcacgcatgcccacaccgtgacaccatggctcacatcggcagccaaacgagtcttgaaccttcaaaagctgggcccccaagagtgggccgggtgtgttttctcagtgtgtgagctgaggtttgggcagatgaatttttcatgagctcgtggaagagcggaaccagaacagaggctggggccgggcggtgagagggcgggggagggcaggcgtccagtctcctgctgctgctgtttccatctcaggaatggggaaggctgccagtggctctgaggggccagaaagggcagtgccagggctctgtccatctgtctgtccagggtaaggcatctttagcacctaacgctgggggtttaggagaggggagaatagcaggtaggtttggtggcagctcacacagagctgctgctttctgccacaccagattcctgggaaagaaaggggaggagaaactcccccttatcaggggtcttggatccaggccctgttccctagaggcagagcagtttgatgttgtgtactggtaccttgggacctgcctgtcactcaaagcactgttgccctgacaacatcctcccagacaggctggggctgtgctctcagcaggaggtgctggccctacattcaggctgcgaagcatggggttggattttcagccacagtggctggggctgggccactccctgtcaccttttagctgtcccaaagagcccaagcctgagagcatcccctagggctccaagacatgcagaccatgcagagccttttgggaacattctctggagcatctggagcagctctagtttcagggggccctaggccagtccttgcatgggagcgagcatctctcctcaggagactccaaggacacttctggctagacagactttcttggaagcccatgtaaagactgtgtcacatcctctatccccatcagggatactccagaggtcattccctccattcccctgcctccaggaaacagtaggcttctctcactgccccatagggggaagcacacctcaccctccggtgatctctgggcagtggggatggagacagctgaatcatcagtcacccccaggccatgtgagtatttgatactacatgatggggttaagatggtcagtggccccatccataggcggtgggatatctgcttcaggagctgagaccgtggccaaggtagaaggtgaggtggtggttgatctggagttctatatctcagtaggagactaggactatgagggacccatgaggctgcaaaccctaatgcctccaatggccagctgagaaacacaactataagaagcagcccagtgtaaacaaatagggagggctcgggggcagagtgggggactatggtgagccagggaatggccatgaaactggaaggcactcaaatgcaaattaagtttgtaacagaacagcctgtgctagagatcacctctgtggccatgggcaggggtctttggtgaagttcagggctctgcctgtggacagaagtggagattttctcaagatctctcactcagcatgctgtattcaagctgagctcactggggactggatttgtaatcaataataatgaataacaatagcagctgtcacttagaccgcactctgtgccacttaattaatcattcatgctctgaactctatgaagtaggtgcagttattaacacctccctttttcaggtggagaaactgaggcacagggcggataagcaatttcttagggtcatatggcaaatcaacatcaaagccaggactccaccccaaaggtctgtgcttttgatcatcaaactgttctttcctcatgtcctggtggcactgcatgtcccaaagagctctggggttgtatctgcccagatgccttgcagctgagaggctgtgggacagatggagctgtgaccaggctatgagccaagaggggttctctgctttcctagccctgggctacctaggaaccagcaggatactgggaatgcaacctctggggattcagtgagcacagcaggtcggggatctttgcaagaagctgcaagtattgacagagaagctgtaagcactcacaggtcgagagcatggggtgtctcctggattctgcctctgcttatgtagcaaaaatcccctgtgcccctgcagaagggttttatgcccttgaaatcaggctgctaccattttaataaaatttaaccccttgatctttcaaggtgcttatattttgtatccttttggtatattacctttagcttgcctcttactgttcagagtattgttttgtgactgactcaccttagctcatttaatcatctctcttcctaatctcttaaatcatcctagttttacctttttttaatcttgccttgtgaaaagtgttttatttatatctcacattttatgcagctctgcttttaatcttttagcacctttttattattttatttttacccttttatattttagctttgtcacacttttatccttttgctttttgacatttgggtgttacattttttaccttgtctagtcagagctataaattatttaatttttcatctttcttactatctttcctttttatctcattccttatcttcattttctctttgttattttccttttaacctttttattttgttctctttttaaccctcctttatcttttctatttttatccacatcaatatccctttaattgcccattagtcttcaccctaatccctttgctcttgttatttgtttattttcatcctttacatttttacatcacaggttttttttttttttaaccctgttcctcttgagatatttttgcttattggttttagcagactgatttttatatttgtttagttaacaaaaagttgatcaataaaggccagcaggatgtgaggttttagggaagaagatagtaggggtcttgccccaaagagggggacaggtgtcccctaagaccacctcttcaggctctgtgggcagcttgtctggagccaccgtgagatctccatcatctttagctcagatcctctcaatcatcctaaccccgagggccgatggtgagactcacaggctaacatttatctctggatgccgacaggatgcctggtatctgccactcactgggctacctggaagaatggttttttccccattacttcccttcctgttccatgacatctgccacccagccaccaagcacatatatggtgaatcatcccaggtagggccacccagtagggcctggttcagctgcctctgagggcacatgggtgagaacaagccccatctgagcaccgtggaaggggccaggtatagggtgaccagtctgtcctgggttctgctccaaggcagcctcactatatccaaaacgggttgaactcccttttgtgtagaggaatgaccccagcatatggtccttataaatatatttgctttattatgagtcagagctgactagagctagcattgtcctcaaagggtcttcagtcataattcaccaggctgtgactgggctgcctctccccaagatggctcggcttgagcccccaaaagcagggctgtgtccctgagaggatctgtcctgagtctctggacacctctgaggccttccaggagggacaggcacaggtggagtgggcacagccctggcagcacaagggggtcagcagcctgggtctgtcctcctgcccccgcatgagctcaaaggtgcagagagcccatgggaggcccccagagttgcttcttggtttgaaacaggtcaggagaaggcggtgctattcagttggggaatagagagaagatggggtgtgattccaggcagggggtgtggcagtggctgacggctctcggaagggccactatagaatgcggcatgtgtacaggctcccagcacctgctgggctctcgaggtgtggccacagcacccaccacagctggggtgacttgtgggaaaggcttttgcctgggaactggggtgggagaggcgaatcctcactcaggttgcaatgggctgtcaaacccccttaattccaccatccagcatggttcctactcagacatcaaggacttggggagtgagtgggagtgagacacaaaaacgcagcggcttccgcccgtggcagcgagcagcgctgctgcgctccagctgctctctgagaacttcctgctgactctaaaagtctccacctacctgcagcctccatcttctgggtgggggggatagaggggactctccagcccgaacggccaccccacccccaggtcggacagtccttcctgcaggggctgcaggctcttaccagcactgtggtgacaatgagtgatctgtttgtcagagagtcggtgacattagggcctcggcctttggcaacctcagtgatgttgagcccgtcggcaggactccacaccccaacctggatggacacagacagaaaacagggtgccgagtccttggtctacccatcttcctccatatcgacaagaccttcatctcattcccattcatcatgagcctcattgtcatgatcatcatcatcatcaccactgccattgtgtttccagttataaccgttctggacaacatccctgcagctctccctcctctcctgacgagggtcccagggtgtcgaatctctgaattctgccacctcccttgctggcaagcccatcacagctgaaggggaaaatgcagagagagacagcaaatgcgaaggcagccccaggggtctcagggctgagcagatgccaatcaggggctggagggaatcaggggtctatggtcagtgccaggtcttgccctgggacacagtctttgtggctgttttggggtggcagcacaaggaggggatggacctcactgggaaatgctgctgggtttaaaggcagtttgctttgtggttttacatttaaaactggcagacacacagactaaggtagaataatctctctctctacagcgtccttgtggatatcgggcctgaggctagaggtagagaaggaaaggtcaagtttagaaatcatcctaaagccctgggcctcttgaagatcctttttgacccaactctggccagctctgcctggtctcagctcctctcactcaaggaaggcttctgcatgcccactctgtccttggcccagttaggggggctactcaggacacttaatcaattaaacagagaggctgaatgcaaacatcccattaagagagctgcgcagagcagacagcagagagacatgtaattatgcttgggtaattctgccttaatcctcccaaagccaccggttggagctggctggatcagctatgacccggcttagcaaacaagtgataatatgagaggcagagtagctgtgtttgggagctcagcatcctctcagggcgggatccctgcctacatagaccacccagggccttgaggagaggaaagtggtagacggcatcgaagaggctcttctcttaagtgggctgagctcagagccaagctcactttgagcgtgcctagcagagcacctgggtgcaggaggtgcttggcaaacatctgttcagaggccacatgaagagcacagaccctcacttgagctccaactgcatgctctgttagataccaggtgctatggagatgtgaggccagttaggactgaggaggacccagcctgtggaggctctgtgctcacagtccgggtggctgtgacccggtgccttggtgagtgcctctggcaggctaacctctgcccagggataatagagtttttcttgagtattagctacggccaatttgaaccagctgcctggagggctgtttggagaaggatgttgcaggtgggatcaggtggaaagagtactcaaatgacggattattgatgccttttatggcacagggtgggaagtagtggcatatgtgccacctaattgccctccctagaattttaggttatccctagagatgggtagctgagagagcaaaagtgggacagctacttgagtgaatactgcattcactctagcactgccagaggaggaagggtgctctccatcactgcaggagcttaaatagaagctggaagatcgcttgatgagaactcatagagtttgtgtagggttgagcaaactggcccctgtgatcttaggaggggaggccacagcccctgttattaagggactgatgctatatatggtgtgaaataattacagagtaatagggaggcttccccagccacctcctcccttgcacagtggctcccatgagtaggtgggaaagtcgggagagactggaataactgtggccacaggtacaaggaggacagcattgagctaggcagagccagcctttgcctgagggacagaggtcacatcctgcaaccagggcaattgtgtgggcaatggcctggaggtccaggagggagggagcatgatggggccatggggtatgtttcagggaaatgtggaaacgaggcccagaagggccagttggtgcatttcttggagagctgaagtttaatgacttggcactagggagccatgggcagtttcagagcagggcagagctgtgcttggggaagcctcatctgtgtgtacactctggatggctggagggctcaagaaccagggcggcatgttaaaataatccacataaaatgcttgaaccagggcactgccggggtggagaggaccgaaatcagagtcttgagccccagaggcatccgaagtggcccctccactctgctggcttctgctcactacatttcatacacagcaacttgcagggttggggaggtgcccttgtggctcccagggacccacttgctggggacagagtgtggctgagcccccagaatccaggtcccaggggatgctgtgaattgagggctcgtattaaatctcccttcttggcccagcagcctgacattgacagaatatgctgaaggttcccagggactgggattggcctcattaaaacatctctatgttagccagatgggaggccccagccccaggcaggcccgctttcctggtccaaactctctggaatcgcagaggccttagaagcccagagcgaaggagctcagaatccatgtgcttcaacctctttccaagggaaagaatcaccttcagtctcccagacaagcaactgctctatctttgcttaaatgtctccagtgacagtgagctcactactcacaggggagatactctctggttagaaaggttttatgttttttatattcttaaatttttacccaagaacatgtctgtccttctgctccatgacagccctgcagggactcagagacagtccatccaccccatgggcctttgttatgcttccgaggttaggcatccccaatgacccttactcacagagtgacagtgtgggtgtctgctgcagccaggccactggcttctgtaccctccagtccaaccaggccttcttgttctctgatgggcccccaagagctacaggctacactggaccaagtcaatccctgaggggcagctggactgtgtcttgccccttgcctctgggcctctgactgaggtctgccctaggagatttaagaagcccctgctcctccgcctgccctccctctcctgagaccacgcaccttctccaggccatcctctttcaggctgatgatgtccagatcaaaatccgtccgcaagccactagttttgttgaaaacaattcgtccagttaatccttcccattgagcctgcggaggggagagggcagagcggcaattcctcgggcttataaatcatcattcggtacaactgtacaatgcttcattttaattactccttgcactgatactgttcccccaagaccatgattaattaataatcacctccatcattgctcgggctgcggtgtgagccagcgatttccataaattctattatgctctttagccagctttacatttgcaccttctcgtgtacaacatcgatcttggatgcgctcaaatgagcccccgccctgaagtcatgggaagggggagcccatgtcagatcctgggagatgggtagggaggcaggcgggcagagtagggcaggtgaggcctgccaagaagcagaaaagccaaagggccaagctggccttggctgtagaaccagacgcttggcatagccccccgaaaggcaggggagaccgaaatcaccccccaacctcccagctccagccccatgtgtgctgtggttaagaactctggcgtctgaatgctgggtccaaccacaattagccgtgcgaccttgggtatttcattttacccgtctgccccagtttcctcatctgtgcaatggaactaatcattgtgtccatcttaccaaatgctataagggtgaaatgagataagtcatataaaatactgagaacggtcccggcacaagatgaacactggataaatggtagcttttttgtcatttttgtatcgtcattagcgtcattaataacacagagagaggaaggcagaggttggggcagacctaaagtgggaaaagctccatcttctacatcaggggttggcgtcctatggctagcgggtcaacctggcccctggctgcttctgtaaatggtttattagctcacagccatgccccccgtgtttatatattacttgtgtgctgcaactatggagttgactagttgcagcagagactgtgtggcctgtaaaatctaaactattttctatgagcccctttacagagaaagcttgctaacttgattctagataacatctttcctgcgggctgagagcactgagtctacgtggtcctttcacactgttcatgccgtgcaacctccacagcagccatgggaggtggccacgcaaggatcatggttcccactttacagacgaggaagcagacctcaagggggccatgggtcgcccaagctcacagagtgaacaagaggcagagccaaactagaacccgtgatcccaggacccctcggtctggacctgtttccctcctccaggaacttaggacggcagctggtgcacagttaaatacccgagctttctgtgtcaggggcaagaacaaggcccacacatcctggagtccttgggaacaaatgtgcacttgggagcaagaggaggggagaaaatctgggagctcacacagccagattgggccagagagagggtaggggagggagggtatccggagaagaggcacggggcaatggaaggtctgagtagtgggagcctggctcccagtccttgctttgccgcattgggttcctaaccactccgagccatgctcccttgcagattctgaatcgggctccacagcctctccctgcggaatgcccccagcacccatgcatacactcacagttcaacccacaaggtcaggggtccacagttccctggagtttcattgacaaatcccaaatgaaaacccttagacatctccaagcacatgggcagctccaaggtacttttacaggtaaatgggtagttgggtaaatgtgcatatgcaaactcaggcagtggggctgtgctttggaggagagggaggctataaaaccaaagtggttagaaagtgggctctgcacaaacaaagcaaccactctgagcttcaggaagagagaaattacctacttcacaggtataaaaaggcatatagagcgctgagcacagtgcctgcatacacaatcacaaggatgtgacagaggttattatttctccttcgtggcttccatctgtgcagctcccttagattagggctggcccttggctgggaagggaggaccagtcacttgggccctggcccaaggctccagtagaaagctggtcacagagggctattatccttccccacatgagcgcattcagtcctcactgtgaccctgccaggtgggcatcagcattgcccccattttgcagatgtggacactgaggctcaaagagggactgaatgatgcaggtctcaagtattgggtgggacaagacagattcgttgcagtagcagtgctgaaagtcctggggtcgaggcacctaaggtggagtcggggaagcttacatggtgcctagggagctggggaccgaggggtcgggaacagagattaaaagatgcatcagagaaggtaaaagccactgtttatgacttcacagggaaactcagcttccctcaggctggctccccagtccctccgccttctctcctctgttggcctcacgccttcaggctatctcttggcccccaggggaaatcacagcaggtgccttcaaacctgcactgtgagggaagccttcctgcctgtcagctacagaggtataaaatgccagcaggtgcacggcctgtctgtgggcgggtggacagggcaggccagggagtgcaggcagctcctcccagtgacatttcctgcgctgcccgccccctctagccaccgctcaggacttgctaaatgaaagatgcttcacacgctctgaactccggcctggtattttccagctcctctcggaaatgccaagtctttaaaatgatttactgtcatgcaatcagatggggagacgggcaagttggaaatggtctgacggaggactgtgctggggtcgggcaggcatctgaggttcggttgtggccagctgtgggaccacaggtaccacggggctattctgggccttagccatgtccatggatgtaaaatggagataggataaatgtttctgaaagggttctgtgagggagtgtgagcagtgagggtcactcgttgggcctgggaaggagaatggagctcctctttctatggtgggcagtggtgaatctgctcccctcagggactcacggctgagcctcaaaatttccaagggttgaggggcaaagtgtaaacagggtgggtgtccctgaaacaatgtggcctggagacctggtagtggaaccccattagcaaacaggaaggcacagtgataacagtagcgatagtggaagtaacagtgatggcagccaacctgttcagcacctgctacgagccaggcgttgtccctagtgcgacacacgtgccaaaactcaccaatcctcagaacaacctgatgataaggtgctatttttatctccactggacagaggaggacactgaggcacagaaagcttcagtagcttgtccaaggttatccagttaaaaagtggtgaagcttccaagtcacttttgtctggctcctaaggctcccaaatttcccgattgagccagaggagcaataggatcgaggtgtggcctgggacaccgacaccctcacagtggcctcacacagtggctgctcagctggaggcctgctgaggaagggggtacagggggccagaagtcaggtctcagagttccctgagagcaagcggatgattgcccagccagggccctgctcagggcattggacagtgggatgtcctgtgcagttttgagggatgggaagctggatgagaagggatcatcaggccctcctatgccaaaacatctgggactggagtcccttctaggggtgaaggaactacaagggactccagtcaggcactgaattcatccctcacaataactgtgaggtggagtttgccgggtgtggaaactgactcagagatgtcccataacgtgtctgaagccacacagctgggaagaggtagagacgcgatccaaaggcacatgtgtggtgccctaaagcctgtatcttatccacatttattgttctactgtgtgagaggagctgtacttggcctcatctggaagcagcgatggtgaacttgggacctcaggggaagctgccctccctcaacccccatccaaggtggggagtttctctgctgtttgctctcgtagagctgcctttatttacatatgggattctctcctttagtgctgtgacctgatgcctccctctctaggatctgcatgtgcacaggcgagtctgttttagctctgttgggcccccagggcatagctaggagcctggaacccagctgccagtcacaaagtgggattgaataaatgagtgtgctcctaagaaggcagctggcttcatttccggcccgctgtgattgttacagagagctcatttgtcctttctatcccgagtccttctagagggcttcccccactgcccttggtgttgccttggacatggtcactccctctggcccaggatgactctgcctagatctcatactccccaattttctttgtctatcatctgctgggatttgactctggccaggtcctgggttaggtgctttgcacatagtttttcactgtcttcccaacaccgccttcaggcaggcactcactatatcatactgaagatcaaagagttaatcagctcacccaaagtcacatagctagttgtaacagagccaggatgcaagttcaggccttaattttccccatccataaaatggggacaataagccctgccatccaaagcttacaaggacagtggcagatggagaagcctttgaaataaaagtaggcactgtgtgttccatggtctaggcagcaggacagtttccatattctctggtttctctagaatcagctccattgatggggttttccacaggagagctggtaccaggagaggtgggtcccagtgggggtgctggctgggaagttggtcagtgggcccatgatgtgaagatgagtttgtggggctgattattatgtattgaccctcctcctgcactaagcactttccacgcaatgtctaacttcatctcacatgcccacgaggtaggttatgcttcatatacccatttcacagatgaggtgactgaggctcagcaaggctctccagctcgcccaaggtcatacagcgaggaagcaaacaccctcatctgttgtactttcaagcccacgctgcatcttgctggcaatgctgaccagctgctgagcacttaccacatgcccaagatgtatgcccctcaatcatgccataagtttggtcctatggagcccattttcacacgggaaactgaggctcggagacatgaggcaacttgcctgaggtcacatggatgagaatcaatccttcctgactcccagaccactctgctgctctacagggcccacagtcccggggagacaacactggtgggggctgtggggcactcacctccttgatgaagttcatgaagcggccgccaaagcgccaggccttgtgccgatggcactgcagggagttcacggtcatctgtggtgcccgctggtagcacacggacacgatatggacggcgtcgtacagtaaggctgcatcagtctgcagggaagggcctgcctgagagcggctcccaaggccctccagtcctcagcccaccctgccctgtcccccttctcctcccttgccacaggtacatgatgtcctggtgagcgaacaggcccagaggccctggaggtgactctgtctacgcctctgaggagtggccaggcttggctgactctgctgctctacaaacatcctgagcacccccctctgcagcttagaccttctcctgcccacccaccccacccctgctacctaggccctgaccacaccttcttctttctgccttctcggccttcacacctgtgtgtcacagcctgagttcctctgtgacctgcatctctgggccttattcctgttctttgtgaccttttgcttacatgtctggatccccatcagatgggtcccttggggagggactgtctgtttcacgtttgtgtccccaatccctagcctggggtctggctgacacatggaaggtctcaagaagagaagtggtggagggaagaaagaaacaagaggaaggagagaagaaaagaagggaggcaggtgggaagcccctggaattcacctcacccagccgccttaccatcatcactccatccagcaggccagactcggaccggggagctgcctgcagccgctccatggaccacttctccacaatggccgagacgtgtgggttgtccacattgagaatccggaatcctgtcaggttcacgcctgagtagcggtagggctccaggtctaaagcgtagagatcctggatagagagaggtctgtgtaaaccaaggcatgctcactgctgagaactccagccccgcctcctacccactccctaatcagggccgccccagggcctgaggtcgcagctccctgcaaagccctgcagagggggtgcgggatatcggggtagtcacaggagcacccataggaccactgcacctggagtctgactcagaacttgggcaactgatcctccatgctaaccaggggatctcagcctgtttcttcatccacaaatggggttcaatcccctttctaggacccagtgaaatagttcacataaaatacccagcctcacatgcagaggaagcttaatgaggctgcttcctttcaaaaggggagacctactagttctgggcatcttgttacacagagggaggctgaagggagcattttatcccctagaagaggatatttaaaaatagtcttttctgcctaggactcaaaaagtatggccctcttctctcccccttttcccccgatcccagccaggacctcctcatcccttgcctcctaggagcagctgagcagcggtcagcctgtctgtcgtgggccaggcaggtcctgccaagggtccaggagaacagggtctcaacgcaggtgaggctggctgtagccccgccctgcagctctgggtctgggggcagggtgggctggtgaaggaaggaggcagagaggggaagcaggtggagggagaagccaggtgtccctaagctaggagagatggcggcagaggacgtggcaggtgggagtgaggaacaaagctgagctctgtcctgttgaaaaccacgcaaacctggaaatcaggcagaagggtagcggtgcgtttttccaacatgacaatgaaacatagtttaccaggccctccagtattacttcattcttctggagaatgcacctgggtttgacttcattgtcagctacttgttaaaagctcagactctgggttaatttgcagaattttgtcaaatagaggagatactccccaaggttgtggttttattgccttacaggacattaatccattttctatccaacctagaagtcttagtctatgctccccgcaaccctacctgaaatacctataaatacccaattcctcaaatgctccttgagtcagcttttccatcctactggttccctcgttagtgagttgaatccatctctgacgcatgttccttctatatttgcataagactcatggttttgattttttgaaatatatacttgcacagtctagattggccctatcccactagtggggaaactgagtcttgaggtcactatctgagctcctcctcgtctactgtctatactctcccacactctcccctcactaagctgccctccttctggcccccagcctgtcttctcccctgggccccccacttagtcactccatctggtgctgggaaggagaggctggggacacacttggggtgtgcttgactctctgtgactgccaccgtcatggggaacatccagccccatcacagccgcagctttagtgaaatcaacaatgactcatggaaggatgatgagtgataaagcctagagacctttcatgctggactggcttcctctggtctctgagatgtctctaatgggcactaaacttatcctgttcctcctgcatccccaaagtggcctccttctggaatgcactgtgttggtttcctcttcaatgatttggggagtagggaaggggtttggagcagacttgagcccaggcaagaaagtctggtcccaagcttgcccaaataaatatggccttgattccaggtcaggatctgggatggggaaggggctgggtgacagaggagggaggggcttcagcagatgcgggcttccctctgagatggccagagggtgtctctgtggccccagtgtcagtagggagtggggggtggcagtgctcagccctgcacaaggactccatggcttcatcttcacagccccctgtgaagtaggcattgaatagcactctattctatttttatagatgagaaaagagagttggagaggtgaggtgacttacctaaggtcacatagctcatacaagtcaaagttgaatttgtacccaggtctatttcaatggtgtgctgccactggctcacactggccagtgggagctgaatgttagcatttcttcccaactctgccttcagtgacattacatggctagcttggtattggccatggtaggagtatttgtaccatggacatttgcaggcattacaaatcaggatttctgtgttttgtcttttttctccctttcagagagctggttgttaaacattgactgatgcatcgttgattgtcttactccaaaccctctatgttctatgtcctcggtgggtgtccaggacaagacatgcatcagagctgtctttggggattttatttttctagaatatgaaccacacctagataacgctgatgcatagtctgtggtggagcctggagtctgtgttttgagaagccactaagcgattactcgtgactgagaaacacacacagatgggtctgggtttagatcaggatgcctctcgaatcagagaagggcagcaaagaggggagagaataaatatcccagaagaagtctccctccctcagctcctccagggcggctccctgaggtggccagacatgggccagaccacctgggctcgagtttcaccctctctcctcatctcagttgcctcatctgcaaaatggggttgaaagtgccacctaccatatagagttgtcaaggaaaataagtgagtttgtagatgcccttagaacatgtctgggacatatcaaacatcatgtatgtgtttgacacatgtttatgttctgcctcgtctggcaggaggttgtgacagctactgggtacatacagcccccagggcagacataggttggtgtcttcctaccttactcgtcttggcaatatcagaacaagcaaagtcagctcacatttactgagcacctacaaatctcagaatggcaggcattgttcaaagtaccttacttgtattaactcattgattcacatgggcacacgactaggatggtgttattatcaccccattttagaggaaagaactgaaccacacagatattaggccttttgctcaaggttctgtaactggggagtgacagagtcaacaccaggctacccagctccagagccctccctcttccctatgatgacgcatctcctcctaccgagaggctctacctgcccagcccccaactcatgcccactgccagggcagtcaccctctgggcagggactagagggatctttctaaggtataaatccaagcctgtcatttccacacttcaaatacttccatgactccttgtagtcttttcagaatatggtacaaattccttagtacagttttccaaagctctccacccctccaggctcactttccttcctaccctctcaatttttttgtcccaggatgcaagttcaggccttaattttcccagtctcgctggcccctgtaccctttgtcctgcttctcgtccctctgttcagcacctttgtatgccttctatttccaggcaagaatgcttgtcttcttgacctctcttgggtgagctattctccaagaatcagctcaagtatcacctcttccaggaagcccctcctgattgctcctgtacacatgcacaacagagtgcgtcagacgcgattctgctcttatcctgagacttctgggctttcatgccactggtaacaactgcttgtgtctgggtctgtctcccctatgagctatgggctgaatattcctgttacccaaagtggaaagaagggtcagccagctgagtggctcctggggcacttaagcatcactgagaagagcctggaatgtagcgacaagtgtttcacatcctcctctcaggggcagcttcaaggaagggcagatgaaaatactaggttagtgcaaaagtcattgtggtttttgttattattttaatggcaccaacccaataccctccccatgatataagtgttattgccgggaagtggcattagttgtcattgtttatctattaacttattataatagttcttttttcacctctaggcttttatctacatgtgacatgtagcaggggctcagctggggctaattaactcagggttatctacagactggaagtttaggagagggttggtaaactgcctggggtggaggatgagatcttccccaaactgcctttcaaccaggagggtctggggagctggaaggatttccttttggacagtggtgttatgcaagtttggggccagggctgacctgctgcgaccatggaagagaagctgagctctgcctacagggggcgccctcctcacctttccttgcatggcattcagtctcttctccaattcagtgttgacctgatatctaaggcttgaaagatgccaaagctttagactgcccagggcctccatgactcgatttaccctcatctaggtaaccagaggccaacctgactcagtgtgaagggcagcatctctggccttggtgggagcttgggtgctggtggaaccagcccttctggtctccagaggcagcatttggtctgttgagactgacacagaggctgcagctgatcacagcccgggagggggcaggttggggtggtagtgattgggatgaccttcctccctgtaacccctgagcctgggcttagctgcaaagtgttgtagggcctgtggcacagagtgcccccatccccgtgatacgaggacaatgacaatggggagctggtgaagaggctcttttgtccagctccattttttttttttttttaattcagactgcccagggccaagaccccaagtgctgtacactgtgaactgtgtgcaaccttgctgcttggcaaaaagttgtgttctcgatgccaaatgttgacacactgaattcagtatcgacgagggaccttttagaaacattcagcataacataataaactaattcattagcaccccatgggtctgaatgggtaggagctgaagcttggaaaacatcgccttaaggaatgacagatgaaaatatcttccccatgatatcactgttattgccaggaagtggcattaattgtgattgcttatctattaatttattataattcttttttcacctccaggcttttacctacacatgacatgtaccaggggctcagctggggctgattaatgcgaggttatctgggaatggctcaaagctggttggaacagataatggcagctggggtaattaaaatatcttctgcatggaagaagcaaatttggagaattttttttagaggcgaagagttggtgatgtgggtttcctaaagggaaggagataaatgccagatgccactgtcctcccaaataagccacaactgaccaatgggcacaaagagggaggatcacgaggtagaggcctcggcaacagggccggaagtggatcctgaagaccggaagcaggatatgactgagggagaggaccaggagcacagctggtgctccaaccgatggggttctgctgggagatactctgggagaccccgccccatactccactgcagaactgtgtgtattgcaagggctatgcctccctggaagggtccattcttcccgaccctcagattgtgtggggaggaaggacagtcagctggaacagccaaggacaggaccaggagtcaggagccaaggcctcttgtcactgatctgctatgaaacttcaggaagtgcctgatgccaggtttccccaccagtcaatggggagtgcaaagtgccctgttgctggcctcaaatgtgtaaagaggaaagtcagagggctttcttcttgctttcttttttaaagtgacagggtctggctctgtcccctaggctggagtgcagcggcacaatcttagctcacggtagcctctaactcctgggctcaggcaatccttctgcctcagtttgccttccaagtagctgggactacaggcctgcccgactatgcctggctaatatttttatttttgtagagatagggtctcactatgttgcctaggctggtcttgtactggcctcaagtgatccccttgccttggcctcccaaagagttgggattactggtgtgagccacaatgtccagccctaaaatcagagggttttggaactggtgtagcatgggagctgctgggatttcaggaggctccgtttccccattgacctcaattaccacacctgaaccaacatggtcaggcattgtgtggaatctgagccagccagaggaggccagggaacacttggtgtggactttcagcatgataggtttcagcagagggctttggagctggacagctccctgctgcgaaaaaatccttgctctgctcctttcttgcagagtgactttgagcctcagtttccacgtttctataaaactgggagagtctatctcccttggaaagttgttctgaattttggatgggatggggtatgttgagcacacagaaaacaaaagcaggatgtttagtttatttaacacttacactgtaataagtgccaagcattgttctaagcattttatgacgtcaatgcactcagcgtaacaatcctgtgaggtagtaatattactgtcaccactgtatagatgagaaaatgaggcacagagaggttaagtaacttgcccaagggagtggaagagtctcaattctaactcaggccaactgggatcagagtggttttaactaactgttgctatgatgatgtgttgacaatttcacggattactttccacattgcattgcagtcatccatccgtccatccatccagccgtctgtccatccatctgtccatccatccagacattaatgagcacctaccatgtgccagcttctatgtgggtgctggggacagagaggttaactgggcacagttcttgtttcttatatacatgaaggaagccaccagcttgtgagctttgtgttgaatccatctatgtacacccctcccacccaagtgcctagtgcagtgcccaggaccttggagagcatttgtatatggctgctggataaatgaatcaatggatgattaagaaaatgaagaaaaatggacactggccggggctagtctctgttccctagagactttagcacaccacagctaccctgggtacatcatatcccagttgaccatccattcctcctctgcctcttctcaccatctctttctctgattatcacccactttcccagatccaattgtggactggctgagcatcagtcaatgtttctcaatggggcaccatagttatctggggctggacaactcatctccagaatcttgcccatcatagaatgtctagcatccctgatccccactcactaatttccagtcttggtgacaaataaatgactagctcccatatagctaaatgctcccagggtgagggttgtgtcaccagcaagattgcagaaaccacccttgggacagacgacgactacttcttggccaatcagctgaggtctgcccatgggtagagagaaagaatgctctctaaggtcctgggcactgagctaggcacttgggtgggaggggtgtacagagatggatccaacacagaatataagatagagccaccaagcagaaagccttgggacattgggaggtttcagtagaattggggtcagagcaggaacaaaatcttcctatctccttcacccaccctgagtactgccctcgccacccactctgtctgcacagggcttgtgattaaaccccctctgggccttgctccaagtcccagccgtaaatatcctattaaaagcatctctgcctggctcaagcctcattccaaggccggggtggggggtcgttgagttggtaaaatggcagggcctgaagctttggcccctcagccctgcagcctggctgaccttccaggacaagactctggggaaggcaccaccccagtgaccccagtaccttccacgttaatgccattggccactggggtcaagatcgaaggtcttaaagagaggatcctagtgtccccgggtccaggagttgctctcagcaccctaagatctcaggatgggatggggagggctgccatgagtggggagaaagttgtggacccctggaatgtgccccaccccaccttcccagtcttgctcctctgccctgctcccagctctggacagaggtagagtttcaggggtctggtagcctcccttgactttccaggagacagcatggcaggaagaagccagcttaggtgggcggaaatccagaagggattcaggggagctggcttcactctgcctgatctcattcgccagcttccaggatccctttctcccagcatggctcctggcaggtccccaggtctgagccctggatcaggagaatcgcagggtggctcctgagctctgctgtgggcacagggtgcagagggagggactgtagggaggataagtgcttaataaccagctctctgggggaggcggctcttatttgtagcatttgctcacttccattgtgtaagcgttcccgtcacagtgatttcaagctaccaacatgacatggacttaggaggagataatgcaattggctctcgcccgctggatcaagccagctcctgcataccatgaagagctaacttgcctcttggcctttgcttatgctgttccttctgcatacaatgtccttcctctttctcccttggtgaactcctatggatctttcgaggcctagttcaagtatctggttttctgtaagactgcctcaaacttcccgccttccaccagaccctcagaacctacggggtcatagatgctgggtagggagagctagctgggtgctggataaatgaatgaatatggttagaggcctacagggctgcagtggctgggcagacacatactgcaggaggctttttgaaaagcgacaggatggtcagtgaggctgtcactcacctcagacctgggatgggtggaatagtctgcccagggccccagcagggtctgaaggtgtctatctgcaaggcagtgaggctcaggatgggtgcccttttggcacaggaatctctttattctgctgaactcaggccacagctaattatcctaatgggtttaaatggccctaaatgttctcagagtttggacaggacccatctggagcctgtaggtgggctgggctagctgacagtgagtgggcagacttcagtatgaatgtggacagaatccaaagcgacaattcccgtgaggcccgagatatgcgtggggaagtgtgggctaggaaccgagggccatgataatcataatagtgaatacttccagagctcctcatgtaccaggcactgcgtgttaccttattaactcatttggtgctcacagtaatcctaggaggcagaagcccattttgcagaggaagaaactgaggcagggaggttaagtgccttagccaaggaaccacagtggtgagcagaggagctggtgttcacattggctccagagttcacatccttaattataacatgatgctgcctctcacaagtgggcaggtcacaaagacatatttgtgcccttacctggggccacccctacagcctgaggaagctgcagcaattgtcttcagtgggctggcccaggctaagccacaatgaacttgatccatgagagtcccacccctttcccgtgccaggacccagaggtacattaccagagtggtgaagatgaagtggtagtactcagtcatcatgcccatggccatggcctgcagaaaagcagagtgttagtgatcagcagggaacccctgggcagccctccccacatccccacccagggctgagaatgggactggcagtgggttggggaaggctggctgcttggagtaaggtgtcctctgagaccacctctgaacagtgacaatgactgcctggcagacagcagtggatttcacactggagtgtgctgtaaagtcacctgggacagattaaaatgcagatttttgggtcacattcttcaaagattccaaattctgcagggcccgtggggtctagctgcctcttttgagtaagcgtctcccggcctgccacacttagagaaatgctgatggcgtcagtctgaggctgtcttctcaagtgccctggactccactcagctgagctccctgtcctggatccagaggcagtacgtttccccccaaccctgctaaccccctggcctagccaggcctgagctgggaggtctgtcttcagcctccccaagaagggctgaggcatccctgctcccttagtcctggctgaccacaaagcaggccacatggccactgtggaattcttaccgtctgccatcatgaagtctgcactatctatagtttatgtattttattagaagcctataatctattatactaatgactataatgcattttctacagagttcctcagaatgctgggcccacagagggctctggggaaaatgtcaccggttcaagtacactttgcaaatgctgcccattccctcccgcctttgaagagtcacagcccacctcagcacgttaaagtctcagagaagtcctgcaagaagctaattggcttaacttcatttaaatctggctttggctcagctcagaatcttcatttctaattccagaagttttaaaatcagacagacctgggagtccattctggcttcctgcctggatgaccttgggtccattactttccccttgagcctcagtttccttacctataaattgggcacaagaattctccctgtttcccagtgtggtgataaatgaggagctacatggacccggcagagggcaactgccgagtaaaccaaagctgtgattgtcaccattcttctgttacacatgctgtctgggtggtgggggttggggtaggggggagaagaggcactgggcacagctgatcgggaggctaggggttataggctttctggggcatgcgtgtttcctcgacagcagctttaaagatgcccaacgctgggtgtcaactgcctgctgggtgtcagaagaaactcctgatgttttccttgttgcactgaagcctccataatggtatgagatggggattatgaacctcatctacagaggaggggaatgactcctgggcctcttgctccagggcacacaacgtgaaagggcagaagcagaactcaaaccctcaaatgagccttttaagtgcggtgtaaaggagcttcctttgtgaggagccagggatagaggctgccattcaggcctggcacccccgatggggcccaactggaggatgggacttgagcccctcaaggcctcgagaacactccggctcagcgtgtctcctcctgcaccccttaaatcacctggaccctgaggggtcatgtgtcaaagccccacagaatgcctcctccagtcaccagaaatgctttctgggatgacataattgccttttacacaaagcgccagctcaaatcagtttttggtttccgctgtggcacccttggagcgggtggtaggcgatttcactgtttattttcttaggtgactggcggagcttggctctcgtccccagcaggccatgctgagctgtgtttgggaacgaaggcccatccaggactgagagccattctcctccccctctgtcactgcagagctgagcagatggtacgagagccttgataaagctcccagtaataggagagtaacaccaagtgccgtgggctacggggaattagtcactggaagaggcggtgaggcattctgggggctgttcctgagaatctgaggcctctctgcttcctggagtgctctgctcctgtgtggctgtgggtacctcccggcagcctctgcctccaaccagcacagaggtgggatggaaactcgtgtctactcagcactctccctgtgtcaggccgggctgggcggatcatccatccttacgccaactcacagagtaaatactgcagtgtccgttttgctactggtgaaaatgaggctcagagaggcaaaccacccaaggtcacacagcaggaaagtggcagagctaggagtcaaacttagatctggcagcatcacacccacatttgggaaggggacgtgggagaagtggccagcagaccccagtcatctgtcccggtggccagcactcacgcacctgcttgaggatctgggccgccatagtgtggctgcagtcgaagataatgcggaattcccggcctcgcttcatctccttgagcaaggggcgcgagtcgtcagagtcgatggggagctgacggatcttcaggcggatgttgtatcttgatggggccatgatgagctcctgcagtcggatgagccctgaggggccatggagcacaaaagacacacgtgtaccacatgtatccacagctccaggcatccacttggacttgtgtgcacacacatgcccatggccacaggtctgcagacatacacgggcagaaacgtggcccacagagacttgtgcacgtgcatggacaacactggagagcaggtgtgtgtgcacatacaaacacatggctacacgcacgtgcatgtcaatatgggcaggaatacacttgggcttatcaacacgtgtgtatatgtagattaaggcctgtgcacacagtggtgcagtacacacatatgtagattcaaaagtaggcacagatagcaaattcccactgaccacacccatctgcttctctctaacccagaatgggtgtaaagccttcagggcctaaatcagagttcacccctcttcttctgtacccacccccaacattgtgagacatgggacatgatttccctcaacatctccagcgagctgcttccaggatatgggcacaaaaggcagctccagcctcagtggtactaacctgtaccaaccactgggctgggtaaggccaggaggtatttgtgtctccgccctcgtcctcactaagggcagtctgccttggtaaaccttacccactttttcaggtttagtgcaaccacctcctccatgaagccttcctcttttgctctgtccagaaaagatcaccctctcctccaactcagtggcctcctccctcagcaatggcctcctctggccccacctcattcccctcatcctgccaccagcacgttgatatctggggctgggttcccaccacccccagcacagggcctggcactcaggtggtactcaacaaaagtttccataattggactgacttactgttttttgttttttgtttttcctcccacactgaaaaatctatcctctaccttggttggcgtttttgtaaaaccacttaatctgaggacttccagggaaaactgaatgtcactttctggagacaaatggcttacttaggtctaattaagttcgtttctgtccctatttcaaggtccatttttgctgacttctttctgcatagcctgggagcaagcctgcttgttactctgtatatacttcccgccccttcctcccctccaaagaagaagctgagccagcacacggccaggtcccaagagggccatcccctcctgcttgcttggtccctagtcatccccaggactcagtgtctggtcctggtgacacagttcacacagcatgtcccacccctgcccccccaccactaatggcacttcaattttcctttggggaaaaacttctcccccactcttagtttctgtgactcaggaggggtccatcgtcagctctaggggcaaagcacatggccccagcctgggaataggtattgactcagagataggtacaataccattgactctcagaaactgtgttagaacaactggcacaaaaagagggtgagaaacactccctttttcactcaacttcaaatatggaggttgtaagtccagggtccccacgtagacctcgagaaggattccaccaggacagatgtcagagagaacaagtagcaaagaagtcctaatgatcttcacttcagcctctggatcaaatggtgcctgaagctaaaattagctccaaactttccagtaaaggaaaccaaattgctgcccccaaactttttttgcttaagccagtttgcactggattaaagttttcaatcaactgttactctatctggaaagagtccccctgacctcactcagatagccctctccaaaagccttccggcagagaatcccagtttccaaaacaatctctggtacacacccctgagtctgtttagcaattattctcattcctgagggctggacatcaggaaagcaatctgattggtgtccatcatctcactttgcttcggggacagacatgtatgctcgtagcctaagcctcctaaagagcttccacacaagctttgccatgactgggcatcaggaacccccagcccactgaagactcaaacccatgtgctggagttgggagacggctatgtagtcccagagtggtctggatcaaacaggtgccctgtgcttcctaataccagacttgatggggaggaggaagaggctatcagttgaccttcacatagaagggagaggccacaagctatcacaagacacacacacaggctatccccctcccaatgtatcccagaaattcttgattaggttgaatgatgcttccctttcatatctgttaccccgtgaggtccagggtgcacagtttgctcctccctgtttggttttgagacttatgtgcagcatcagcaggcatgtgggctttggggacccaggctatgaggactgggacaggctggatgctggagcagaggccaccagggccttcttgtcagccaagcacatcgccccatgtaatgcatggtgacccacattctccagcagcaaatgtcagccctccttcccatcagtgtattcccaaaggagaccagaggctcctctcagcccactccagcagaggactaggctctctttgtttgcctgagatgagctttcctttctggctgctcccctaatcaatctctcttaaaatatctgcagtgaatcatggttgttggaatcatgcttttcactcacaaagcgcttctgcattcattaccctatttaaccatctcccaatcctagaaggcatatagaacaaggattttcattccaatgttacagagaaaaatcccaaggaccacagaggttaagtaacaccacagaggttaagtgattatggaatcataattagagacccaataacattttgactcctaggctgtagccctttccttcatcccaggtttttgtttgtttgtttgtttaataccatcctttcaccctcaagatgagtttgtctttatgcatagaatagataaggcacaaagctcgtggggcaaacactggctgccttctcaatagccattctccttgggggagattgcagccatgaccccaattcttcacctctccttataaccacaccctttgccatgtaactttgcagggccctccaattgggctcacccatgtgaattgttttggccagtgggatgttggcaggtaccatgcaggcaaacagttgaaatggaattgtacattgggtttgctctctcgcccctctgcaattgtcatgacaatgtgcctcggctatcctgctggaggatgagagacaggtggagagctgaatatacctgcatttcagtcaaggccagcctagatcaaccaacagccagctgaccaccaagcaggtgagtgatccaggtgaacccagaaaaacgacctagccaagttcaagaaatcactgaccctgtggacttgtgagttaaacaaatgcttattattttaagccactgagtttttgaggtggtttgttacacagcattattatagaaagagataacaactgcactcccttccagcattctaaaagaactgtgattgtgtttgggtgaaaatgcaccagtcccatgagatgactcgtgattggcaggagccaatcagtggcaatcccattcccatctgacaatgtctagaataataggtatggacccagtgagctatacaggattgtcttctagaaggttctgagacagatcttcctctttgataagaggcatgagtcacattaagaaaaatctcattgggctggttgtggtggctcatacctataatctcagtgctttgagaggctaaagcaggagtttgagaccagccttggcaatacagcaagactctgactctataaaaaaatttaaaacttagcagggcatggtggtatgttcctgggttccagctacttgggaggctgaggtgggaggaccgtttgagccctggagttcaaggttgccaggagccatgattgtgccactgcattccagcctgggtgacagagtgagaccctgtctctaaaataaaaaaataatgaagaagaaaatcccattggcctctaccttctgtatgccacctactgcatgctccgagcttcagcagccctattgtgactatgagctgaaggccaagagagctgtggcaatactgacccagcaccctgactttgtcaagctgctaaatcatcccaggaaaggcccatctccagaattcttgtcagtgagataacggtttattgcttgagtcaatgtgagttgggctgtctgttacttgcagccaaaacatcctgatggacacaatctccaaagcaaacacagccaaagcccactgtggagtatttcccactccatgggtttgatgacccatacattgtcctgccctttgacatatctggattctgggagcacacttctttctacccactatacatcatcaaagttatattatttggctgaagccaaacctgagcccctagtgctcattgtcttcttgatcaaactcactgacccattgactcccctatgttttaaatatttgttgaactgaattgagttgaatttaactgaatcaaatggaaaatgaagttgaattaaactctaattaaatattgaaggaaagagtataaggataaaaaaatgaagatgttgctatcctatctccttttgagaagttaattgtattccagaggagtgggtacctgcccagtgatcacaggtaattccaggccatcagagctgagaatgaagtgacgtgtacttatagtcagagctaaaggcacttgtgggtaagagctgcagacctgagcatcagctctggccagttttgctagcatggtatccatcatcatgataaagcaccttttcctctgcaaagccacttcctccaccctccacctagactatgtcagtgtctgctctgacactctgtacccatgacattccagttacatgtcttcaacattaccctgttcacatccctttcttctcttccattctggccccatgttctcttccaagcaccccttgaattctggcctcctttgctcctgtctggaccagtgcagtcggctgtgctctagtctccttgctctaggctctccttccaaccctccctgtgcattgctcttagaaccaccttctaaaactctgctttgattattctacgcctttgctcagcaatactcaatgatccttggctgctttaaagataaaacctgaactctgaggctggacatcagagaccttgcatagccagctacactctgttaatctgactttttcttcccaccttccatacctgaatcctctcccctagccaggctgtcctcttggttaagctgctaggtacagtccaacctagtttttgctcatgctgttccctccacctgtaattccctcatgattcctctcctcattcatctatcctctcctcattcacctatcctgctccaatctctcctcctctggtaagtcagctcagaccagccaaggccatagagcttccattccccaagtggtctggctctgactaaatgtatatgccatttcattcttagctctgatggcctagaattatgtgtgacctctgggcaggcacccattcttctatgctaagattaacttttcaaaagaagacaggataacaacatctttgtttcttcacccgtatactctttccttcaatatttaattagggtttaattcaacttgatttccaattcaatccaaactaatccaatccagtccaatccaactcagtgccaacaaacaatgaaaaacatctacactgtaccagaccctgtgttaaatcctggagacactgaaagctcctggcctggaagcagacacagactcacagacagataatgattcacagtggtacattaagaaacaactccacaatgcagcagaaacactggagtggctgggaggtgggcaggagtgcccctcaatggcaaggtcttcatgctggggtgaataagccaggctggggatccctgctctcaaggatcttctgtcgggtgctttggaaatagcaggaactcaatagatgcttgtagaagcctgagttaaataaacagctttccaattgtcttttctgagggagtctctccctactatttccagtccccattaggaggtaatcaaaagctgacattgaatcacaggcagctgagagctggagggctctttcaaggctggatgcagcagctcttgacatgtgggcagagcaaggccagatgggttaagtgacttgccaaggtcactctctcttaagaggccaggctaagaaatgtcttgggactcaagcctttggaaagaaagaggagaagaaacagctccatgctggctagcagcacagactttaggctcaaacaggcctgtaggtgcatgctggctctggcactcactagctgggtgacagtgcacagggcatgtcacctctttgggactcagtttcctcatttctaattcatcgctccagggagttactatgagatttacatgaaatgaaataagatcacacttgcaccacttggttcgcagcaggtaaacagtagccttctttagcagatgaatccagaagcatgtatgaattccatctctaggggactctccaggtctgtccctgccccacacatcctcacaaggatgacttaaggatgaaggcagggaccaggcagcggtcagtgccctcagtggctcttctctcccttttccctttcctgcttgctctttttgtgacttatggcagaccattagctctctgtacatagagctacatggagatggctctgttcatgcagatggctatgttgtcccgtttgtgtttccctacaatgtagtgcttgccaagaccaagaactgagttttggtgtggtgtggtgactcacacctgtaatcccagcactttgggaggctgaggtgggaggattgcttgaatccaggagttggagaccagcctgggcaacgtagccagaacttggctctacaaaaaaatacaaaattagccaggtgtggtgctgcatgcctatagttccagctatttgggagactgaggtgggaggatctcttgatcccagaggtcgaggtgatagtgagctgtggtggcaccactgcactctagcctgggtgacagaaagagtgggttttgtttatctaagtatctccagctcctagcaatgaatgagatccaaaggaaaagccagagtgcgtttgctgggtttgttggtggttatctgctaggtgtgtgctctgggccctctctaagggcctgggacttgagaggcagggggtatcacattggagcaagggttttctggaaggcagagcccaggctggacttggaaggcagggcaggagtgggtcaggtgggtcctacccagaaaaatgtgggcagcattagctctagctggcagagcatgtgggacaggtgcagccacatcagggagcccagctttgggcccgcagctcatagccacgggccccagagcccatctcctctttctgtcctggcaggatgagacaacagcctggtgctgacgtctgcaagcttggcactggctggggtcagcggtcaagtgggtatggcaggggctggtgtgtgtgcgagcagagctgggcacgtgcaggtgtctgtgtgtgagtgtgggtagagaagagtgtgtgtgtggcgggtgaaggtgtgaggaggatgagaagaaccaaccttcagcgctcactgcatgtcagtgcttgtcactgtcatcttgtaatcccacattttacagatttacattttataggaaactgaggcacaaagaggctactcagccagcaggtgatagagatgggatttacacccaggtggtttggctccagtgtgtacacacttaacactaggccacgccataagctatgtgtgtgagtgtgcaagtgtgagggtggatgtgtttgcagcagatggaaatgtgtgagcgtaagggcatgggcaggtgtcggtgtggcttgcagatgtgtgtgctgctgctagggtgggtgttcagtgcagatttgaacacttgtgctgctagaggaggagctgagtgtgaggcaggggtgaggtgcgctggggctgagtgagatatgagtgccgctggggtgcacagggtgtgagtgggtgcaggggtgaacatcagcataaccgagtggaactggggtatggaacacagcctcttcccccagggcagctgtgctgaacaaacagacaagagcttgatcctgggcctctgcccccctcaaccgttgcccccagcctagccaggcctggccacccacctgtactgtcgtcatagaccacggtggctgaccgccacttgaggtactggaccaggtcgaggatggcatggctgagcgaggcgtagtcggggtagaggttcacgtagaaggtgtccttgttgtccagcgggtggtgcttccaacgcagctggatgtggggcacctccagggcattgcagatggactggacggcattggtgcaggagccctgtgatgggccgaagatcgccaccacgcccagtgccagctggtcacaggctgcaacagagggtagggcagcacaggggtcagcactggggctgtgggtatggggacagtgatgctgatgatcctgtaaacatgtgggaaaaacagcaactggaaccctcggtgggtgcacaatggatgagctctctgaacctcagtttcctcatctgaaaacaggggttctaacagtccctgccttgcaagaccacatgaaggtggaaagacatggttgtgggagactggagcacagtgccagggtacgtcccttttccttaggaagtgcccatgacaaaagtgatcaccacattcaatgttaccatcctgggattagcatcaccatctctgtgccaggttctgttcttgggggacttgagaaacaaatagaatcaaactggctgatggtgcttcaacttcaacctctagcccggcctgttccctaccccggacctgtgcatctcacctcttactcaacatcaccagttggatatctgacatgcatatcagatctgacatgtccagcacaggatcccctcttgtcccaacctccttcacctccataaacagcagctccattgtccctggacccatatgccaaaaaccatggttctgtcttgattcttctcattcactcatatcccacaccccaattcatcaacaactcctgtggcttcacctgcaaaatacatcacaacctgaccacttcccgccactcccagccccgactcccatcctggtccaagccgccatcatctttggcttggattattgcagaagcttcctcagtcatcctccctcctgtctattctgcactcagcagccagggtgagacttccacagtataaggtagattacgtcactcctttgcttcaagggctcctcagtgcaaaagccaaagtcatagcagtggccagagatcctgcttgttgtagctcctcccttccctgtccctaccgccacttttctgacttcgtctcccatccttctttccctccctcaaagcattcaagctcctctggcttccatgatgctccttgaacatgctaagtgcattcctgcctatttgcacgtgctgtcctctctggctggaatgctcttccctcatagagcctcaagactccctccccctcctccttgaggcctctgtgtctgtgtcttactagggaggccttcaccgcacaatttataatcacaatccctgtccccccatgccctgtttatttccttctttattaaatgatcactggaagtcttgtccattggttgactttctcctcccagtagaatgtaagttccaaagaggcagggccttgatctatgtggtttactgctgtatcgacagtgccgaatcatcatctgaatgttgaatgaatgccgaatccctgccttcaaacagttcaggttcttgcagaggtccaaaaactcaggcaggtgaggcagcagatgctttccaccggcctgggatggtagaacatcagtgggcacaacagagcatcaaatgagcagacccagggcagctggggctcaaaatgggggattctgcctaaaagatccatagaaaggggacctcttagagtcattctggggtaggtgggagagctccccagaagccattctctcttcttttctcaactgtctctaattttccttggggcttcacccctcttttccactgtcaacccattggtgcagagaatgcggctcgcacccagaaaaccactcactgaccttcctagttcacagccatgagtttagaggacatttgtgggccagtcagagccagtgggatgccatgagatccactggactgagaaaggggcacctccctctttaagtgaaccttcaaggaagtaacagctggagctgcagtagccatcttgtgctcataaagaggggcgcctgtctgtgaacatagtcagtgtgggttgagcagagccaagagagagaaaacacaggagtcgcccaccaggcaaaaccctggacttagaatttgcatgaaccaagacttacgccatttaggttttagttttccgccagttgcaaccatcggagatccaccaacagagcatgagcaagctcacctacctgtggacaggggaatgacactatgtgcacacatatgacatctgatgcacacaggaggaggcaggacagagcaccgaagcaggaatgaatacactggattcagtgtattgaggcctggctgtctcaagggcctctgggaatgacccactgggcacaggcctacccctaagatttgcagggcccagggccagagtataagtggaagcctacataccatacggctaaatagttacatgctgttagtcaagctaaaaaactgttaaacgaaacacgtccttttctcttaccttgacaaatgtaccttcatcacaatctggaaagtcaggtgagaatggagacttctcctacacagtgacatggggagaggtagcaccaggaccccattctccccctttctcttttaccactggctccatcctgaaccataaggggccttgcattctctgtggaaaccccagcccttatgtccaaacactgtctacacccactgcaaacagctgccccttggtcacccttagggcctaaaagtgcacctcctgcaagtatggctttccctctggaagacagacccaaggaagaggcccacgcatgtcctagaagtgggctcaggggcaagtgggcaggaaattcagggttctagatccttagaggaaagtctggaagggcagggcacaggctcctggtgggtatgtcccctggtcccactgactccttgtcccgggaggagaggccaaccagaggaggcagagggcaagacatcaaagcacaggccctgggaaagggtccctctcgcctgggcttaaggatggtccagattgatccagattgatccagaggtacagggtagttttgaatccatcagaatatgtggtcttgggttgtgtttcctgttgactcacatccaccactcccactgcctcctggaaatgggagattttatataaagaagttatttttcctgaaatctgtacttctaccaggaacaccagagattgccacttaagggcaaggtgaaagatatagcaatgtgatgagctggctagtttttgttaggggtctgctggagccccctgtaacacggggcagaacagcagcagtgccagtacagagggtatctcctgggcaacccaggattcattgtggccaaggccaggtgcaggagagcacatacaacgggggcatggcatcctcctggtgcttctgtagttctgggactgggagccaagtcggggaagcaccatcttgttcctgctcttgtcacctttgagtcaacatgccttgggtagcccttggtgtgagcaggtgtgtgagacaaaccacagtgataataaatgctttaaaaacaggaactctgggtttgctggtgaattgtcaaatttaggactagttcttttttcagttccctctccccaaggaggccatgctcggacctgcaccctcactgcccattcgtgctattcttctgccgtctgggggtgttgcatatcttccccgacaaccttgtccccttcagattaggcacttcctgaggaaggaggccatgtgtgagtcactctgcaaccatgggagctgggtaccaacatggaagagatggtaacagtgagtgacagcagtccagggcttgcccaagcctgaggccgtgggcaccctgtaaaccctgtaggtttccctcatactctctcctacctttgttttgacccttctagctgtcccctgatgcctctggtttctgtcccactatattatctgtctattctttttcctggaacaccttcagtttgaagacttggttgaatgatttgaatgtctcattccctcccaccaccacctctacgcatctgcctcttagatttccttcattgattgatgccttgaagcagtcaggtccaggcttccctgccactgctaccattacacggcctggcctcttaggtcatgtccaaggtctgggcatgttgttggaccaaggcaagggagagtggaccaacacaaagtctgatgatgcagaggattgtaagagtgttcttcaaagaagtgacttttattttgacacagactgtgaggattatgacaaaggcaactgaaatcgttgtgatactaaagaccatattgtgaggctgccaatgatgataatggtgacggcattgctgagggtgaaattaatcatgttgatgttgtgatagtaatggcgggatggtgatgttgatgttggtgttgatgagactgacaatgataaatgtgttggtgccttcactgtagtggtgataatgacaggggatgacgggatgtcagcattgatgagagaggaggtgatcacaacgttgatggtactgacagtatcagtgggatggtggcagagatgttggtgctgatgagactggtgatgatgaagatgttgctgtcatggcagtgatggaggtgatgacagtgggggtagtgttggtggtgctgatattaagagtggagatgataccattgttgctggtgaaaacagtaattgtggtgctggtgtactggtgttgatagtagagtcaatggtggtgatgatgatgatgaccacactgggtttcattctgcaagagatgcagtgattagactttactcttgcatagcaggaagcatcagtcctggccttcacctattgcttttccctggcctctctccacctcccctttcctgtctcctccatgttccttccaccctctgaggacttcccagctgggaagaacactgctgcccccacagggaccagggcagggcttacagcagcagcagcagcttttcttccagatgtttccagggcagcagccaactcttgttctggcagccctgatcacactgcagtaattacattatttgtggcttcaattttaaatccattttctggtcattttacagtaactcaatggttcacagtcattgcaggagtccacagcctgaatgctgtccccccactccctttccatggcaattgtagttatggcaaaaattatcccaatcaatttgtgtcttaaaaggaattgagcagcccagagaataagtgaaggcggaggagcctggggagccctgggtcaattccaggcccactccggtcagccttggaagaaaacacagacactctctgcgctgctgctgcctctggcgctgcctggaagtcactcatcttttaatttccacaaaacatgaaaagataaagacaataagagaaagtccattttaacagggaaaggcccccggcctcatgtggagggaaggactaattcaagcagagctggcagggcaggtggtgccaggctttatgcctctgtgtcccctccccccacagggcccgaggtggctggatccagctggaggggaagaaagcaatgacgaggacttctgtctagggaaaatgaattatttctggattaattagaatttgccccaagccccaggttccttggaagagtcctaaagatgcctcaggagaatgctgtttaaaaaaccaaagatgagaagaaaaaataaagatcatggaacatggggctctccctgagggatagagggtacccaaaggggagtgtgatccaacagcaggaatgtgccaaggtgtgacagtggtgttgccagtcatagcagagggatggtatctgtcttaggcatgtcatcacagggacattgagggttgcagaaagatggcacttaatttttttattgagatataaaatatagtaaagtgcattaatgttaagcacatgactgttatgaattttcacatataatttcattcatacgtcatgcactcatgtatgctacactatctcagtcaagctacagagcgtttccaacacctaagaagggtctctcttgctccttcccagtcaatatccactcactgcacactactccctctcccagaggaaatctcttttctttcactcaatactatatctgtgaggttcacctatgatgttgagtggagaaagtttattctttttttaattgctgattaaaattccattgtataattatatccgaatctatccattctcctactgatggacctttaatttacttctaacttttgattattaccattaaagtggctagaaacatcgttataggcacaagctttagtagatactgccaaatagttctcctaagaaatggaaggttttactcccatcagcattgtatagaaaaaataagcccaaacccctgcctcccaccatacacagaaaatcaatgtgagatagatcacagagctaactatgaaagataaaacaacagcatttctaggaaaaaaatgagaaaatatcttcataaccttaggttagacaaagacttctcaaacaacacaaaatacattaaccataatggaaaatattgataaattggacttctttaaattaagaactttactcctcaaaagaaactgttaagagaatgtaaagggaagcccacatgtaatgcatatatgcaatagagatatctctccaacaaaggatgcaataatatataaatcaagaatataggcggggcgtggtggctcatacttgtaatcccagcactttaggaggctgaggtgggtggatcacgaggtcaggagttcgagaccagtctggccaacatgatgaaaccctacctgtactaaaaatacaaagaatcatttgggtgtggtggtggatgcctgtaatcccagctacttgggaggctgaggcaggagaattgcttgaacccaagaggcggaggttgcaatgagctgaggtggcaccactgcactccagcctgggcaacaagagtgaaattccatctcaaaaaaaaaaaaaaaatatatatatatatatatagtgagagagagagagagtgagagagagagagagacagagattcactatatatatataatgagactcactacagaaaccaccagaatggccaaaatttaaaaataaaactgactttaccaagtgctagtgaagatgtagggcaagtgccactctcaaacatagctgtggggagttcagactgtgcagcagctttggataactgtttagctgaacatatgtacatactgtgacccgcatacttccactcctaagtatatacccaacaaaaatgagtatacatgtgcatcacaagacatctacatgaacgtccacagcaggaatgcaggtaatagccccaagcagaaaccaacacataagtgtaacaaaagtgaaatggatttgtttaaaatggggcatattcatgtaacagaacactgtacatcaatgaagaccagtatattcaaccacgtagacaatctcacggatacgagacaaagcaaagagcaaggcttaaaagagtagacactgaatgatttcatttatgtaaagttcaaaaacagcaaaacccagtgtggggcaccagcagtcagaacggtggtgaccttgggagaggaatgactgggagggccatgggggcttctggagggctcacatggtctatatcttgatttgggtggcagttccttttttcttgatctagcttgagtaggtgtctgtttcttataaactcatgctccttgaccaagctaatgttccatcctccctttcctgcactctctcctgcaactcccagtatggcacctgttgcttcatccactagattataagctccatggtcacaggaaccagccacctctgtcttaaacactttgggatccccagcacctggcacacagtgggcgctcaacagacttctcaagtgcataaactggctccttcaaacaacttgcattttccactccaccttctgccttatcccactcctcactctttcccaccatccttcaaaactcaactcaaacctctcctcctccaggaagccttcctgcttgtaccacaacacttctgtagctctctctcattttctggttgttatagttattggtcctatgacctagcttccttgggcatgacctataaagggcagggccttttttcctgcagggatcgtaaggaacaatgttcgttaagtgggtttgacacactttcatttgtgcatccgatcaaactaccaggactgattttgtgcctcctgcgtgccaggcccatgccaggttctatagtggagcagtaaaaagacacgggggcttgcagacaagtggaagaaatgtacaataatcacatgacctctctctcacacacacaggtcaggcttgtgaaagaaaagttgagtgttataagatgaaagcaaggagacctgaccttgtctaggggttaggggagggtctccctgaggactggaagtttgagaagagaaggatgagttggccaggcaaagggcaggagagggtgggctggagaaagggaattacaagcagagagggcagcatgtgcggaagcccagaggtgggaggaagcatggcaccctgaggagggcaggtttggctagaacccagggcctaagggagcagatggtatggatgtggctggaaggccaagctggggctagactggaaaggccctcatgggctctaatgacgatttggggaaagaccatgagatgttccatccaagaatttaagaaagcaagtcatgtcatctggttggggggaggcggggagtggaggggttgtggctttggtcacttggaagcccagggctagattttcaggagctaggtttctgtcttgggcctgctcaccaacaacttggcagtttcacatagggcaggactataatttcctggaggaagtaactccgggagggctcggaaactctgccctggggttccctgcctggctggggaaggtccctgtgctgaatcacaggtgtaccactagggagtcattgtattattttagtaatttttagcaaacatagacagaaaacccagtctagctttttgtgggtggttgtacccacgagggcctctgcactctgattccaggcttttgttctgtgtcctgacctttttattgagcagttttggttgagttgagtcattttctagctggacaaggccgggcagagggtgttagcatagactctcagcagggagatggacacttcactgcacagggtaggctgcagggcatgctgggaaaagagtggcagggagcagacacaacagcagagagaggggtcacgggtgaaggatcactcttcggatgatccaggctaaaccagggtggggcacctcttgtctgtctgcagatcagctctgagattcagcagagtggcctcaaaaatgtcagaatggccaggcacagtggcctgtaatcccagtactctgggaggctgaggtgggtagatcacttaaggtcaggagttcaagaccagcctggacaacatggtgaaaccctatctctactaaaaatgcaaaaaattagctgggtgtggtggcatgcacctgtagtcccagctactcaggaggcggagagaggagaattgcttgaacctgggaggcggagggtgcagtgagcagagatcgcaccactgtactccagcctgggcaacagagtgagactctgtctaaaaaaaaaaaaaaatgtcagcagtaactgctctcgatatcagggactctgactgccagaatacaaggcaaggagaagcaggtgggtgggacacagaaattgggtctctgacctggtggctcagtatgtggagggcaaagaagccaagtgcaataagagtaaagtcctatatggtacttcctacgtgccagcgcttactattctaagcactttacagaaatgcatccattgtgcagatgagaaaattgaggcacagggtattttgtccaaggtcacacaactaatatcagagttgctaggatgcaagtccaggcagtctggctccaagcccaaaccaggtagaaaaggctctgaacctacttggagctctggcccattcccaggatcttggacagcaaatgcagcgcttcccctccccaggctgggaagagaacagaggcaggagctgcacactcaccctttttggtcgcctcgaagctgtcatggaagtgaatcctctgtatgtcataggtcaaggttgtgttgggcagcagagtcctgttcctgttgatgatgttggcagaaaatcgaaaggcatgctcctcggcattcatgacctgggcgttggggccgtccgcatactcgaagattcctcctgtgaaagatgagtaaaattgtgtgtggttgggaggagggatggggctctagcaaggatgcttggctcaaaagattttatagacaagttgcctgctccctgaaatgttcaataatatcctaggtaactgccatacctagaaagtgtgcaggagcacaagaaataggaaaatcctcctcattcatttcactcaaccagcaaattcctgataacagagcccgacagggccaaaataagattaccaacttattaatattgctgtgaaaattctcaatagaattatagcaagcagaatctaccaggataacataccatgaccacgcagagttttattctaggaatctaagactggttcaatataaagaaatctatgaatatcattccatcacatcaatagttcaaataagaaaaaaaatataatcaactcacaaaatgcaagatggcatttaataaaatccaatatctattgctgttaagaatgcataataaaatagcaccagaagaaatacttccttgaaacttttttagcttaaatcagcctttaatatcatactaatggtgaaaaactagaggcattctcattaaagaaaaataagaggcatgggggaggatttgcatcacgccattaaccaatgaaataagaaagaaaaataatttagagccacaacatttgtaaagaaagaaattcttatttgcaaatgatataaaaacccttaaaataatccctaaacatgaaaacaagtaggagctagtagagttaagttaaatgaccagttagcacaaattaatagtgtttcttcatatcagtgacaatcagtaaaaaaacttaatagcaaatgaattccttttacaatatcagcaaaaacattaaataactaataataaaccaaatgagaagtgtgcagttccagttttatttatttatttatttattcatttgagatggagtttcactcttgtcgctcaggctggagtgcagtggcacaatctctgctcacggcagcctccgcttcccgggttcaagcggttctccaacctcagtctctcaagttgctgggactacaggcacatgctgctacgcccggataatttttgtatttttagtagagatgggatttcaccatgttggccaggctggtctggaactcttgacctcaggtgagccacctgccttggcctgcctcccaaagtgctgggattacaggtgtgagccactgtgccggactacaattccagttttaaaacatgacaaaaacaggctgagagcagtagcttatgcctgtaatcccaacacttccagaggccgaggcaggaagatgacgattgaagccaagagttcaagaccaacttgagcaacatagtgacactttgtctttacaaaaataaaaagaaaagaaaaaaattaaaaatgaccagcacaaaaaaaaaaaacacctttaatgagagatataaacatagccttaaatgaagagacatggtgtgtttctgaatggtaaagttcacgtgtagaggtgtcagtttttccaaattaatttttcagtttaattccaatcagaatcatgaaaggatttttcttttcctgataaaatgactctaaaatgtatctggaagactaaacatgaactaatgaccaaaacatgttttaaaaagaatgagaggtaattcgtactgccagattttaaaatatatcattaagccaaataattaaattcatgttctaatagcatatgaaaacacagatagatcaaaggaacaggataaaagctcccataaagagactcaagtagagataagtatttaaaacatgagaaagatggctagttccaatcagtaagtaaatgaattattcattaactgtgctgtgacaattattcaattatttggaagaaatttaagttagaattcaatcttaatctaaaataaattccagataaattaaagattaatggcaaatgggtaaggggaggagcagaaaaaatactataaaagtaccaaaaaagaaaatataggtgaatattttacaatattgggtagaggaggtctttctaagcctttcaaaaacatcagaaaccataaaagaaagtttgatagctccacaaaaataacataaaacttctacccattaaaaaccataaacaaaattaaattacaaacacaaacttgaaataaatatttgtaacatatgtgggagcataaagatggaagctcttattttataaaaagctcttaaattctacaaaaaggacgaatactcccatagaaaaatgtgcaaaggacgagtatgaacctttaacaaaagaaaagaaaataatacaaaggggctattaatgtatgaagaagtgtgcaacttccctaataattaaaataaactcaatttaaaccaacaatgagataccattttttgcctatccagttggtaaagatacaaaataaaccatggctccagctttggtgcgggaatagttgtttagaaagagatacctgcttaactgtgggtggagggggaaatgtatacccagcctgttgagatggacattagaaatttaccaaaagccctaaaaatgtccacgcctgtgactcgggaatttgatatctagaaatggactctaacaacaacagtaggcatatggatcatgtatggggaaggagatctagggacgttcaaccagagaaatagtaaactattgtctatgtatttacatataatcacaaaaatttaatgacacaggaaatacccatgatatatttttaagtgaacagtgagggtttctggcagaggtgcagtacaattccctttagaagaggaagaagaagaggaacttatgtctttaacataagaatagaagacatttcttgtttcattcttaatgcctttctatattttttccaattaaacctttattatttttgataattgattttgttgaggtattattacattctacaagattcacctgttttaaagtgtacaatgatttttagtaaatttactgagttctatgaccataagcacaatcctgttttagaaccttcccatcacccagtaagaatccccgtgcccatttacagtcaattatagttttcattcccactcccaggcagccactaatttactttttgtcttttctgaacatttcatataaatggaatcatgcaataggtggtcttttcatctggctttttgtatttcgtgtgcttttgcggttcatccatattagtgtcatgtatcagtactttattcctctttattgctaaataatattactttgtatagacgtaccacattttatttttctatccaccagctgatgggtatttggattgttttaattgttttgaaaattctaaaaagtagtggtttccagtctctggtctggcatatgacaagcttgaaagttgccattctgtcctaacaaccagttaaggctgaacaaactgaaaaatcaacaactcttcttagatctgtaagagaagtgaggtcacagggcaaaccactgcccccagaattggagagataggtaaatagagagaattacaaattaatggagcagaaacctccatgggaatcggtgtgcaggtaggaaaaccgaaagtgtaattgactagttgctggaggctcagtgtggataagtctgagagacaaaaacctcaggggaggccttcactgggcccccacgcttttgtgagttttactcctggaattctaccaggttcttaagtgaatattggagaaaaatccccatgtgcttctggcagtggaaggggaaaaggaatcatttcaaaatatgccagagcattctgtttttaacaaggtttgtcctcaggggaaactagttagccagagcctaacctgctggggtttcatgagagactaactgacctggtggaagggaaatactcaactccagcccaccctagccatcctatcccttctacacgtgtgtgttgcgggggaggtgggggagaagcacctgtgaagtttaccgcccaggggcacaggctcaccaaaagactgagatgtaatcatagcactatagaatgcttccccctctcctcaccccttaccactaaatcactaaaggccttattttcagcagttacttttacccagtgcatcatgtccagctatcaagaaaaaattacagggcatactaaaaggcataaaaaccatagtttgaagagacagagcaagcatcagaaccagattcagatatggcatggattttggaattatcagaccagaaattcaaaacaactatgattaatatgctaagggctctaatggataaagaggacagcatgcaagaacagataggcaaagagatgggaattctaagaaaaaaaaaagaaatgttagagataaaaagcaaaacaaaacgaaatactgtaacagaaatgaagagtgcctttgatgggcttgtaagtagactgaacacagctgagaagtgggtctctgagcttgaggatatctcaatagaaacttccaaaactgaaaagcaaagagcagaaagactggaagaagaaaacagaatatccaaaaactgtggctgtaaaaatgcctaatggaaatgcaagaaggagaaggaagagagaaatgatcaggagaaatatttgaaacagtaatgactttcctcaaattaatgtcagacaccaaaccactgatctaggatccttagagcacaccaagcacaaagcaggaaatatgtccccaaaatgacactgaggcatatcattttcaaacaatagaaaatcaaagatcaagaaaaaaatcccaacaagcccgaagaaaaatgcatcttatctatggaggaaaaaagataagaattacatctgacttctcttcagaaaccatgcaagcaagaagagggtgaagtgaaatatataaagtattgagagaaaataaaaaccaacctataattctgtatcctgagaaattatccttcaaaagtggagagaaataaagactttctctgacaaacaaaaatcaatgaaatttgttgccagtagatctgccttacaagaaatattaaaagatgttctttagagagaaggaaaataatataggtcaaaaacttcaatctacatacaagaagaacactgaagaaagaataagcgaaggtaaaatttaaaaaatgtatttttcttactcttaattgatttaacagacaatagtttgttcaaaataataatagcaacaatgtattcataaatatccacttatgtatgcttatatatgagcaaaatgaatgacagcaatgatataaggatgggagggaggaattaggattattttgttactgtaaaatactcacactacttgtgaagcagtataacattatttgagaatgaacttggattagttgcatatgtatattgcaaactctagggcaactactaaaaaaatagtacaattgacatgataagtgaggagaggaaatgaaatgataaaatatgctcaattaaaatcatgaaaggcagaaaagggctggaaggcaaaaatagaaacaaagaacaagggcaacaaatagaaaacagtgacaaataaggtagatattaatccagttatatcaattctcattttaaacatcaaaggtctaaatgcatcaactaaaagagattgtcaaagtggatcaaaaaacaagatccaactatatgttgtctacaataaacctattttaactatacaggtgcacataaaataaaagtaaatgaacaaatgaaaaatttattcctggaatgcaaggatggttcaaaacaactgatcaatataatacatcatagtaacagaataaaggaaaaaaatgcgatcatctgaatcaatgcagaagcagcatttgacaaaattcaacaactattcatgataaaagacactcaacaactaggaacagaagggaactatctcaacataataaaagccatttatgaatagcccacagcaaatgtcatactcaatggtaagagactgaaagcttttcctctaagatcagtgacaaggctaggatgttcactttcaccacttctattaaacattctactggaagttctatccagagcagttaggcaagaaaatgaaaaagaaggcatccaagtcagaaaggaagaagtaaaagtgtctgtctgcagataatatggtcttatatgtagaaaaccccaaatatttcacaaaaaatcagttagagctaataaaatttggcaaagtaacagaatacaaagtcaatacacaaaatcagttgcatttctatacctaacaattaacaatctgaaaaggatatcacaaaataattccatttctaataatctcacaaaggacaaactacctaggacttaaccaaggagatgaaagacttgtacctgctcaatgaaaactacaaaataaaatggggaaattatttaaataggcatttttcaaaagaagacatacaaatggcaagcaggcatatgaaaagatgctcacatcattgatcatcagaaaaatgcaaatccaaactagtgaggcatcatctgacctcagttaaaatggcttatatccaaaagacaggcaataataaatgctactgaggatgtggagaaaagggaaccctcataccatgttggtgggaatgtgaattaggacaaccaccttggagaacagtttggaggttcctcaaaaaactaaaaatagagctaccatatgatccagcaatctcactgctagatatatgctccaaagaaaggaaatcagtatattgaatagatatctgcacacctatgtttgttgcagcactgttcacaataaccaaaatttgggagcaacctacatgtccatcaacagatgaatggataaagaaaatgtggtgcttatacacaatggagtactattcagccataaaaagaatgagatcatctcattttcaacaacatagatggaaatgaggtcattatactaagtgaaataagccaggcacagaaagataaacatcacacactctcaaaccaaaacaattgaaatcatggagatagagagtagaaggatggtaaccagaggctgggaagggtagtggtaggctgggtggggggaggtgggggtgcttaataggtacaaaatagataactagaaagaattaataagacctagtatttgatagcacaacagggtgactataatcaataataatttaattgtacatttaaaaactaaaatagtgtaattggattgtttgtaacacaaggataaatacttgaggggatggctacctcatttcccatgatgtgattattacatattgcatgcctgtatgccttacaagaaatattaaaagatgttctttagagagaaggaaaataatacaggtaaacatctcatgaacctcataaatatatacatctattatgtacccacaaaaaataaaatttaaaatgtaaaaagctcttcaaaacattgttgaaggtaattaaataagacatcaataaatgtaaatacatcccatgttcatggactggaagacttaatattgttaaggtgtcaatactgcccaaagtgatctgtagattcaatgaaatccttatgacatttcaatgtcaatgaaaatcccaatgacatttttttgcagaaatagaaaaaccaatcctaaaattcatatggaattgcaaaggaatccaaatagccaaaaacagtcttgaaaaagaagaacaaagttgaaagacatttcctgatttcaaaacttactacaaagctagagtaatcaaaacagtgtgatactggcataaagacaaactatatatagagtccagaaataaaacctcacatgtatggttaaatgatttttgacaaaggtgctaagactactgaatggggaaaggatagtcttttcaacaaataatgctggaataactgaatgtccacatgtaaaagaatgaatttggatccttacttaacaccatatacaaaaactaactcaaaatggatcaaagacttaaatgtaagacctaaaactatacaactcttagaagaaaacatagaacaaaggcttcatgagattgaatttggcaacaatctcttggatatgacaccaaaggcacagacaagaaaagaaagacaaattgagcttaataaaaaattaccaaaaaactgtatatcaaaagacactattaacagagtaaaatgcaacctatagaatgcgagaagatatttgcaaatcatacacctgataaggaattaatatccagaacatattccagaacaattaatatccagaacaatatccagaaaagaaggaaattcggacatatgttacatcgtgaataaacattgaggacagtaggctaagtgaaataagccagtcacaaaaagacaaatactgtatgattccacttatatgaggtacttagagtagccaaaatcagagaatcaaaaaatagaaaggaggtttccagggcctagaggaaggggggaaagtgaagttattctttatggatatagagttatagagtttcagttttacaagatgaaaagagttatggagatgagtggtgctgatggttgcacaacattatgaatgtatttagtaccactgaacagtacacttaaaaatggttaagatggcaaattttatgttatttgtattttaccacaataaaaaagtaaatgaatgaagacatgccatcctaatatcaatcaaaagaaagtgaaagtagctgtattcagatggagaagactttgggtcaaggaactttatcagagacaaagagaagcattacataatgatgaaggggtcaattatccaaaaagacgtaacaatctttaatgtgtatgtgctcaaaagagagcatcagaatacatgaggcaaggaaaaatggatgaatttactattctactaggagacttcaacacccttttatcagaaatggactgatccagttgacagaaaatcagtaaggttatagttaaactcaacaacagcctcagtgaatcagacgtaatgtacatctatagactacttcagtcaacagcaacagaatacacattcttctcaagctcacatggaacattcagcaatatagaccacattctgtccataaagcacatcttaacaaatttaaaagactagaaatcatataatgtctactcttagaccaccgtggaattaaactagaaatcaataacagaatgagatcagggaaatccccaaatacttgaagattaggcaatgctcctcctccccctcctgctcctcctcctcctcttcctccttctcctcctcctccttgttttgctatgtggactcaaactcctctgctcaagtgatcctcccacctcagcttccagagtagctgggactacagccacataccactgtgcccagcttaaacaatgtacttccaaataacacatgggtcacaaaagaaatttaaaaatattttgaactaaataaaaatgaaagcataacttatcaaaatttgtgggatgtagtgaaagcagtgcatagagagaaatttatagcactgaatgcataaaatagaaaagaagaaagatctaaaattaataatccaagtttctacctcaggaaactagaaaaagaagagcaaattaaatccaaagtaagcagaggaaaagaaataataaaaattagatctgaaatcaatgaaactgaaaacaagaaatcaatataaaaatatcaatgaaaccaaaagctggtcatgtgaaaagacagataaaattgataggcctctaatttggccaattaagaataaaaaagagaggatacaaattgttagtatcagaagtgaaagaggggacatctctacagatctcgtggacattaaaaagattatcgaggaatattaataactctatgtccactaatttgctaacctagatgaaatgaatgaaacacaatttgtcaaaattcatgcaagaagaaagagaacatttgaacaggactctctctattaaagaaattgaattaataataaaccttacaaagcagaaatcaccaggcccagatgggttcactggtaaattctactaaacatttaagaaagaaataatacaaattctctacactctattggaaaacagaagcagaggactatttcttaactcattttacaaggccagcactactctaataccaaaatcagacaaagacatcacaagaaataaaactacagatcaatatctctcattaatacagatacagaaatcctcaacaaaaagttagcaaattgaatccaatcatgtataaaaagaactacataacacaaccaagtgggatttaccccaggtatgcaaggctgtttcaagatttaaaaatcaattaatgtaatccattatatcagtatcaacaggccaaagaagaaaaatcacatgatcatatcaacagatgcagaaaatgcatttgacaaaatccaacaccccattaatgataaaaactctcagtaaagtaagaataaaggggaatgtcctcaacttcataagaatattaatagcagaatacacattcttctcaagcacatctacaaaaacccacagttgacatcatacataatagtgagaaacttgaagctttcccactaaaatcaggtacaagggaaggatgtcccctctcccactgcttttcaagatcacactggaagtcctagcaaatgcaataaggcaagaaaaggaaacgaaagaaattcagattggggaggaagaaataaaactgtctttgtttacaggtgacatgatcccctatgtagaaaatccacgtgaatcaggaacaaaagagaaaactacctcttggcattaataagcaattatagaaaggtggcagaatatacggttaatatgcaaaagtcaattgcttttctatataccagcaatgaacaaatggaatttgaaatagaaacaagatcacttacattaacatgcaaagaaaagaaacacttgggttataaatctaacaaaatatgtacaagatatatttgaggtaaaactcacaactctaatgaaagaaatcaaagaataactaaataaatggagagaccttcaatgttcatggataagaaaagtcaattattttcaagatgtgagtttttcccaaattgatttatagatacagtgcaatcccaatcaaaatctcagcaagttattttgtggctattgacaaattgattctaaagtgtacatagagaggcaaaagaccagaataatcaacacaatattgaaggagaagaacaacattgggagatcaacacggctcaacttcaagacttgctataaagctatagtaatcaagacagcatgatgttggcatatagacagacaaatagatcattggaacagaatggagaattcagatgcagacccacataaataaagtcgaccgatctttgacaagggagcaaaggcaatacggtggagaaaagaaagacttttcaacaaaagggctagaacaactggacatccacatgcaaaaaagaatctagacacagaccttacacccttcacaaaaatgaactcaaagtgtatcagagacctcaatgtacaatgcaaaactataaattgccaaacttgggtttggcaatggctttttagatataataccaaaggcacgacccatgaaagaaataattgataagctggactacattaaaattaaaattttctgctctgcaaaagacacagtaaagagaatgaaaaatgaagccactgactgggacatatcttatgatggactacttttttttttgaaacagggtcttgctctgttgcccaggctggtgtgcagtggtacaaccttggctcactgcaacccctgcctcctgggttcgagtgattctcctgtctcagcctcctgagtagctgggataagaggcgtccaccaccacatccggctaatttttgtatttttagtagagacagggtttccccatcttggccaggctggtcttgaactcctgacctcgagtgatctgtctgcctcggcctcccaaagtgctgggattaccgtgagccaccacgcccggcctgatgatggactattatccaacatatgcaaaccacttttaaaattcaacaataagaaaacaaacaaccttattaaaaagtgggccaaagaccttaacagaatatatacagatggaaaataagcatatgaagatactccatattatatgtcattgaggaaatgtaaattaaaacaacaacaagataccactacacatctgttagaatggccaaaattcagaacactagcaacaccaaagtctggcaaggatgcggggcaacaggagccctcattcactgctggtgagaatgcaaaatagtacagccactttgaaagaaaagtttttcaattgcttatgaaattaaacatactcttacacgcaagtgcaatggcactccttcgtatttacacaaaggagttgaaaatatgtccacacaaaagcctgcacatggatgtgtatagcagctttattcatggttgcccaaacatgggagaaatcaagatatccttcagtagatgagtggatacacaaactggctacatccagacaatggaatattattcagcacgtaaaagaaatgagctatcaagccatgaaaagataaggataaaacttaagtgcctatcactaagcgaatgaagccaatgtgaaaaggctacagactatatgatttcaactactgacattctggaaaaggcataactatggagatagtaaaaaaaagcagtggcttccagcgggtggaggagggagagatgcattggtaaaaacacagaggatttttagggcagtcaaatgattctgtatgatactattatagtgaatacatgtcattatacattagtcaaagcccacagaatgtacaccaccaagaatgaaccttaatgtaaactatggactttggatgatgatgatgtatcagtataagtccattcattgtaacaaatgtacctctctggtggcagatgttgataatggaggaggctatgcatgtgtgtgggcagggggtatatgggaaatctccgtgccttccactcagtttttgctgtgaacttaaaactgctccaaaaaataaaatctattaaaaagaaaaaagggtaatattttaacacgtgaacacacaactgtgtcccttccagagtactccagcatgcttacagtttgtaacacttaagtgtgtacgcgtgtgcatccacacaggtgtgcatcgacatgccgagcacgtgcataaaacaagacaagaagaattcgtaccaaaagttaagggtggttttctctgagtggtaggctcatgggtaaatttaatttccttctttgtgtttttctgtatttttaaaaagttctgcagtgaacatgtgttacatttctcatcagaaaagccatcgtgattgtgtgtatgtgtttaaagggaaataaatgatcaaaataccatatgacccagtaattccatttctaggaatataaatttagagaaagttggagatatataaacacatttatggataaggttttttacataatattgaaaaaaatagaaacagcttaatgtccaaaagcaagagattactcaatatattaaaacccacccatatggcagaacaacttgtaggcattatcaatcaaagcataggatgatacggtacagtgaatgaaattggattcaaaatgtgggaagaattttactcacatgatgcaaagtgggtacagatggggcagaagaggccatgggttttgctggggccagatgaagggcacatgaggattcattacgctactctctctgtgtgtgtatggcagacattctccataataaaatattccttaaaatcatgatatgaataagacaaaaataacaaatcatgttgttgcaatcagaaaagagacacaattaatactacttgcagatgcttattatggttctcttaaaaacacaagggaatcaggtgaaaacctagcagaaagtaaacagagagctcatcaagaggccagcatacaaatatagaaaaacatatagcctccccacatagcagcaataaacagcaaggaattataggggaaaaaaagagaccctactcacaaaaacaacaacaaaaaaagaaaataccttaccataaatgtgcaattcctatatcaagaaaactacaaaactttactagaggacataaaagaagtcttgaataaatggagagacataacttactccttggaagggatggctcaatattgtaaagatgtcatttctcctcagattaatttataaatttaatgcaattccaattaaaatcaaaaaggacacaccagaaggacacacactaaaatgttaacagaagttctttctagaaagtaaaaagataatggattgctcttgcttggtgcttttttttttgttttccaagccctctgcattgagatagagctttggtaataagaaaaaaaaaacaaagctttagcgaaatgttcttaaagaatacttaatggcatagaaaattttcatcctctccctgctccccaatgctacaaaataatattacagtatgataattatttatcaaacaaaaagcatatttacagaagaaagactggaaggatttgtaccaaaatgttaccagtgaatatctctggatagaagtttatggataatttttatcttgttctttgtgttttcttgatttttccaaaattatttacaacaagtatgtattattacttcaaaatgtgaaaacaaacacacaaaaaacaaaaaaagcctggaaagaggtctggttattacagatctgaagaaagatacctctacccatcccaaatggggataaaaagtcaggggacaaagccatctccatagggcttcacatcctcttcctggcctctcagaccttggcaggtggggaggaggggaaagagaggggccatcatctcaacaaggatggtgacatgtctcagccattaagacctaagtccaagggatggagcctcagtcttatcctatataaaacagctccattaatacccactaatctctgccctgtgccaccctgtcactgggccctgggataccaaaagaagtcagcaccaggctcctgctttcaaggaatgctgaaccccgcagggcagccgagaagaacagacaactagcacatgtgtggtgctccactcaggtgcaataccagggaggttcccaattcaggtttcagtgacagccatgcttcagtcccaaacctagctctatccactggaggaagttactcagactctctgagactcagtttctccgagactcagtttctccacctgcaagatggggtacacatctcagagggctgattattgtgaggaagacataaaacaatggagctactgcatggcacatggcaaggacttaatacacagtagctatcaaagaaagagtgaaacaatgagtgctactatactatttagaaaacagcaaataaaagctaccatgcaatttagaaaaacaaagtgaagtgtgagcttccacattttctagggcagggttgacaaactttgtctgcaaaggatcggagggtaaatgttttagatgataagtatttttggctttgtggaccagatggttgttgttgcaaggactcacttctgccactgtagcacgctggcagccgcagacaatgtgtcacagtaggcacagttgtgtttcaataaaactttatttgcaaaaatacagaatgaagagatgtttcatgggtacaaatatatagcttggtagaagaaataagacctagtgtttgacagatcagtggggtgactattaatgtaagtttacaataacttattgtttatttcaaaatagctagaggagaataatttgaaggttttcagcacaaagaaaagataactatgtaagatgatgaatatcctaagtatgctgacttgatctttacaaattatatgaatgtattactttatcatatgtaccccaaaactctgtacatctattatgtatcaataaaaacataaaattaattcaaaaaacaggtggtgagtggctggatttggctattgggctgtagtctctacttgttctgggggtgggcagcgtttatttcagaggtgagtgagtgtttccttaggaaaagcacctcagggcctgggtaaagaattaagactatgacggaacaaaatcatgatgcaaaagaaacaaagacaggatgctggagttttgagtggagaagatgtgagacaaggaggaaggcctaagagaaagggaacagagatgaagtggaccccaaaggacagaacccaggcccaaaggtgggcgagtcaagtaagaaattcaccacagcaggagggggccatgcatttttcatacagtgatgtccgatgctgggttttaagttgagcctcccttccttccaggaggcccatcgttagaaaagtcagctacagaatactgacaccagctcctgctgtttggaggaaggcgacagaagatgggcatggtccaaaacagagtgagtcagggcagagaaaggacaagaggcgagatgagaggagacagaagactcagcagaagacactggagcatgaggtcatcaggagaaacaggaagccctagagcatcctcagagacatggtgggtgagaggctgcccctccacccccaaactcagtacaagggtgggaggtgttctaatgagtgtgtaagggctaggtggctgcaaaggctgaatatcatgggacatccaagcagcaaatattgaggggcaccacagaggttcagagagtgggttctaggcacaggcagacctcgatttgaattttggttccactcacaggctacccctttctctagggaattgttcccagtgagagaggcccccttgcccaggaggaggggtcactcacctgggcccctggaagcagcctgccatcaataaccaactaataatggggctcaaaagactgggcggtcccttgcttcagggtggggacaatctgcagtatgacatattctttggagcccctccccacactccccaccttgcatcaggcaaaggctagatcttggcagaggcacatctctgcccaactccgtcctcttcccaaccctgccttattcattcccctacagggttttcctgaagagcactcttcccctctataaaccccatgcatccgaatccctgcctcaggctctgcttccaggggacctgacctaagacaggggtgacattactggggggcagtgtcaactgcactactttagtgttgctggagatggggaaggggacgctggacctcattaactgctaaatggccaaggttctccactaccctctccctcctgggtcctcctgctccctctcccttctagagagcctgtagctttgggagctcaggcatctgattgtcctgggttctgatccaagctccacccatgcaagaagggctgctttgggtctcagcttctggagagagttccctgccccgctggaggctgcccccctttccactggctcctctccattctctgccttcccatacattcctcatgatcgttatttaaagaggctaataagtaggttggcaccattgattaacgcataatcttaatcatgattgcatagtgtaattggcattaatttgaagagccagttcattatgaaaataattgtcactgctttctgctttaataaaatggagcagagacactgaggcggctaagaaatgggatagggtgtgtgtgtgtgtgtgtgtgtgtgtgtgtagggaggggtgtgtaagatgagtcccagaagacgtgagcaggggtggaacagggtgcagctggaatattttcttcaaacaaaaccttgtgtggaagcccaacgggtaaaacaaataacaacaaccacagcagtaataacaactgactgtgttccagggatgatgctgcatgccttccactcactacatttaacactcatgagaacctctacaaccccattagagaggaagtaacattgcctcaatttacacaggagaaaatggaagtccagggaagtcaaggatgttgttaaaactacaaagtggcaaaattctctttgcaaccaaagccagtgacgtgctgcagccggctagtaccagctttcaggagccaattgttaaattttcaggaattctgaaaaccagttattaaaccattggcagcctgaaatcggccatagtgagagtatttacaccacagaaataagcagatactacaaatcagggctttttttttttttttccttcctgagatggagtcttgctgtgtcacccaggctggagtgcagtggcacaatctcggttcactgcaacctccacctcctgggttcaagcaattctcctgcctcagcctcctgaatagctgggactacaggtgcacgccaccatgcctggctaattttttcgtatttttggtagagacggggtttcaccacgttgaccaggctgatttcgaactcttgacctcaagtgatctgcctgcctcggcctcccaaagtgctaggatgacaggtgtgagccactgcgcccggcctttttttcttttttatcggcatgcccctgcccaaacccatttgcatcactgggctctgaaagacttgatgtcacagcttctgagaaggctctgtagcttcctgggctctgagtgtggcaagaaaaccactgctcaaatctaacccctaactgagagccagagttggggaggaggggtagaactggctgtgtcaactgcaaccaacttctttcttcatctttctactatgatatgttgttatatgtttcgggaaacatactgaataccctaagcattagtgcctatattttttaaattgctttttttacctctagaaacatgcccaatggtggaattcctctgcctcccaggtgaggatgctatgatggcctgtgtcaagctgaatgtgacctccaaaaccagggggaagctccttgcttaagcttggccctctgacctcatgactgtttaggtgtcctctggaacccgttgaggttttttcctttctcttcaataactctgtgctcttaaatttagccaagcagcccagctggcctggcccagagtgcagtgagcctgggagactcaggcaggacttaaggcctgctgccattatgaagagtcccagaagacattcacgctcccagcaccaggcccaggctccatttgtcctcaggggcctgagcccactctttcttttctagactgctttgtactttttctgaagtttccaaggtgttgtggagattaattgagacgtggatcagcgagattgttgctaacagcctcttctcagggcccgcctccctgtctgttctgatcagggttctctttgcttcctgccagggcccccgcagctcagtgcagctgtgggctggaagatccaggctctgctctctgctgcgccttagccagacccctgggggaactggtggtgtctctgaacctgcttctcaggcacctctgtgccctctctcagcagcagtggtgggggggcggggacagggacaagtcagttgcttcccctgctggacacagcatgtggtttacagaggtggagcagcacccagtgaaacggtccagggatgggctttctaatgtcctgggagaggaaagggagacgagggatgtgtgtcccccttcttgttcattcagttcttcattcattcatatactcattaactcattcattccataagcaggtaattggctacaatctggaacaaggcactatgctgggcactaggtgagtcagtgagagattagtttcagccccgttcttcaggaactcctagctcagaacaggaggtgagtgggggggcataactcaaaacgctgtcaaggtgagaacgctccatgtgataaccacggactaaacactggggagactcagaggagagggcatcttgcggacgtcttcatgggggaggcagcacctgacctgctcggagctgagctgtggaaggaacacagcaaccagcaggggcactggccttggatagattatcacagtgaggaggacctgtacagacccactggggagagagggagggagggggtggccggaggggagctgcgtggttggcttttctaggattggtcaataataaactgagggagggaggtgggggtctgggagagggtgcatccaacatgaccccagtgtttgaatgaggatgaggttcagctaagcatgtgggctctgcagccagaaggcaccacttcccagctatgtcaccttgggcaagtccctttactgctctgtgtctctgtttcatcatctgaaacagagatattaatagtgtttacaacataggggtattttgaggcttaaatggcataaatcacctaaagcacattgtatgcctttgataagaataagaaattattatgaggtgataggaaggctggagggccttcaacggagctgtaggcaggcatccagagaaggggcagatctgagcagaggatgtgcacttccctggggtcccagggggactcctgattgagttccggggcctggtggcagttgttttaattgatctagtgctatgaggagctttgtctgtacaactcagggacatgcaagtcaaatattgcagaatcgaccgtgttgggaggatggctggaggctcttgtgctgcccagagaccctgatgagggatgggctgtcatcaggcaggaggagcaggagtacaatgtgggcagaggactgagcggggagctgtggaggggccctgtgagcagtgcctgtccttgctggaggggacaaaggaatggagatctagagccaccatgcgggcctcccccagacactggcggggctgtcccacctccgcggtcagtcagcagagcaattccacagccccctcttcacgcacacccactggcagcagaaaggacaactcccttagcctggtgtttggggcccttccccatccagcccagcctctcttcagcgtccactcttccaggcagggtgtcctcaccccatgctgtttctcaccactcccttcacgcacaccttcctctgcgtctcgcttttccttctttctctgggtttcgtcctgggtcacgcttttctcttctgagccttgtgcaacagacatgatcctcgtcccctgatcccaaccccagaggccactgcagacacttcctctgcatgccctcagcttccacgatctctgatactctctggcaaaggcgcggatttggccagcacatgggacaggctagggaggcctgggagctggtggataaacgtccagcttcctcgccccttgcaggcaccgttgggatgcagattctatgcagtttctcaataggccccagcagaacagaacccccctcctcccccctctgctgcccacagtgtaacccacctgcctgcacacccttgcttggctcccctgcttaccggtctctcttccctgctccctcatggtcctgattcctggagccgcctcccagataaactatttacaccctagccctcctcacagggcttgcatttgggggtccttgactaagagctttcctgagctccctatgcgtcctcctccgtatcctcacacatggtggggggctgcgttgtgctgtgctgagtcctgggccccactctcccccttctccattaggctgaggtcatctagagggtgaggacacgcctttgtcatcctggcatctccttccctcccccagtgcctgacacactatctagcacagataggatgtcaacatgtttgttaaatatatgtatatgtatgtgtgcctaaaacacatatgctgcttgttttaagaagctaatttgagttcaggactttgatatttacgtgacaaatcaaagaacacacaaatatctctcagaccatctgtaatgattatgcacagccaggaggacactagctcctgctgttctcaagccctccgctaccccagctccagcagggatccgctattagtagatagggagactgaggctgagggaccttcagtagacaccctgtcccttacaagagtggataggggccatgtgcctggcatgagtaggcagctgcacagagagggcctggctctccctggatgggggcgtgtcccaccaccatcccaactgggctcatctccaaacccgggcacctgctccatagcaatgccaggatcagggagagaaccctgccaccagcagcccctctgtgccagcctgcccacccacagacctgccctgagaaagccagaaggcccaatctaaggtcactccagaaatgagagtgggcagaggcgagggtcaggggagcaagaccgggaaaattagtggaggagaacagaagccccctgttctgcgtttattacttccatcctcgtctgttgtaaatatcaattgctatgcaggttaaatacttatccagatgccttttagcttaaaagcaagctaattgatctctggagatcctgaatgaacagtgaagaaattgcactaattatagaatcaacttccactctcaattttgttttgttttgtttcttctctaacaatactgctggagtgacagaaaggggcctggtggagcagacacacaaagcacacatcattctcatcaggtggcaacaccacgccccacagccccacccccaatcacagcagggcctttggctttctgggaggagctctcccaggcaaacctctcccagaggcatgactctaagatgctgaaaatatcactgccgtccaccatcggccagaatccactgaagtcacctgccttcagcccacccatcctgcaggttctaccttcctctcccaaatccccacaactctcccaaaaccaacacaaatgctgccaaagctactcctgctcacatattctgacctcctctggggtctcagctcctgacttgtcaccggccacctggaattaaaggcacagcacagctttgttcttggcacagctctggtccctgtctctagctccttgtttaccagggaggtcccacactgcagccccacggtgccggggcaggtgtgggagcctcagctttctcatctagcaacagtagaatggggctgtatcctttctccctcccgcttgggaagatgtgtcctcttgcttcctcttctcacctcagctcagcttttgactccacttactatgctgcctggggtagaatggagaatggacacctctggcttggctggagggaaaattgtgtcattgctatttcagtggccccaggaaactgcagtcaatgtgcagagaagctaaagtcttctttaagttgagaaaactagaagttgaacaaggttgagcaggtttcttttctgcaggacttctctgggcatttgctctgctcacatgcagagcctctgagaggtgggtagcaacatttcccaaacttacttgacaaccggggaaaccttttctggcagagcatcttactggaaacacgcttctggaaatcgctgtgttacagtgacttgggcaaaagttatttatcctgcctctgaggtgtgagctatttgaggtccagggctagatcctccacatctcagtcagccccacacactgggctccccagccctgtgcactagagacacacaagaagaataagaaagtacaacggtgaaactatttgatctactcagcccaacgggccccaccaaatgatggattttgctttttaaagattgattctgaggcatcagtgaccggttgttttaacacagccttggaggtgtgattactccactagactctcatttatgcatgtgtatgcacctgggcaggtgtgagcacacatctcacctgggcagggcacaacaggagggaaggctggggaaccaattcatcagcctggtgctttgtgcctctccctgaggtagttgtttcaaataagggattctgacttaattattatcattagcacatgaggctgcttggatcttcataagttcgtgcaaaggaattctgagcgaccttgtcctttatcaacaccccagaaaaagatgttcctccattcagcccttccttcactcaacaaacactcagggagcacccaccatgtgtcaagtactgggcatacagcagataaacagtaggggagacctctgccactgtgacaccttgcttgctttctcaaagttcttcatgcagcttaatatctatttgctgtcttaaatatctatttgctgtctagtgtacagtccacctcttctccccaccctcagcacttagaagttccttgggcctgcagatcttatcagcttgttcatctctttctctccagtgcctagaacaagacctggcacataattggcattcaataaacatttctcaaatataaataaatatgcacaaacatacaagtataaacaagcatgaaatggctaaacagcaaaactccggggtgggaacaagtggaaagtggtttttaaccaaagctgctgcctaggggagggatatggtttggatgtgtccccacccaaatctcatcttgaatccccatgtgatgtgggagggacctggtgggaggtaattgaatcatgggggcaggtctttcccgtgctgttttcatggttgtgaataagtctcacgagatctgatggttttaataaaggggagtttccctgaacaagctctcttctcttgtttgccaccatgtaagacatgcctttcaccttccatcatgattgtgagggctcccagccacatggaactgtaagtgcattaaacgtctttcttctgtaaattgcccagtcttgggtatgtctttattggcaacatgaaaatgggctaattcagtaaattggtactgggagtggtacgttgctgaaaagatacctgaaaatgtggaagcgactttggaactgggtaacgggcagaggttggaaaaatttggagggctcagaagaagacaggaaaatgtgggaagtttggaattgcctagagacttgttgaatggcttcaaccaaaatgctgataatgatatcgtcaatgaaattcaggctgatgtgatctcagatggagatgaggaacttgttggaaactggagcaaagctgacttgctatgttttagcaaagagactggcagcattttgcccctgccctacagacttgtggaactttgagcttgagagagatgatttagtgtatctggtggaaaaagtttctaagctgcaaagcattcaaaaggtgacttgggtgctgttaaaggcactgatttttaaaaaggaaacagagtataaaagtttggaaaatttgcagcctgacaacatgatggaaaagaaaaacccattttctgaggagaaattcaagccaactgcagaaacttgcataagtaatgaggagcctaatgttaatccccaagacaatggggaaaatgtctccagggaatatcagaggtcttcatggcagcccctcacatcacaggcatggagacctaggagaaaaatggttttgtgggccgggctcagggttccagtgctgcatgcagtctagggacttggtgccctgtgtcccagccactccagcagtgactaaaaggggacaagttacacctcgggctgttgcttcaacgggtggaagccccaagcctcagcagcttccatgtggtgttgagcctgcaggtgcccaaaagtcaagaattgaggtttgggagcctctgcctagatttcagaggatgtatggaaacacctggatgcccagacaaaagtttgctgcaggggtggggccctcatggagaacctctgctagggtagcgcagaagggaaatgtggggttggagcccccatgcagagtctctattggggcaccacctagtggagctatgagaagagggccaccattctccagaccccagaatggtagatccactgacagcctgcactgtgcatctggaaaaaccacagacactcaatgctgacccatgaaagcagccaagatagggactattccctgtaaagcctcaggggtggagctgccaacgaccatgggaacttacctcttgcatcagtgtgatctgtccagtgaggcatggagtcaaaggagatcattttggagctttaagatttgagtgccctgctggatttcagacttgcatggggcctgtagcctcctttttttaagccaatttctcccatttgaaatggctgtatttatcgaatgcctgtaatgccattttatcgaggaagtaactaacttgttcttgattttactggctcataggtggaagggacttgccttgtctcagatgagactttgaactgtggacttttgagctaatgctgaaatcagttaaaactttgggggactgttgggaaggcatcggttttgaaatgtgaggacatgagatttgggaggggccaggggtggcatgatatggtttggctgtgtccccatccaaatctcatcttgaattcccacgtgttgtgggagggacccactgagaggtaattgaatcatgggggcaggtatttcttgtgctgttctcatgatagtgaataagtctcacgagatttaataaggaggagtttccctgcacaagctctcttctcttgtctgccaccacgtgagatgtgcctttcaacttctgccatgattgtaaagccttccagccacatggaactgtaagtccattaaacctctttcttttgcaaattgcccagtctcaggtatgtttttatcagcagcttgaaaacggactaatacagggaggttgaagaggacaccacaggaaaatgtcattcaggccttttaagcagtggggagagattccttataggagcatccagagcagaaagctaagctgctcttgtcaaaagccagaaggactcatacccccacccccagtcacagccactcagaaactccaaggaggtttataaggggaggccagcagctgcatttgcagaactggagcaaagttgcaatctcaaaatttgcatgggctgtcagcagccatggagaagagaagtagcttgaattttaaaaatataggtttaaagacactgtactcctctaaaccctgcactttgaacaatgcaaagacaggactttctgtgtaaccttctggtgttagttagcaggggaacccaaagcagctctgaagtcataaaaacaagaagtatcactaacacctatagaacctatgttccaagcctttcccttcattatctcatttaatcctcacagcaaccctagcaggtagattctgatatcattctcctttttcatatatcaggaccccacctacctttctgccctatgtccctttaaccttcttatgcagtgtgcatttttgctgtatcagacagcccctcagcaagcccataaactgccacatctttgcccatgtctttgctcatgacattacatttattattaatggcgacaaagtatctgatcccttctcgtgcatcaggtagtgtgccaaatgctttatgaacatcatctggtttaatctctgacacacccctaaatattaatattagattcccactgtatgacagatgaagaaactgaggttcagacagagtcgtaacctccctatggttcataccttgcagccaggtgtgtccagctgtgtcctcccccagacaatgccagttggtttcatctttcattcagcatttgccctgtcaccatttccacgtctgtctcccacctagattgtgtgaccttcaagagatgtgctgcctagtcttgcacagtgcctggaaactgagccagtgggaataaaccccacattcttggccctgtgtgagcagccctctgacctctctgagcagcccttctctcattcattcattcactcattcattcattcaattactattcatcgaacaccaatgacaggccaaggactgttccaggcactggagatacagcgctgaactaagcaaacatgctccctgcctttagggcaccaaccttgctttgataaaagctatgaagagacctatgaagggtgagatgatgaggagcccatagaggggactgtttttatggctttcccaagggaggttcaatgcagccaatgtccactggtgccttctcagtgctggggtagaaaaatgggtaagggccagtccttgccttggtttgttcacaaactgaagaaggaaagtgtcaaatggagaaataaccaacaatcagggtgatgagtgctctactgtgataaactcagtgttcaaggggaagaaaatggcctggaagaatcccagaaggcctctcagaggaagtgatatttgggctgggcttttttaaaattttattttattttattttattttattttattttatttattattattatactttaagttttagggtacatgtgcacaatgtgcaggttagttacatatgtatacatgtgccatgctggtgcgctgctttaaagagtgagcagaggaagagtaaaagcacctgacatgcagagggagcagctggagcagcaggaacgagcctgctggttttggcgaacaggcaggagtcaggcatggtcatgcctggctaagtcacaccctgccagccatctccttccaggtatcagtttttctcactctctgtctcagaacagaaatgctgcctcaaggaactgctgctcccatctccagcactgctgtgcccggctgtcagtggacacatggtgatggcacctccactgtgtctcccacagtgctggctctgccagtgagccctgcagtggaggactggagagttttgtaggagaactcagtgcccatggcccctgggccctacccgtggcgggtgcatatcctcatcttcaggagagaggtgcatggtgtgggggaagaggaagatgctcctcctgcctggagagccagctccatccctgccatcagcagatgcatgcaagctgcagctgcggatgctcactggatgcagtatggctcccggttgccaaaagcaaagtgtgtgtcccaccccaggctcagctctgccaagggccaaggaccacggctgagaagaaatggcatggaattaaggagctgtagcagactgacccctgaaactggtctgtcctgaagctggtcggccttggttctgtgagctcatcttgccctgtctggctcacttatctaatgcctcttctctagagggaccagagtctagtgacctggaaccagactattgtggtgcagttcttgtgccagctcagaaactaactagctgttactcaacccctctgcctgtcagtttttccatctgtgaaatgggaattttgcctcccagggctgctggacaggttagaggctgatgcacaagaatcctttggcccagggcctgggtgtgccttacctgctccagatcccccctccctgctgctctctgcctgaggcccagggtaaagcctgatccagaatttaccatcccgggacccccagaagccaccgtctgctgtttggggttggattttgcacctcccaccaagccctgggtctgtctgttcagcacctgcttcccatgccccatatctcattggctctggcctcttgtgtccacctgaagacccctacagttactgttggccacctcccccatgcaccagctcctgtgctccagccctgttctctgaggaggatgagcccaggctggcctccaaggcctccgtgcccctccagaagggagctgtggaggccccagtgccattccccacacccacacctgagtttcactccagccaaggccctcacactgctttcctgataatggttgggggagtgagctgatgggcaaaaagaggctccatttctctctgggaccaatttgtgagttttcagcagcagctctcactctcagtttctgcctcatccctgcatgcctgctgcctcccgccccctccatgcatactggctgttaggattctggaggaggccgaagaggtgggaatcaccctctgctgggaagccagcatggaaagcaagtgcccatctggaggtggagagtgggcatggcggggcagcctccagagggctgggagggccagagagagggcaagtcctgtgggtggacacggatgccgaaatctcctcctctgccatcctttgcttttgaaaagaggcaataaagcctagtggttaggagcatggcttggagttagatgaaacagggtttgaagcacagctctggccctgctagctgatgacaggatggtggagaggccaaccaagtaggctccgcagaggttcagatcccagctcctctgccacctaccagctgcatttgacctcagacacacaagctccatgtgccttactccatgtccttactacagatctgggggatgatcttgttagcacatgatcattctcaaatactactgaaggatgattatgatggtctgcgtgacctttaacactgcttaacctctgaacgatatctcgattcacagggttccatgaggatcgggtgagatgctgcacacacagccctcagagatagcggggtacgtaaagagctcttgataaatggcagctagtgctatttttattaccatatttcattgatttcaaatcacacttttttttttcacattttaacatccctgaaattgagatgggtcttgcagtagatgataagaaagcactgtgtcatagtataatgggtggcattttttttctttcttagggaagtacataaaattatgtatattactgtcgatgtgtcttagattttatgaaatcaaagcagaccaaggcaggagaaggagtttccactgaggacctggccctgctttgtcctgagggtgtctcacctgccctgctcctattgtaggacaaatccctcgggtcacctggggtccagtggctccttccctcccacctctctcctttccccaggagtgagctctcaatgttctcccagacaggaatgctgggagcccttagagaggcatttgttttgcttttatgctgctcatcagggccccacagaggggtaggcccctatgaccacagcaccaggctgagaggtgggtgttgggcagagtgcacactgggatccagttcctgtcgtgccactaagagggtgcacagtggctttgcaccagtgacctccagagctacgggaaaatgggacacagagctgagtgggtggacatcagtcccagaggttcaggctcagcagtgagagaggccaccctgaactctgggtgcctcgtggttcctgaggaaggaggagaacaatgagaaccccaggaaagccacaatgtaggggaggtcaggcggtgggttctgccctgtggcaggtaccacccgcccccttaagcagcatccccaagctcctggaagttctgctgctgcctcagctgcttcaactccctccctggggaaccccctccctgaactccccatgagccagcatctaaatggttaatgcctggccatacagggggctttactggctgccacccttcccctcaggactcgtggttacatatgcagaatatcacccttcactcccccaaggtgatccagatgtttaccaggaatcactgggattggtccccaagacagggggccatgcgcttatttatcaaggaagaaaaccttcctatgttgagtatccactctatgcctgtgcttggacttcacgtagactttctccctgaatcctcaaaatatccaagaggaggatgaggaaacaggttccgggaggtgcggctgcttgctcagggctcagatctgtctgctgcgactcccttctctcacagctccctccactccctaaacccctgagcagggatccagcctctcctgcaacccagaatccaacaataaaagcaatgatcaaaggcaaaggcaggagatggcccttgtctggagcctggggtaaagggaggctgtattgcagggttgcagcctgggagcccacaccaggctggccagcggcacccccagtgctcacccttggtctgcaaagccattaaatatgcagaatctcatcttgttcctgggaagccgagggctctgagtcacaggaggtgacattgctctccaacaggtaagttgttcaacagatgggcagtcgagtggcaaagaaatacattattaatgtttctggttaaattaactgattaaaaccaccctaggtaaaaatgtacgtatcagcgctttgcccacagcaaatgaggaattaatggaatatggctgtgtctttgtaatgaaacacagaggctctctggaaaggttcgctctcttcagaggcagcagcagggggtagaggggtgggaggcctaatccatctgttaaagggacctctactgattggaacagggaaagggcagggaagagacacccaagggggcatccccaggtctgactggagaccctagaaatctgacattttgacccctaatttgctggagccaaattttgcagtgggggcttaaggcagaagcagcaggccacaaatggggtgggtgggtgaggtggacaccactgcatgggaatgaggatcatggaatgctggccctagctctatccttgcagactttatgcaagctgacttcctggcagggcctcagtttcctcactagtaaattggagaggtgaatgaaacactcttccgtgctctctcccaactccttgtctcacatcataggcttctaggataaatcctagtgtttaccctgtccttattctcatcccataacctagtgagaagctgaaccccatcgggggtgtatccagagatcacctccattgcatggcttttgggaaacacctgttctaactcaagtcccaaaggcactctcctatgtgtctatctggttggctgtaaacacatgcatgtacacacacatgcactggctgacccacacatgcacacacctgcattcaagggcccacacatacaagcaagcttgcaccaagacacatacatcccagagctctacacatgagtgcacacatgtgtacacacagctgcatagaaagtgaagtcctgttgtgcaagggcaggaggatgtcagacacatttcagagacagcggtggggctaaggggcagggagggcactgccagggcagaggatcaagggccagttttttaatccacaaaatcggttttgtgccagggtttcaggaactcccagaggctatgacccaattcgagcaagactgaagttttgcataaattaaccaggtaatcgcatttccactagggtttcccttgatgcagagccctggagtggctggagtcccacaaccccagtcatggcttcatcgggtgcaactggacgaaagcagggcctggtgctgtgcaattttggcatcctccgccccgcctccctagtgatgcgttgggagctctccaaggtgctgatggctgagggtagggagagattagctaagagaagttgtttttctccgctgcttacaggctggctgtggagaggggagggggagtgggttgggtgctgagcccctatcacacacacagtcgctgttgctgctgggtacccggttgggggagtaggagggaggcacagccagagcctcctaatgcctcccagcctgtgaggagggccacgaaggggtcagcgctggccttgcagtatcattagctgtttaccctgggaaagttcacacttccagaggccgtgctcaagctgtcagaaacactgcacggcagtgctggcagctctgccaactgtgctccccagggcccagcaaagcaaatatttagcaaacgcctggctcttgagcacacgtgcacacaccttctcgcaggggacacagcatgccaacacatggatacaaacatctgcacagacttactctcaacacccacagagacccagacacacacagacatgcacacgaaaacccacactctcaggataatggaatcatgtgatatgtatcaggcatctactatgtgaaaggcagtatttacaaatggtgaatatgcattattaaatctaatgctcctgacaacccaaaatggtagacagtatcatgcacccattattcagaggataacaaatgaagctccagcaggaagattccacagctagagctcttaccattcactaccctgacatacattcacccacccaaaggcagtacacttagatacacactcacaaacatggacatgctagcacacagaggcaaacttgaactcacacatgtgaatattcacagaaacataccggaatacacacatgtgcagacacacacggcacacacacattgcacaaccaaacccacaacagcatactccgtgcacatccctcctggcagaagtactctgtcccagcccccaggggcctagatacaatgccccagtgagccagttcgtgccctcggagcctttcccctgaaagctgcccagcttctggtcaggccgcctggttgatgttgataacagcattggcagccaccaggagagagtgagctttgatcaggagcaagtccagatggtggcggtaagccccagatgttgtgtagaaacagacaagcctgctgaaaccaagaacttgtctctggcctggccttgcagtgtggccctcccagggcctggggctctgctggtagtgcagccagtgtggccactgccacaggccgagcatggcacaagagcctggcaacagaaaaagaaagctcagctctgaggtccagatttctccagagctctgagcagcaaaaggccatttggaatgtctgggtccctgcatccttggggaggcaagggtgctcagtgctggtgtagtgggagcgtggctaaggaaccttgaacattaccaattatcttggtccccactggcctggtccacttggggacctgggcctgacctgtaggccccaagcctgagtgctcttccctgaaagtcatcactcactaattcaccagatttctactcactgatttccaaggttgatgctctagatcaacgcctcactaattttcaaggtcattgttcactaactcccaaggtcactgcatgatgattttggtagtcattggccagtggtcatcaggaccattttcttatgatccctgagatcacagtgattcctcagtccagtcccaagaattcttagggccctgcttctactttaggaaggctcggccctaccctttgccccctgccctaactgtttgtggtcctgacaaaaagttaggcactccctgagcagtggttagcaccacaaagcaggtgggagggcagacaggggaaaggcaattggggaggtgaagtccaaggcttcaggtgagcttcacagttcatgaacaatgcatgtacttgaggttcctccctcctttcctctcccttcatcccctctacgccccactttttttttttttgagatggagtctcaccctgtcacccaggctggagtgcaacagtatgatctcggctcactgccacctctgcctcccgggttcaagcgattcttctgcctcagcctcctaagtagctgggactacaggcacacaccactatgcctggctaatttttgtatttttagtagagatgggctttcaccgtattggccaggctggtcttgaactcctgacctcgtgatctgtccgccttggcctcccaaagtgctgggattacaggtgtgagccaccgtgcccggccctactccccactttttaagcaggatctcccaggactgttgaaaaggaatctgctattgtctccagcaccaggaccagaaccatcctacctcttaggcaacccacgttcttataaccactcccactttttgatctcaagaaaagatattattagctcaacctctgatcaggtaagtaagtgagtctgtagagttctcctggggaatttgcatgaaaagaagtaacatgccaaagaagtgaccctctaatactagaatttcagacgtcatagagctacacggtgaagctcttttctaaagttgaacagacacatttcccttccccaggtactgcctgaattgctaagcaaggaaaacatacacaaataaagtgtcatgtcctgacatttgataatttaaattgagcgtcaaagagcatctgcttaattacacatggagctaagtgtgaacactaagagggaggctccaggggagacagagaccctcgttcaagagctctaacagtcatgcagcccagggtgtgcagacagtaagatttgtcttctgaggttaaaataaagcccacgtttcatttttgatgcaacctaattcttctcgttttctccatctacctccagaagctggggccttaagtggaaaagatgcattgaatagcaaatgcaattcaacaaatattatgacatgctgttcaccacgagccctaaatatttaactgttcgactttatgggcttttcattttgttttattttcttttttgccggatgtgatgaatttagcactaacaggccccgtgtcaaggaactgccagtgtcctagtttgcaaaatgaacaaagtgaatttcgttcaggtgtttgtgacctccgttcattcaggccacactccatgtcgccttatcttggctctgcccagctggctttctagaaaaaaatataaaagtaagatagagggaaaaaagagggaaaagggaggcaagaacgaagagggtcaaaaagcctctgtcggccaattcatttctgtttaatccatctccgcgctgcagaaagctcctttgtggtggaggagaccaaaggtcggtaatagatttcaacaggttccgagaggctgttgactgcttggagctgagtgggagagtgtgaggctccccgagaggcagggggagagataattggagacccggagccccggcttgccctgtggttcctgatttcacggatttaagaagaaaaaaagattgtctagaattccgcctccggaattgtgtatgagagggaaggagagcagaggtggggggtaccaggccttgactggccctccctggagctgccgtcacgtgaccacttgtcctgctcaaagagagtgggctgggagggaggttaggaagcctctgagccaggcctgttggctgtgaactgcctctggagagctgggaaggcccttgggtcatctctgaggctcctttgaggtagccactaacttggaaatggggtgaggaagggaagaggtgagtggaggcagggactggagaggtagacactgaattaaatttaccagctctattctgcaaaatctctctgagtgtgcgaggtagctgtagcaagaaaaggaactcctatagctgtgctttagcccacagctacctccaccccagatttccaggcctgaggatgccatattaccactttcacctttcatcgtggctgcccaggtgaacaaaggatggtgtgacctggtataccagattgtctgaatcaaagtggcaatggcaagtgtttggggtgggggtggaaattatgatgtccttagctttggagttattccctgccatgcaaaaccactgtctgacaacgcagtgtttagaacagcattctgcttgcatgcatgtaggttcagcttaatggtatgtcattccaacagtaggctgagccaggcctggcaataaagggccaaatggccacaccttgccttgcaaccctccctggtttcccacaatccaagaatccagcctagacttcagcgtggcaaaagaaaaaaaaatccccccaaacttcttcagcctcattcttttgtattctctgctttggtcatattaggcccctctttgtccccaattatgcagtaggaaaatgctcagatggaggtaagatcaggatgttctcaaggaaggagaactaggggcatcttagtcagccttggggtacaggtgtcaaggaacatgtcctggaggagatagcacctgtgctgaaccctaaagaatgggtaatatacataatgagaatgactcatgtttattgaacatttattatgttacttgaatcccttgaccttgtggaatcataaaatctttcctatgggataggtacagttattcttagtttcgatttacagatgaggaaactgagtcatagaggggtgaagaaacctgcccaaggtcacctagcttgtaagggatgaagctgggcttcagagtcaggcattacaacatccaagaccacactctaaccactctgctaaaccccattcagctttgagcctttgaagatggagactgtatctccatcttcgaaggtgctcattgtgagcaccaggagtataggagtgaatctatactccagcagagaggcatctgtgaacattgtagaataaatgggtgaaggtactgatggatgcatgaataaatttagatatattttagatatattttcaaccccaatagatcctggggttaacaagcacataagattatagtacattggtaaaaatcaaatgtgctatttatcccagaacagtaattcccaaaccacattccataggacatgaatttctggaaatctcaggcacaaagggtgtccatcatcatgtgggtttgagaaaccctgggttaaacaaaactaaatagctttctttatttcagggattttctagtttttttcctcagtgaatatctcctggggccagagacccagcaaataaagtctgggaagcaccatattcgagtccctgcctttggaatttcagggatggtgtattagctatttattgttgtgtaacaaattgttccaaaacttggtgacctaaaacaacaataaacattatctcacaaagtttcttcatacaattagaaattcagaagcaacttcgttggatggttctggcttaaggtcttgcaggagctgcagtcaagatgtcagcctaggctgcaggcttttgaaagcttggctggagctggagcaaccacttccaggatggctaactcatgtggctggcacagtggcgctcgctgctggcaggaggcctccattcctgacagtccatagagttgtttaagtgtcttcatgacatgcttcccaagaatgagtgatctaggagagcaaggtggaggtggcaatgtcttttatgacctggcattaggcgtcacagcctgtcagtcccattatattttattggtcacacaggatgaccctaatacaatgtggaagaggaattataaggacacgaataccagggggaaggatcaatgtgggccttcttggaggctggcttttgagattggccttctggtttcagcttctggaacttggtgataggtgtgtgcaccctcttcagacctgcaggtgcacacaaacttcatgttgaatgacctcagccaccatatttccccagtggtgatttggtctttatactctgttctcatcagctgcctctcttgacctcttcaatcccttgaccttgtggaatcataaatcctaagtgtcagagctggaaaccacccagcccaaactctaattttatagatgagaaaatggaggccaatacaggcaaaggaattgtccagcatcaccatgccttagttcttgtgctctggtccatcacacatgcctgatgagacatgaatgtaagtctactagcctgaaattccacatggggcattacatccctacccaaagccttgaactgtccacaggcctgaccacaatgggccaaggtaggtggacaccaggccagggatggtgtgagtggtgcctttggagtggggtatgggggaaatattacggaatgggctccttatagccccatttggaatagtaccatttccctgagtgactttgtcaccactatccaagggaacaataggaacgaggagttgtctccctcaaaacctgtatcttgagagctacccttatctgccagcatgagctcagccaacgaaacaggcagtggaactagctacgcttttaggtaggaaagctgagtgtatgctcctgagatacctgctgaccctatatctctggcatagcttggaggtgcacagcatagtctcagggaccatgttcttctaggtgcggggcctgcctttctggtcaccattgcagcagctgatggagtcaagctcagcagagtctccccttcactcagtcggttggaactagaaagtatttatcacaagtcttcataccagcaagttctttctctgtaaagtaaatttgtcaaactactatgggagacctgagatgactcttaataaaagcaggataaacagggaaattcaataaggaacatgactgaatagaagtagaaacatctgcctgcccttcctactgacatcagctccctctcggcccagcctcccctggagagaggcacaaatgggtcctcatcactccaggtctcagcctaaaccctgcctcctcaaagagccttctctgatcactttttctgaggtttcatcactctgttatttattcttcattgtgaatcctgtttgtttccctcctcatccttaacacattttgtaattatacatgtatttatttacttgtttgttgtctatatcccctaaaagactgcaagtttcatgaggatatggacaatgactgttttatttccccagtctgtattgagcgcccagcacaatgctggcattcaataaatgattgttctcgcctcagtagaagagtgtttttctttgccatatgcctgagagtggagacatctggaggagagtccatcttcctaatttggcatcaggactagatgagagcttctccaacccactcccacagagcggcgtgtgcagccccttctgtctgggtctcaatgctgtgtctctggcatctggcgaggagttctgtctgctccccagctgcctggttggggctgactttgtgacccctctcttgtcagcctctgtttctccagaggaaattgtccatcacatttttctccttgctgatcctggctggatcttccagaggacccagctctgcatcaactctttagccaagccattccgtcctcctcatcctgtcctgccccctatctgacctgaagctcactgtgacggcctggattcattaccctctccccttcctggataaacttgttctattgttgtggcttccttgaggggcaacatcccacagatctgctggcctctccgcttgtttctccttccttctctagggcaaggctgtgaattccgatgttgacaatttcctgctgattgaccgtaactccaatttgactgatcttagtcatcatatgacttcattcgatgcttgttttaattcttatcatgctgtagagcttccaggtgtagaaagctggcccttggttttggttagtgcccaatcgtagaaacctggtgaatgccactcccaagcatgcgacagccacagtccactctggccccgtgggacttggatgtgccacagtcccctcttgtaccagagtaggaggtgtaggaaacaccgagcacttccaaggtcatccttcgtttctttgttcattgctaccagggacactggaagttctgcatccttccccttccgggttcagaagtgaaagaccacagaggcaacactcccagggccttccatttccaatgaagggtccgcagccaagatgaccacttttacagccagtggcacatcttctattaagaagcttcttggctaaaataagattgctattactttccaaactgccacttggaatctgtccactctacctcctaaattaacttgattttcttcttctttcattctctacatttttgaagaggatagagaggcagttacacctggttgctgtcacaagtgtatctacagtcagttcacccctggaaacaccctgaggctaggtactgcatctatttgcttgctgtagtatctccagcccagggcctggcacataaatctatttcaaatgcacgtactggaataatggagggaggaagaggtcatggagaaccccaaatcactgctaacgctaataaccaaaacatgccgaataacagatttaatgtgaactgattctgttacaattgcccaatatgtagaaccacgtttaccattcattctgcagtctgttacattgtctgtttctatctgagctatcttttttttgtgaatagagaacaaagcctacactaaagcggcttgtcactgagcaagctgaactctctgctttctaaacagtctggcaggctacacgggccaggtgactacgcccagcagcttcagagccttgattctgtgccccccacccctgccattccccacctctctgccaagtgacttcactttgctcaaggtgtcaaacctcagttcacacgcattacagcaaagtcactcgtgaaggtgttttcatcaaggtgctcaccactccatgtgctgcctgaaccgactgctgatggggagggatgttttcatgcagccagagacatgaagtaaacctaatggtaactatgtagtttcaaacagttggcatctttttaaataaagatgttatctctgattggtaatcaatttgatttccccctccaccatcacatctgcttttcctattattttccttagaattatttgttttcctgtggtttacctgccagcctgttaatccactcaccgacaactgagtgactaggtcataatcaaaggtacactatctctagttgctttggttggcttgaggcagcggaagacattcatgtgtcttacacacttttttccaacattacttccaagttcaaggacagcagcaaggtatgatagaaggcacacaaggctgaaagtcagatgctgctgtgtgacggaggtcatgtcccttctctatttcttcagctgggtagaccaggtaagtcctgggtgtgtggcaggaacctcactgccctctcttcgaccttctgcttttccccagaggaaggagaacttccacttgagcatctcgccccccaccacctcatctttatgccccactgtgggataaggaattgtgaatttgcatggtcagagaccactggaccacacttacagtgggcagggatactgtgtcttagagaccagggcctgagcagtaaggtcacaaggggctgccctctactctctcttccaatgtctcttctgtctgagggtgagtgagtaggtgggacaagtcttccctgaggtcctggtagcattggatggcacagggtggtaaggacacaaggctcttccactctggattttctgggtgagagtctgtatccagtctgtacagctgacccgatctcctgggcctccctccctctggctggcatgcagcccagacagatgcccagacctttctgcctgcctactctcctgtgtgcagactcccatgacattgctctctcttcctggtcaccaagcacttttctgaatctcatattccttatgctaaacccgcagttccttctgccctagtcatggtgatcttgtttcatttccttaaacaaagaactcttcaccagctcaggggtccacaaggctgtcccctctggtgggatgctgtctcatccactcttctcagccaactcttatctctcaggtctcaactcaaatgtcacatcttcagataagcctttcccgacctcccagtcctcagtattttccttcatgactcttattacaaatagtaattagatgtgaaaactgcaaagcagagagatctctcccagtgccacgttgctggggcctcgcttatccctgtactaaggtgcacacacctgccagacacaatggaaacacatttaatgtgggaagatggagcaggggagttcagcatacatcacccagcaagatcatgctaaatatctctttgacatctctttccccaaagttccaatcccaaggcaactgccagttctcttctcttctctttcatctctttagcctccctcctggctcccctctctggcacctatgtctacttttcttctccatatctggcacctttccttccaggccttgatttccacttccctgttgtatttggagtaatttagctctttcttagttcttccaatcccttcctccccattgcccaccagccaatcaaaggatgtaaaaggagtaggagagtagttaataactctattctgttacatgcacttaggtatacttgttcagcaactgttgcccctaccatttgtaagtttcatgacactcacatgacctcatgaatgttttattcaccactgtacacccagcacccagcacggtgcctgacacatagtaggggttcaataaatattggcggaataaatgcatatcatggttctctaaggcaactcattttttaatttcaatttaaacatctgggtccctggatatgcaatcctgggtacccatatacccaggtagaaggtcaccatagactgtgaacacattgcctgaccttcttaatatccaaatacatgcattagcatccagaattctccaccacatttggattaccattgtcctattcaggccgggagtcctctgaatctgggataactggggtcctatgaccgctctgtatctggggaaagcagccttcccttctcctcccctcccccatctcttctccccaccctgcccccgcacccagcaaagatgagaatgactgacacaagcattagagatatggaaacttccctcctgaatgatctcactaatggtaaattgatgggattgaatacattcaagtcggaaatgatccaaatatatgctaatgaagctgaatatgcattatttagactaaaacaaactaactgcgagtcaggaaataaagtaggtgaattattagtttggcaactcaaagaatcggaaaactcaagcaccattccagagacaggcagaggcaggcaggaaaatgtggttaatggattctaaaccaattaatcgcaaattgatggtgcgcttgaagacttgccgccccgactccctcagattgctttctgaaattttgaaaagaagatgctgttgccatgcacttttcttgtcttcccttcttaaacatgctgtcctagatactcaagtctcagggaaaacagaaaactacaaacaaatcccagaaacagggaatggggctattttggccacagggggagataaataacgcaaagaggaacttcccaccccttctttgtcaaagagcatcatcctcagactgaagagtaaagtgagccttgatgggaggaaactgaagcctgagatgggtgaagaaaatacaaaaatatgctttgctggtccaagctagaatcatccccccatcctggaggaatcccaacccagggcaaatcaggggatggcaagggggctcactaatgggtttcatgaggtggaagagtcactaggaagagatggaaaacaagatggcacggttttccaaagatggagtctagaaatcccaaagcatttgatgataaccaaagaaaattctcaggttcaattcttgaaaggttatagtttgcaagatcttaggaaagcagggagtgatgagttagagccagtatgagtttgccagaagccagatatttgctgaaagggcacctcggctgatgaatgctttcctgatcttgctacataaaatagcactgtctgtcctgcccctgacccaccccattcccattctccagctttatttactccccggctttattaaagcagttaacaccatccagcactcacacacgtacttgtttattttcttctcctcccacggggatgtaagcttcatgaggtcagggactttgtctattccatcctctgccaagtgagtctggcatgctaggggctgttaagtgaatgtgcgaacaaatggaatgtcagactttaacctcatttttttttttctgatggaacattgggatgagaaggtgaggtaaattcagtagatctgggattttataagagaatttaactatctcatgatgttattgtagaaaagatgaagaattgggagctggatacaacaacaggtgcggggggtaggatccccgccacccacagagtgaatgatcacagccgggtggtcaatggacacgcagtggaggatatcgggctgtcctctccaccagttttcatgttggcttagctgaagattcagaagacagggcccttcaaattgtagtgtgtgacacagccagaaggatggcactgtggagcaggatggaagaccctcagcgagcaggaacaatgggctaactctgaaaagatgagctgtccctggagtaaactgaagtcctatccttggagcacagagtgggatggggagacacagcatggtgccacgccctcgagtgaacaacaagcccggtgtgaatcagcttcctagatggctaaggacagccaccacgttcatggaagtgggaaagttgagaagggagaaggcaatctcttgttgtactctgcatgcaaggatggaactggactcagttctgcagtctaaaatttgatgatggaagctataatcagcctgtgagctatttctcattacaggatgactatctaagacatcacagattttcagcctgagtttattgtgattcagtgaaacagaaatttcggtggagagaaacaaccccagagataaagtcccgtgcctcacatgcctaaatgattacgggcagggagcagcggtggagcagaggtgactaaggtttagttcctgcccttgtggaattgacaatctagttgaggaaataagtaagactcaaaagaaaaaaaaagaaaataaacgaactctttggaaacagccattccaattgcgattgcttcaggtttataatgaacaatcaagtgtcccatcaattcgtaatagtacagggaccactacatccatgaattaagccagttggaggaaactacccttatgtagtcaacctggagggctctcacataactaatggccaaactgcatggagtggtctctgctggacagctcagccttctgctaacctaatctgctagtgtacatgccaagcctttatacattcttttggttaatcaataagcattcccttaaagatatactaggtgtccagccctgtgtcctgtgttaggaacaaacccatgcataagacctagtccatgcccttcaggcactcatggactggtaagagagaaagacacatgcaatttcagtgcaatctgcacctgcagaaaaggcagcatggagatcaagggcaagtgctgaggctgaagggcaggggcaggaagtggtggatggcctccctaaagtaggaaatgatggcaccataccctgggtccactgcaggtgactccaacccagaccaggcagagagagaggatggaggaggtaggacccgttccaggtcaggcaatggaggtacattcccataaaaagcatgagggtgctttcagcagaatccagcacctctgaaacccaaagttgaatgaccacatagcaggggtttgcaatgattaaacagtaaaaccttgacctgctactgccggggagggaaccagtagtgtcagtcagaaatgccgtgatgttgcatctctgttgttcattggagaaatgtgttttcagcctggactgactctaaaagatctccctgctgaaaggccaggagatgaaaagcccccacttatgtcagtcacaacccagagtgacttttcccagctcaaaccatcccccagcagcagtgtttgtgtcaccccccagccccacctcttttaggacagtgactctcatcctcccactctcaacctgtgttctgaatgggagctgctcttcttgtacctgagcccaactccctgaccacagtgactgttggggggttgacagctgacccaagattagccaatggagtcctttcaaacaagagaggggagggagaagacattttctctcttgacataaaactacaacaaatgaaagcctggagctcccagaggctatgattctggcctcgtggggaagccaacttgagaggctgaagatgattcaccgggaaaagcagaggacacatgagccagcacaagacggaaagagagagagagagttttgagtctcgtctctttgagtccttggctctggctgtccctaaggctaagccaacactgcccttcccgcatttggctgtatgagtcagtaaatatcactactgacacatcagctacttgatacgaggcttctcttactggcaatcaaagcctaatatccttccaccacacaacgcatggaagtgaaacatgaaaagctgatcatgtgcccccagagggagcggggcggagaggtgcagcccccaaggggagtagcaacatcagaacagcagcctttctcctgcagggtgctgcaagggtgctggaggaagaaactctctcaaacaaagcaacagagaaagaccctggacttggctttgcatactcacaagcaaagaacaaaccccttctgcaaatagtaaggagagctacgttgacacaagctggcaccagccatccccgcttagaagaggtgggactagaactgcatgcagaaggcagacgggagcctcctaggagggatcatttaggaagaagagcaaatgagatggcacaacacagcatgtgaggccagggctgtcatcagcccctaaggaagaaaaagcagaaatgtgtattacaaggataatgctttttgatttaactggtagaaaactacaaagagtatttaatcattgtcaataatcctgttgtcaacttcataaagttttaagttgtggaagcccctccaaacaccactccaaacctcccttaataattgtaaccaagatagtgtgcccaagtctgaatgttgctatttctcagagaatgtgggtagaaggattccacgtgaatcagagggggacccttgttcaggaagggctgccagaggaggcctggtccactaccactaccgttgtccctgggccctcctgacacagtcatctctatcatacctgaaaagtgtctgcaaatgaggtccctcggtgatccctcaaatccacatcccatttatcaaggatctactggtcctaggcactattctcggagctgggtacacagctgtgaataagacaacacagtccctctgtcctcagggacttccatgacaggtgggaacacaagcaataagcaaggaaaataaaggagcgaggcaattacagaatgtaataattatacaagatactgtgacgctcagcatctcatggagaggaaatggaggcccagagatgggacaggacttgcccgagcagaagcagcccaacccccaactggtacaacccaactgtgtctccacctccgtcctgtggccctggtagccccacagaggccctatggctctatccagagaggtccagtgctcttttgggcaacttctggaaggatactctatctgcctttgtctctattgcatctgatacatgatcagagtaatcatatgtcttgctgtcttagggacagtcctagttgatacctgttcttagaagtaattactaatacaacccactttcatttacccactttaccccagatttggatggtaaatattcatgggggacctgggtctctggagcatcttgatgccagaatgaagtgtttggtatattcttgagatattgcataacactacgagtcttgctgcattgtgcctcagaaaaccttggggcctgcctcccggggcactgcccagcatctgaggggcctggcagaggagaaggtatccccttacatgcttctccctggctgatcccacttctgataccctaagctgtggctctgccttgctagttaatcttcgccccttgcaaaggatttctcctgaaaacagagctcacactcatggcactagaagcttctggagagaatcagccacatccccagcacaagggagcaccactgtttgctgacttggagaggacacacaacattcttcagggaaatatatctcagggaggagcctgtggttcccaatcagacccaaacacacatgtattttaaatgtccacctcccttcccaagaaaatgtgatgatgtttgccatgtgtattgggttcctggcctattagaccccctgacctcctgagtttctgcccccgtaagtggtttcttgggtctcagtctcctgggctagaagcccttctctatcccaaaaatgacaagtatggtgcaggtgcaggtctcccatgatagaatgatttcagatcaggatggactctcatgacccagtctctgtgaccaaaaatccaggcagcctggcaagatgatccctgagccaggacacagcctgcatctacctgtgcatgcccactccaagcgccagacacacagctgggcagcagcaggcagcctcttcatgcaaattaaataaaacaacctttttatctgttggctgattccctcttttgaagaaatcaactacaaattcatttttcgggagaagcaattacgatgattgatggaatgtcagggaaagggaatcaaacagaagcccagaggcccgggctgggggtggcttcacgggacaggagagtggggacagctgcctttggctcccatgctggctggctctctctttctctccatcttcagtggggtggagggggggagtgctgtataaaggcgcccctcccaccgtggctatggtctactttgacactgtgagaggcagtcagaaaagacacagtaagaggtgtggcttgtattcaatagaccacaagcacctgctgtgctgggcgctttctaggcattatctccttttgtcttcacaactgccctgcaaaatcaagcttattttacccatttcacagatggagaaactgagatgcatccattgatttgctcaagatcatgcagcttttaaaggggagcagaattatgacctaatcttcattccactgcaatataagcccttccaaggaaagcgagttcaagctcagaatcctggagactaggtagcctatccccccctcaccctgcctgtttccaccttgcagatgcaggaatagaggctaactgcaggccatggcactatcgttagagaaattcatctgtttattcaatgaataataatctacagggccaagcactctttgaggatgcaggagctccaagttcagtccaggcttccacttgccagcctggggttgggagacctggagggcaggaaaatcccatggacttgacacaggaccccactggaagccgaactccacggcactacctgcagttgcagcagcacacattgaattctccgtcgagcaggtctctgtgctggtgatgatgctggcgctgccaccgcggggtgactcacatgagtcctgtggtgccagtccagagccaggagcccctggcacttaggaaagggccgagctgatagcagcgtctgccagcttgtcagttctgcggaaacccttcacagagatgggtctgggcttggacttcaaaggctcctctggtaaagacctgctaattgcttgaaacacgttttcagtgaagtgtgaatactctctctccaaacctcccgtgaattccaggagagctcaagctagaaggagctagggaggctgttcccttgcctgcagctggaggggaactgggaagtcaagggccaaaccccacctccaccctttgaccgcaggtggaggtcaaactccacctcatcacttgactggaggggaactgggaagtcaagggccaaaccccacccccaacccttgcctacagctggaggagaactgggaagtcaggggccaaaacccacccccatgccttgcctgtagctggaggggaactaggaagtcaggggccaaaccccgcccccatggttccacctcccagtggctcctgggcactaaccatcccaggagaactgaggtgaagctggcagcccagggaactgctaaccctggggaagtgggggaccactctcctgatagggcagctcagtggactgagggtttggggctcattgcagactccccccaccttcagattacaaggctatgcaaaacaataacaactacatgaagctatgtggcaggtgctgttctaagtgttgtacccactacacattcccactcaccagcatccctcctgcaccccatgacataaggatgactatggtgtccctttttagagctaaggacactgaggcatgaggagtttaagtaacttgcccatggtcacattcatctaaacagaggagactggactagacctagacacctggtagcctctgcacagggtgcaggagatgagggtggttgttgggggttgggggggctggggcagcacataaaacatgaaaagaagcatgtggctgcaactcctcctccctcccccatcccaggtccctggctgaggggtcaagcaaggcagagaaactgagaccaaggagagaaggaaggcattgaagccacatagatctgggaacaaatattaccagccaggtgactagaagatgtaaagtagccttcctctgactccatttccacctctacacaatggaaattacaataccgaccagcaaggttattttcaggagctgagctaatcaggcactagcatgaccctgagagcaatgtctccttaaatattgtgcctgaggcatctcattagtctctccctagtcctggacctggagataattatatgttaagatccgaaccagaaaactcctgacaaaagtagacaataaatgagcaaataaataaaagaaaatgaacgaatagtagcagaattaatgatagccagctatcactcattcattaatttatggtctactcttatcctgtgggcacagcagtcactgggctctaggatgagcaaggcacatgtgcttgctctcccagcttactctctagggagaagccctgggaagccagggagacccatctctgccccgtgctgcccaaccatgagctggtctgctgcaagcattggcctcacactgtttttcctggtcctgcaggtacctgccaggtatctccatatgggtgagagcttcattccagacagggactttagcttggcagaaagatgcccctggcccttggtagcttcttaccaagctcttgaccagctcaggacatggcatctcacacagggcatctgaggaaacctgaagctgtcactcagccttccacctgggatacatacagctcaaactgagtgctcctcaaaaggctgcaacctgtcttataaatcctattccccaaaaggaggaggggaaatgaaaaaggggtggagggaggagaggagagaggagaacaactttcccagggcttcctctgctagtaaagaaatagctagaaggtgttttgttgctagcagagcaagccttgggaaagtgggatgaacttggttgaagaacgttgtgccctggagataaatatcagagatggcacagggaatcccctcaggccgaaggggctgcaggcttcccactcatttctgtagtcccccaagtgttggaatttgagaggaagcaggaaattgagagttgcaagataccagagaagaggggagggaagaagaaaagaggagggaggaagagagggaagagagtgttctcagttctctggactaaagccacaagagaggccagagccagatcagaagggaagagaaatggggccttggagacttggggtaagggttgctggagttttccatttcttgcagtctcccctcatattgcacctcagtcctccaccgcacccccttccctgtgatctcccaaggccactgagtgtggtggttaggggtttgtgctttggggtcagagagatgtgggtctatgtcaatttcctcatctttaaaatgggagaacaaccaccttgacgtctcaaggctgctggtattttcagcgaggtaatgtctgcagagctctcagtccacacctggcagaggacacaggaagagtctagcgaacagtggcttgtgccatctttatattatggtctctagcagtggctgagctgaccctggtgccctctcagaagggccagctgctgagcctggtggtagcaaggcaagacctagagaggctgccccagccatgctggcctgtgggcagcaggtgtgcccagctggctccacccctggccgtcggccacactgttcattaagcaaatggcccacagtggccaatgatcactggagcacaagggcggacgcctttctcaagcaggcctcatcaaaggccggtgtcgagctaatttaatgatctaagtggaacatatttctcctgatgaggcagtttcaattgacttgtattgtctccagataaacagtggaatcacagcaactagtttctggacaaagcaccagtttagggtagaagaagcagtggagtggaggttgtggggagtgaagtgagactgggcagctagagggggcctgagccagtctcaaagaccaggcctggggcctctgcctggtcagggatgggctctcaggcctctgggtttcggccagggaatggaaaaacccaagtgtcaatcataggctttcagacctggcagagacttgcgacgtcatttagactgatcctgcaacatcgtttagactgatccttcctgccaacagatggaaagacaccggagatgtacaagagaatacagatagctcagagtgtctctcaatttagaggcacaatctgagcctcctgactcaggtaggaaaaggtaaccaatattctccagcacctggaggcttcaaaggttcttttggtgtgtgtaatttcatatgatcagcacgctgtccctgagaggatagaattgctagtcttacttcagaattgaggaaacagaagctcagagagattacgtgactttcccaaggtcacacagctgatgaatggggactctggatgttctgctcttcctaccacctatgctggacagggaagtgtctttcattcccatggatccctgcagatgaagccctgttgtgctccaagggggacctacgttctggagcatcctgatttccctaggatgtcaaactcctggccccctcggaaatctctgtccaaggtgaagagccaggggacacccatgagaatgactgacagaaagtgagagagaaggcagaactgcaagaggcagcccgaggatatgcagccaggataggggccaggcctgtgatcagtgcaaagccaggtgcctgaagttcctccattaaagttgaggcccaggccaggggacaggagagcgatgggtatccagagcctcctgggcaagccctgacacctggagcctggggctggaggcaggactgcaccaggacagagcagatgggacacctgggacaccggcccttggtctatgtgagcacaggtcgtgcagtgcagactggggtcctggcctttgggcaacccagggttcctggctccagcaggagtctgcaagtgaccactggaccttccacagggacacggagcattcagtggctgcttcaggctgcaggaaggatgctccaaggggctgctggacagcccttctggagtggggctatggacactcgggcatgcccattatcaggaaggacttgggtagtctagcctgatcctggaacacacactcccctctgaaggtggctctcgcatgggaaggatctatctgggtggatagcctcacatttggcgaataagtaacaataccacaaacagtaataatcatagcgtcagccgccacccacacaacccttatgttgtgccaggccccgtgctagcccatgcaccttctcatttcacagatgagggatcggaggcagaggtgcatccaataactcacccatcatggtgctgctcatacacggcagggttgagatgcaaaccctattctgtgagacacaaaaaccagggcatccaactaccccgacactgtctccaccccaacaggctgtcaggtaccccaggaagacctggacaatttgatttgtattataccctctacggatcactggctcagaaggggtaagaaaggacagagaaggagaaagaaacacatgtgagatgaaagcagaggagaagcccagatacttgggatttggaccgtggagtttctaagattgtagcaggaggtgctagaggaggagaagggaaaagaggacatgggggaagggagagaggaggctcaaggggaggagagggacaagcaggaggaaaacaacagcttcagaagggatggaccatctgctcctggcccactcctgggcctggtgtgtgcatttccgatcatggtacccaactcaccctcacatgcctttgtttcatcctccttcaacctcacaccagaaaatgccaccttcacacagccctggcatctgcccctcctcttgccctgcccccatcactacctgcacccaggcctggcatctcccacctggaccactgccacccctccacgctggtctcagctgcccacaattctgccatcttctccttcctgcagctctcatcccatccgtcctctgctcaaaagccttcagagcctggccactgctacaaaatccaatccaaattctttaccctagaattcaaggctcttggcaattggcccccaccttcctgccctcccttccctctgcctgtcaggttctcctctccccgtgaccatgccctctcccttcctggagtcagatttcagcttacatgtcatcttatcagagaagatgtggaaagagctcaccccctccagtgagctcctcacccttcccctcctttatttttcttcaaagcactatcagcagctgacatctaatatgctgctattttctatcctcctgcccccccatgaagcaggatagttttatccagagctgtagcatcacagcttagagccatgccagcccctcacagctcctgatacttgttgaatgagagaatgacaccccaccccctccacagtatgatactttgctgcagtgatcagcgatggttcatggccatctccgtgggtcaccctcactctctacacttgcctttgcacttttgctgacttgagaaacttgactcatctccaggaccacctcctccaagcagcctcactccttacccctgcctcagtcataagttatttgtaaaggggtggtatttcatcacttggctgtcggttctttaaataagaataaaaggtttgtgtctcccttactctgctcccccatgcaacacctggtatcaaactggggcagtactaggtactcagtacatatttcttgagcacagtgaagagagaaggaaaacttgacccaggggacatttttctgaaacttgcctgctctgaagcacactctaggaaggctgacgccctactatgtgccaatgctggaggaatttctactgtgtgccagatcctgtactgggagaggcctactacgtgccaggctccatgctgagaaagcacctcctgtgtgctgatctgagttggctgaagccctactgtgtatagatcttgtttggatgagcttctaagatggagggggaacctatgtgcctggcttcctgctgacagtgcacctactgtgtgctaggtcctgaacaaggcactgagcatcaaagaaagaggcaacccctgcctccatgcacctcacaatcaacctgggaaaatcagaaaaagggagaggaagggtaagaaggagagcacaggggagattaataataactacttattctggcaaattatgagcgcatgtagggccatctgtgcacacagctccatgccggctcctcaccagcaaggcccagtgtaggaacccaggtcagctcagttgggccttccaacagcttgtcaatgcctgggggaaggagcgcctggcctccttgtctccagccctccagccctccagcccactgcccgccaggtggacaggcaggagctattctaaaaatatagctaaggtttggcacaggtgctgtggaggctgccccctcctgccaggtctgagctggctgctcctcaagctagaagacgctcagggaccagggcaccaagcgcagctcctggggactccctgagcaggggtcaagggcactgctgggtggctcagactgcctgggaagaagggcagcacgcagtctatggggaggctgaaacaggccccagggtgaaggtgggacccagggaaaggccatccaggagcacaacccagccctgcactgtggaacaggccccaggacctgcctggctccacaagaaagcaagagacaaacttgggccctggccccagacacagacctggttcctttctcaacttcatcttgatcttgatccagactgaaccttgaccttaaactctattctgatctctgatcctagctctacactgaaccctagttttcatggtggcctccagtccccctactgaagctactagagggccctcactctgtctctttcaactctggaacagccaaatgtggacagggctctccccaagaaggcagacccacagctcacagagggctttcaatcccaacagcctggaaagaaagcaaaagaacatgtactcaataataaagtaataagagcaataataacatctttattgtgctcttattgtgtactttgcatgtctttcttttctttcttttttttctttctctctctctctttctttttttttttttttttttttttgagtctcgctctgttgccccaggctggagtgcaatagtgcaaccttggctcactgcaacctctgcctcccaggttcaggtgattctcctgtctcagccttctgagtagctgggattacaggtgtgtgccaccatgtccggctaatactttttgtatatttattagagacaggggggtcaccatgttggccaggatggtttcgaacttctgacctcaggtgatctgcccacctcggcctcccaaagtgctgggactacaggcataagccaccacgcctggccctaattcttttaattcatatcacaaccccactttacagagaagaaacagaggcacagagtggtcaagcaaccttcccaaaatctcacagctggtaaatatcagagccaggatttgaatccaggccacctggctctagagtgtctgtgtgtggccatcatactggagttgctctaaaagtgtgccagatctagcttcagggtacacacatacacaacacacacacaatacacatacacatgatctcattttctttctcagaacaatgctatgaaaatgactttattaccccagtcctagaagtgtagaaattggaactctggaaaagaagtggcttgccaaagatagcacagctgagacacgatcaaattggcattcaaactcagatttttaaatataatcattcctgctcacaaaatgcatgtccattgaataacataaagaagttaacaacatttataaatgcaccatccagaaaaagcacctttagtattttggtagaggtctttccaggcttttctccatttataaaataatatttttccaataaaatgtggatgctccataatttatttgacaaatcctaacagattggcagttaggttgtggccaatgtttaagcccatctttccacactcccagacaaatcagatttcaggaagatgaagctggaatggcctttggacaacatgctctgggcttggctaagccagtctttggctgtgcagacggtggggtgacacagcagaggcacagagactgtggcccaattggtacccacatcctgctgcacaacttgctttggtaaaggcaagaggctacatgcgatttatctgtttgtttattcttagaaactgtcttgttgagaacttgatgttttctgtgcagctgagcagaactgtggctttggaggttcatgatttgcgcgggagctgatctcgtgagtgatcacatgctgtcaccctaccaattctacactcactcccctgggatgatagaagcctctgaagttacagcaacggggagcggagggtctggagtggggcaggagggtttggggtggggcatgatgcagcctctgctgcagactggggccccaggtttttctaaatgttagcagagttagggtggaacaaatgtgctcagacccaaagggaaattttcccagagcagggcccaggaaaggagaaggtctggagcatgcaaatgacctttgtctttctggctttgtagaggagctggctgggccaggaggccaagctgttcagtgtcacctgctgcagaagcttacagcagggggctggacattagagtcctctgagggtcaggacatgtgagcagagactgagactagtgactccaagtctggcagcaccctctgaagggaaggaccaacagaatgccggactcagggtgaagaagagtgatcacgatcaaggacaataccagcaagggacagcaaatacttaggggtccttgggccgaaatctaggacatgtggaagaagggacagcagatgccctggggtcttttgtttctccttccttctcctttgtcttcttcccactgcacacttggggggtggccacgtgactgctgggggaccaagtggccagagcccaaggccccctctcctcggcagcatggcttctgtcctacttatgtcgaactggcaatgctggtcgcatgcagattaatgaggccacggctgaggccctgcattgggggactggccttgtttctaggtgaccaggtacttgagcctaaattaactttgactaccctttgtgctctcccccttgggcagggcagcaggaaaataatgggggagaaagaagagaaggtgaggaagaggaggaataaaagggggagggagaaggagaagaggatgaaaggggctgaggaagacgaggaggagggagaggagagggcagaaatggggggaacagggaagaagcagagagaaggaggttggagggcggaggggcgggaggaccacaggaggcagggcaggtagagggcagctgccccatgctctgcccactctgccaaacagccagggcctctgccaggtgggttctgtcttgtggggaggagcatcgaagggaaatgaatgttcctgccagtcagccacctcagcccacagactgtcagcacagggcctgcccggctttgcagatgcagaaacagggtcagcaagggaatgtgattttcccaaagtgacagggagtggggatgactggaacacaggcctcctgattccctgtccagtgttctttctgctgtacaatacgtaccactcagccacgagagcctactcatccctcaaaaccctactcaaagagcccttcctccatggtgtctcctcagggcccacgatgtccgttagggcctcctcctgaccactgtcttcagtcccctcccctctggactgagctgtcatccaggcagcagctgtgatgatcccatctctgtgcctctgttcccagcacagggcctctgcacagagcaggtgctgaatgaatgaatgaatgaatgagagtaaataggatcagtcaaatctggatgtgaacctccagaccacctctctcattagttttgtgaccactagtgagtttcttcacttctctggtcctcagttttctcatctctaaagtggatccctgacagggttggaaaataagttacataatgcaatccttcatttacacacataatgaacacgcactgtgtgccagcaggctctgatgggtgccgggtcaacagtggggaggaacttgcctccagggagcttagagtttggtggggcaaacagataatgagaaagcatatgaatgaatgaatgaatgaataaatgactattccattgtgataagtgccaggaaggaaaagccaaaaggagatgatagggaatactgggtgttggggggtctaatttatacatggtgttcagggaagggttcttcaaggtgagaacacttgaagccaaatctggaggagagggaacgagctatgtgcctgagagaaatgctccaggtagagggaacagcacgtgcaacacttgtacaaggcagctgacagggagaatcagcatcaccatcagggtgtccatgctgtgtcctccgaagggctctgcaggctgacccaggactacttgggtgaggaggagcgggaggaggaggaagagactgtgctcaagtgccctttactcatgcattcattcagcacacgtctgttgggctccatgtctgtgcagacacaacacttcactgctagcactgaggacaacgtgtggacagccctgtccttgcccctccccctgcccctgcctcatagcacttagtcaggaggagctgcccttgggctctggcaagtgcggagcgttcccagcttgagcagaacagatggcaagaggacctggcctggcacaggtagagggcaagaggagtgaggtccaagggggcctccctgcagatatgctgttgagccgagacctgcaggataaaggagttagtgtgccaagtgaagggcaggagtcatcctaaaagcaatggtgagctattgatggctttaagcaggagagtgccatgatcaaaattgtagatctcacatgtggaacagattgaagggtgagggctagggcatacgtaaggagaagagcttaggtggtgatgacaatggcctagggcaggctgctggcagacagaagagggcttgggtatgcttaggtggtgaatctgcacaatggggccatggaccaggcaggggaaaggaaaggtgactaggaaggagtcggtagggaccccacaggtttccagctcacggaagtggcacccgaaggtgccagctggggctgagtgcctttgagatgtccaagcagagatgcagggcaggtggtgagagatgctcagaggggatgctcacacaggcttcactcgctccgcagcaatcaaagcatggccctgaagaagctcccctggaggggaagcacagagggggccctcaaatcaatggcttgattgagggaagctgccgggaaaggacaattagagggcagaggacccccagcccctgtctcccaagggtactgcccctgcagtcagactgcccttggcctccttccttcgtgccagctgagccaagctctgatgatgggaaaccgttagtcctaagaggaaagggatctactaggtgcaaggggtcaagggggacgaagggcatcctttccgctggggaaccagatgaggggctgtgccagggactctcaaagacaagaatgcttctcagggtgagatagaggggggcattcctgttgggaagctctcacccctcaccaagctcacctctctctagcacaccttacatctgagctccaggatcttgccactgcactagcctaagacgtcttggaatgctggcccatgattacccctgctgcctctcctggagcccagcacacagcctcagcatcagaggacttgctcagtgaagagtcacggaatgcctttcagtagaggaagccacatgccaatcagagcagccagaaaggtcatctgcgggagaagtgagagtggcctggaggaggcccccgaccctgaaggccaacagaaagcatgtggggagccactccagggttctgggcaaggcagcattgtgtggcatgtgtgggtctccaggactcttggggtggggacgggggctgaggccagcagcaggagcacaggtagcacatgtctgtgttccaaaggacaggtccctgaggttcccctgattactgtaaggaggctggggaaagagtgtgcatgcacatacatatgcatacacaggtccacacacacgcagagaagcacatgtgtacacacctgtgcacgcacaaggacacacacatgcatagacaaatcacagaaaaaaaccagctacagacacatgagttcaggccacagaaaggtgcccttcctcacacaagtataagtgcatagtgggcaagtgcctgcaggtgtggacccagggacacatgcctgtgtgtacccacctgtgcacatgcacgttcacacacacgaacacacacacacaggtccataggagccctgggtaagggcctattcctttgagaacaggcaggaagcccaagccagctctacattggatggtggtgctataagtggtgtcagggtggtagacagaggcctcagccacatgggcctccaaccccaagcagacttcagcagtgaggggccaccccagagtgggtcctgagctcactgatttgctgaggctcagatgagcagcccgccagccagctgcttcccctcctgaaatagcagccctaaataagtgacagcccacctggctaagggtagggcctggcatggctgtcatcaaccctgccagcaggacaggaaggggcaggtgtggggcggtggggtacaggggctgggcctgacccaacaccacccaaactgtgcttccccgtccacacaccgagcagcgcacacgtgcacacaaacacgtggatggatacacagaggctgacaggcacactcacagcacccaacacacagtggaacacaggcactgagtcacaggccctctctgggaggccccgcacatcactcaaacccagaaccacagacacagcacacacagacatacccccgcccccggagaacacgcatgcacacacaggctgccctgctccatacaaacacagggcacatgcacatacattcacacacaagcatatctggacagctgcagccaagcatactgaacaggctacctcaagcactcacacatgtgaacacaacaacagaaggctcagaaacaccctggcacatgctgtgtagacaaagacacaaccagcacaccaaggcgttcaggaccagacacacttgcacacattcacgcaagtgctcatgcacacatccagagtgtctgtggcctttctgactcacaacctcatccctgtcagtaaggatcccccgctggccaccagggccagggtctggtgttttggctggccagccatggcctgtggccaaggccttcttaacaaaggctcggcatcagaccagattctcagaactggtaggtgacggtgaggaagacaaggttcttggtgacacctcctcctgcaggcctccaggctccaccaacagccagagcggggcctgtgggggcttcagtggctcagtgggggaggagtcctgagccgtggggtgctcggcctgggggacggcaggccctagaactctgctccccgcccttttcaacatcatcctctccccttctcagactaagccagcaaatggctgagccagggaagcaagagaggggaagaggcccttggaagacagggctgagggtgggaagcaggcagcgtgattggtaggaaggggtggccaccttggctggggactgggccaaggtgctgcataggcagaagcccagaagagaaagttacttaggaagatgaaatgactcagggcagcatctcaccagcagccatttaaatgactcaaagcctcatcgtgaaactgccacaatttacccagacggcagcattccgcatgcccaccggagagggaaaaacccgctaactccttccacgctggtgtgtgggcagccaggcttcccagctcccaagaaaacagctgcccagggccatgtccaccccacaccactctcgaccatcacatgccatggccaagctgaatccttgcaaggcttccaaagaactgagagaggcggaccctgagcccagcatccttgggaaggtgaggggagcacagaacaaaagcccccgaggtgcacaggaaacatttcaggtgaaatgagacaaaggcagtggggaagtatgaagccagactggccccgggccaacaattgactctgggggatgaacacatggtacttactgttctattctctctactctggcatattttgaaaatttgaaaatttttctgaaataaaacattttttaaaaagctttgtgtcctctgttttacagagagcagtcattcattgttcgttcacttacccatgcattcattcactgtcctgtgagtaaagcactctgtctccacccgcatcactctgggcgatgcccagcacccaagggagaccaggagcaagaccccctctgctggagcaggccacagagcaggaggcttcggcagatgccacacagctatggaaacggaggctctgacaaacagcctccagaataaggctgggctgagtcctgaaccctcatcagattggctgattgggggcctgtgctcttatcaatagagagagagggacatgtgtttactgcagggaactttccacagcaggtgggagtgtgatcctgaggagcttccatgagcctctgtgctctgtgagcctacctgttctgtgagtctgtgtgccccacgagcccgtgtgcctcatgactttgtgccccgtgagcctgtgtacccagtgagcctatgccccctgagtctgtgccctgtgagcctgtgtgctctgtgaatctgtgccccgtgagcctgtgtgccccatgagcctctgtgctctgtgagtctgtgccctgtgagcctatgtgctctgtgagtctgtgccccgtgagcctgtgtgccccatgactctgtgccccataagcctgtgtgccccgtgtcctgtgccccgtgagcctgtgtgctctgtgagtctgtgccctgtgagtctctgtgccccgtgagcctgtgtgccctgtgactgtgccccgtaagcctgtgccccatgagcatctgtgatctgtgagtctgtgccccgtgactctgtgccccatgagcctgtgtgccccgtgagcctgtgtgctctgtgagtctgtgccccataagcctgtgtgtcctgtgagcatgtgtgtcccatgagtctgtgccccgtgactctgtgcccaatgaacctatgtgtcccgtgagcctgtgtgtcccatgactctgtgccccgtgagtctgtgtgccccgtgactctgtgcccctgagtctgtgtgccctgtgagtctgtgccccgtgagcctgtgtgccccatgagcctgtgtgtcccatgactctgtgccccgtgagtctgtgtgccccatgactctgtgccccctgagtctgtgtgcccggtgagtctgtgccccatgagcctgtgtgctctttgaatctttgctccgtgagcctgtgtgctctttgaatctgcgccctgtgagcctgtgtgccccgtgagtctgtgtcccatgagtctgtgtgccccgtgactctgtgccctgagtctgtgtgccctgtgagtctgtgcccctgagtctgtgtgccctgtgagtctgtgccccgtgagcctgtgtgccccgtgagcctgtgtgtcccatgactctgtgccccgtgagtctgtgtgccccatgactctgtgccccctgagtctgtgtgcccggtgagtctgtgccccatgagcctgtgtgctctttgaatctttgctccatgagcctgtgtgctctttgaatctgcgccctgtgagcctgtgtgccccgtgagtctgtgccccgtgactctgtgccccgagtctgtgtgccctgtgagtctgtgccccctaagtctgtgtgctctgtgagtctgtgctccatgagtctgtgccccataagcctgtgtgtcccgtgagcctgtgtgccctgtgagtctgtgccctgtgactctgtgccctgtgagcctatgtgtcctgtgaacctgtgtgccctgtgagcctgtgtgccctgtgactgtgtgcccaatgagcctgtgtcccgtgagcctgtgtgccctgtgagtctgtgccttgtgactctgtgccccatgactctgtgccccgtgagcctgtgtgtcccatgaacctgtgtgccctgcgagcctgtgtgccctgtgactgtgtgcccaatgagcctgtgtcccgtgagcctgtgtgccctgtgagtctgtgccttgtgactctgtgccccatgagcctgtgtgtcctgtgagcctgtgtgccctgtgagtctgtgccttgtgactctgtgccccatgagcctgtgtgccctgtgagcctgtgtgccctgtgagcctgcaccccatgagcctctgtgacctgtgagtttgtgagtctgtgccccgtgactctgtgccccatgagcctgtgtgccctgtgagtctgtgtgccctgtgagcctgcaccccatgagcgtctatgacctgtgagtctgtgagtctgtgccccatgactctgtgccccatgaacctgtgtgtcctgtgagcctgtgtgccctgtgagcctgtgtgtcccatgactctgtgtcccgtgagcctgtgtgccctgtgaacctgtgtgccccatgactctgtgtcccatgacctgtgtgtccggtaagtctgtgccccgtgagcctgtgcctgtgagcctgtgccctgtgagcctctgtgccccatgactctgtgtgcccggtgagcctgtgtgtcccgtgagcctgtgtgccctgtgagtctgtgtgccctgtgagcctgcaccccatgagcctctgtgatctgtgagtctgtgagtctgtgccccgtgactctgtgccccatgagcctgtgtggcccctgactctgtgccctgtgagcctgtgtgccctgtgactgtgtgccctgtgagcctgtgtgccctgtaagcctgggtgtcccatgactgtgtgctccatgagcctgtgtgccccatgactctgtaccccatgagcctgtgtgccccgtaactctgtgccctgtgagcctatgtgtcccataagcttgtatgccctgtgagtctgtgtgccctgtgactctgtgccccttgagcctgtgtgctttgtgagtcggtgtgtcccatgagtctgtgcgccccattgagtctgtgtgccctgtgagcctgtgtgccctgtgagcctgtgtaccccatgactctgtgccccatgagcctgtgtgccctgtgagtctgtgtgccctgtgagcctgtgtgccccatgagccgtgtgccccatgattctgtgccccatgagcctgtgtgccctgtgagcctgtgtgccccatgactctgtgccctgtgagcctgtgtgccctgtgagtctatgccccatgagcctctgtgccccgtgagtctgtgtgccccataagtctgtgtgccccgcgagtctgtgtgccctgtgagcctgtgtgccctgtgagccatgtgccccatgactctgtgccccataagcctgtgtgctctgtgagtctgtgcctcgtgagcctgtgccccttgagcctgtgtgccctgtgagcctgtgtgccctgtgagtctgtgcccccgagcctctgtgacccatgagcctgtgtgccctgtgagcctgtgacccatgagtctgtgtgccctgtgactctgtgacccgtgagcctgtgacccatgagcctgtgtaccccgtgactctgtgccccatgagcctgtgtgacccgtgaacctgtttgccccatgagcttgtgtgccctgtaagcctgtgtggtctgcaattgcagctccggtatttaacgcagtacttggcacctgtacttactcaataaacatcactgggtgaatggaagttagaggccagtggggtactggaagcccctggagaaagcaggggacactgggaacagagtgaggcatgtgaagggacctgggatggctaagcaaccgcctctaggcacggggtccactcctgggctgggcccatgttcttctggcccacttcagagtctctgagaaatagaggagcagagcagagccctgtatccagcctcaaggccagtccaatcagcacctcccagacttccgctgctaagcctggctccttggaggctgctccattcaccccctagacacagaactgccctctgggcctatttggtcagctctgctgcctggtatatcagcatccctccttcccccaccctgcgatgaccaaccaggccgagggagtaagcatctcaaggtcccttctagcctaggacaagctggggagatggggtgggagacaaagtgcaatccctcagagaggaaagagtgctgatttgggattcatcagggaagcacaacacataggtcaccaccaaacagctttggggtgggtcagtggtcattccactgctaaagccacatacatggagacgacctgtcttcaactctcatatcccaggaacagcagctctcttgttatcctgtccctgtttcgctggtttctgcagacatccggtgatgcctcttctcccctgcacatggaggtaggctccatgcaacacactgcgtgcacacacgtgcccacctgtgcacacacccacatcctcactcagccgcctgccctcaagcacccaccatccctccctccacaatcctgcctggctcaggcccaggctaggggtgaaggggcatacggaggcaagcaggaaaggggccttggcctgaattccaaagtctgaaatagcccaccacaaattatctttgttctgacaggctgattagcataattatcccatcagaggaaaaaaaagcagaagagagaggacgaggacagtggtagaaagagagacagccaggggcagagacaaagaaagcagcaggcactgagaggggtggctctcaggaggccacagcccacgagcaagcacagatgcccaccgggccccaggcacagccctgggggagccccttccctccgacaggccaggcttgctgtgggcttcagggcctatctgtgagacgggagggctcaacaaagtgatctccagggtcctgctggctccgacatgaatgtctcgagatggcagagccaggatgtgttcgatgaaatcattttgccgaaggatgcaaagacccgtgaatgaaggttgtcctgctttcattcaagtcacatctctttgttctccagcccaccttatcaagagcccagaatgtgagtgcccctgctctgcaatggcactgtcctaggtgcgggggactcagcagtaatcaggacaaccaaccacccttgctctcgagctcacagcctggtggaaggggacagagaaacccagccagatgattccacatgtggtgagaactggtctaagagccagagtccagggtgctctggggatgcagatgaaggacccctgatccagacatgctggtgggaagacacagaaaaattcaaaaggaagggaggctcacagaaggactgagtgatgggcagttgctggccaggcggggcaggagcaccggccctgcacagacaattccagacatcacgaggcatggcttctgcccctggccacccagtacctgcttctgaacaggttcgcatgtatcagcttctcctcttctactagatgcaaagatccttgcaaagaggcactctccattcctcttatctctgtcacagtcctgggcacacaacaggcttaatacatcctcactgaatgcatgttcggtccattcccagaaacaagccacagatggaagatcctagcctcaggtccctggggctccctctggtatcccctaggtacatgcatgccccaggggttaatctcagccccacgccgcttttcaagaaagaattaaagggatgggtctagattcaggggaaggagacaggaaagggactgagggccaagaaacccagaagacctggagactcctaagccagggccctgggtttgtgtgcagtggggcctgaggcgagcaagcagacggtggctgaagtggttagcggtggaggaaagtgagagagagggagaggaagagagagagagagagagagagagagaacagaagtgaacaaaaagtcagagggagaaggagatatggagaggcaaagagagggaccaagccaggtggataaagaccaatacaaacggataaaaaatgaaggaaggagggaggttgaggcaggaggatagcttgaacccgggaggcggaggttgcagtgagccgagatcgtgccactgcactccagcctgggcaacagagcgagactccctctcaaaaaaaaaaaaaaaaaaaggaggaaggaaggaaagagaaaaatctagagggacatgatgaggagagagatgacctggggtgggtagaggtggccaagggcaatgcaaaggacagaaagggtgaaggaagacagagtcagacagcttccattccaggaggagagaggaacttggaagggggaggagaaggaaggacagacattagccaaccccgaggtcagggaccgaggcagggagcccaggggaggggtcggctgcatgcccagtgtcgtctccccatctgcctctccacaggagctaatccttggtcttccactccatcaggctggcaggactctctcctttgcctcctgcccacttggctccataagtacgtctgggggaggcaagcggcggtagcaggcaatagagaaaacagctctgggaataaacaaaccccccgctcagcctcctgagaccaggacactcgagacgccaggcagaacgtgagagtcacaccaatgcttcccagtgatttcctgcatgcctgggaggaggcttgggagttgcattaataactacgatggagaggaacgccttctgtgtggcacgcacttgctgagctccttccatgcattatctcactgagtcctcacaaccactctgagccgcatgccattactcgctccctttgaacatctgaggctcagagaggtccaagatctcacccaaagttgcacagctgggaagtggtggaactgggatttgaacccctgcttttaacttctattccttgtgatctataaagaggagtgagagtgtgctggcctctctgtgagagttccccacctctgaaggcccagcttcctttaggaaacaatccccagtgagatatccccctcaacccccagcagcctcctgaatgctttccaggttggtgtgacctcagaggcacctctgcattgaatggctgtatggacaagggcctcccaaagcaggcaatgcatggaactgagtctctggtgacctgagcctcagattgtttccatttgtccatcatccccagggacaaagaagtagctggtgaggatgaagagacagggtttaaagccagagccttctcctaaggacaggcaaaggcctgggaggccagctggggattctctgtaccaccgtggtcatgaagaccccatggacaaatgcatgcagaggcaggaggtgctaagaagccgtgggcctggcctgggcaagaagagagtcactcattagtatggggacaccaggctgcttacacagctgggcgaggtctggcacagatggaccaactgtgttgggctgctgtactcctctggacagcaacagagtcctcctccaggtcttgcctggagacaagcaccagctgagggttcaggatttctcagaactcaggtgacctccctgtagagggggcccctgagccccagcctggcagcttcatctactgcagctggcaaactccccaaggggaggaaatcagaccatgaggctccatgactcaggggtggcctccacacagtgacccctctcccctcctcacacatgcagcatccatagacaagtccggccactggaaaccgaacccccacatctctgcccttctgataaaatcagcatggaccagggctccctgtatgtggggctctgacttggatactttctcatgttcatcttttatagttttcagttacgctgaaagggtcagctcctgatgcccattggatagataagaaaatggaggctcagtgaagtgacttgcccaagaccatgcccacagtgagtaacagtgcctgatttcaagaccattcatgtcctttccactacccacacccctgccaagacaccccacgtgatatgaccagcacagccatcactaatagcatcaaactcaaacctcaagtgccacattgaaaagaggaatccccaaggcatctgacaaatgtcctgtgggggagagagcacataggaagacccccatagttgccagctgccaccaatcacagcccaagcccattagctgagtcagtttcctaggaaaggttttgaaacgctgttaattcccccaattataagacaaatgtttgttgatcctcttaaggtttatcacatagcagtgctgcctgagtaacagctaaatccaaggggcccagtgccgtggagtggaaggcgtgtggtacctgaaaaagcaggctcaaatctgatcccagagctgtcctcactcagagtatgactttgggcaagtcacttaaccatcctagacttctatttcctcgcctgtcaaatgaacgagttgaattatacggtacccaaagtcctcgcgggctgaactttccagaagatggtgattcgtgattcaattaaagtttaccaggctgcctatcagaaaatttaatgactcttccaagttgaccaaggcaggtaaaaaagattataaatgtaatttcattgaaatgggaaaagatgagaataagcaagcaaataacatcttaacacagaggccacactcgccagcgaacagtgagtcactgcctttgcgtgggggaaaaaaggaatgaaattggattctctggagctcacatggacttgttttcccagagacttggagagggcttgccatagccaggggatagatgagactctgggggttaactagaaatggggggagagaggtcccaggggaatgtgatttaagccaacctaaaagaagaatttatgacaactgcagtcatttcttctccatttgacccacaggcctccagacttgctgagatgtggctctgaaagattctgagatagtttagattgagtcccaacgggaattttgttcccagggaggttaaacgttctctgtggaacctcaattccctaagaaacatttgcaaggagggtaatttaagcaaaaatactatttgtttcccaatttacaagcaattacacatgatttacagcccagcttgcctcttgcacaagcagctctgtaatttacaagaccataaagtcgggggctcccatgctcccgccacaataaatctggcctggatggtgacttggggcggaaatgattaatctgcccttcgagggataagccagcacagtgctatattagccagggaagcatggtgctgagacggcacttcttagccccacccgtgacacctgttttgctctagaagagaaatatgccccatggtcccaagagacaggggtataggacatgctagccaggaaagggtgccagccaagggtgcaggtccagccatctgtgcactgatgtgcaccttatctgttatcctgagggtttgccccaatcacctctccacaggcccagttctgcatcagctggggcagcttgtggcagatttgtgatgtctcaagctggacatgggaccagacaggctatcaggcaagtgtcagacggaaaggtcatggtttggcctggactgcagctaaagagtttgccaagccaacaggggccttggacgttcatcagagcagtcaagcttggactgggtgggtctggatcagaacctctttgccaggacagagatggctgggaggtcagcaccagggacagctccagcaaggttctgcttggctaaggctgaggatgaccttggtcttttgacttcccacagttgaagttagcgggggagtgaaggtgagaaaaatttctagcttgagaagcctggactaaggcagatcctaatctttgtggatccatgtaagagccctcttttcttcctcacgaagccgggtgtctctggacaccgagagatcactctgaataccactgaatccttgatggatttaatcatagcttatttccaagatcctcctcatcagaaccctcttccaggatacagaccacccccccaaccccttggcattctcatactcatatggattctgatcttcaggcttagatcctgagaagaaaataataatagagccgggcatggtgagtccctcattcatttattcaccaagtatataataagacccactatttgccagacaatgtgcttgttttgagggatacaatggtttaaaaaaagatgtatggaatccttgccctcttaatacgtgagaaggacaattaagttaatgttaacaatcatgaatatttgttgaattattactaagtatcaggtcttgtgttgggcccctttagagacaacatctcacacagttagcaaaaggaggggctaaaatttgaagtcagacatcctgactctagggccttcccttttaaccactagacaatgacaatatagtttgatcagtgctgtgatagagtgcaagagcctttctggtcctcacttctcttccccagctcctggtcctcccttcttcactgcaagctgagaccagggggtatgtgcacctctgccctttctattgggacccacaaatctctgaagtgcttctcactctgaagcttttctctgccttgtcctggatttctgctccaacctccatgcccagcagggcctgactaccctctgctcagggatcactctacagcatatagctcatggccctgagggagcatgggaaatgagggagcaagactcatgggtcatctgtgtctctatggaaacactgacaccaggaagcagaaccacagcctatggtctggaaaggaggaggtaggtgacaggtaggaggtaaagaggaagtaagatggaaaaccaggtaggaaatccagcttgacagacacagagtgatgtggacaaagggtggggcccatcggcaatgctcctagaaggtaaatgacaagaggtgaagggcagagggttaagataatgcacttgggtgccagacacactgagtcagaagcccaactttaccacctatagacaggttacttaaactctctaaggctctgttttttccatctataacatggggctaataatagcaaaagcacatcctgttatgataattgagataacagatctacgataaatagtaagcactcaataaatgatagcaataatgtgataataatgacatactttgcccagtaagcctgtcctgaaggacctggccccgggtacctgggaacagaggcccagattcagtgccaggtcctctggtgtgtttgccactaggccctctgtcgtactgagaaactgagctggcagagcactggggttctgtgatggtggcagactccctgccccaaccctgccccagctacccccatctcttgcaggtagaaacatccctggaagcttttaccatgagtgatgggagcactattattcacttcctcacagtttcacctgctcttctctctctctttcactctctctctccgtgtgtgtgtgtgtgtgtgtgtgtgtgtgtgtgtgtgtgtgtgtgtcttctttgtttccctctgttcatgctccctccatagatttatttttgtctccgcccttcctgtcttttcctctcccccaccatcactaccactaccccgcagggcaggataactggtggccattgggagtgacactcattcccataaggcaggtcagaagcacattgttaaggaggttgactgagtatcctacccacaggtgttgatactcccccaagattagggaatgttttaacctctttccaaacaagctttgggcagctctgaaaatacctccacctgccctttcaagggccccttgctggtagctcctccacctctctcacatgcacctagtcagcccactggtcacagcacaggaacatggtcacagttgctgcccctctttacaatctggagcctccacagctgctggccccacctgccacagctccacgtggggcaaggccaggacttgctggggtctttgccatgacattcaggctggcaactgggtagcaacgtggctcccatttccccagcagtgggtgtctcaggagcagatgtgcctgtcgggacagcactgacacccccacctgggaagcactctctactgttgtttgacaattgacaatttgagcaaacagaatgactcatccagagacaaagccaaggcaggcagcctttccaaccctctcccaagggaggcaaactaatttgggggccttgtcaaagtgccaaatccctactctctctactcccatgaagaagccagattaatgaaattgataccatatgccaccctctcttcccccaaattacactggctcccaagacaaagcaacccttccagaaaaccaaacccgcatcctccagctcatcccccaagtcaaaacctgaaggttaccatgccaagagtgtcaacaggggctgagcagggccccaccaatggcaggagccagtcaagacagccagggggagaaatggacctaaacaactcagggaggtcacacctgcccctcagaaaccagcaaggggctgtgtctggtcatcctctctccattctgagaacagtgaacgtttaataaggagacggggcccatattcaaatctgccacctgggagcagagttagatttgggttttggttttgtttggtttttggaagcaagtttgatcttgacaaattaactgcctcccaacacacacataatcattgacagatagatttatttatccattcattcaacatttgttggcactaaccatgtgccaagcctgttgctaggccctggaggtgcagaatgaaaatcctaatgatggaataagtactggagtagagagagtagagacctgcataaagtaccctgggtgtgcatgatgaggaaagagtcactattttctgaggatattcgaaagggcttcattgtagagaggacactggcataagcaacaggataagtgaaattcaccaagggaagacacggaactcacagagttcaatgcagtcttgggtcctggcttcaggccataacacacatcttctcaaagccagctgggcacaacacacccagaaatcacagagctttccatgaaaccccatgaggatgcgaatggacagaactctattatgtgatgtaagaacaattcagctaatcgaaactatgaccatatgaaaaatggcaatatgaaatactttcaaaaaatttggcaggggaaaaaatatataacatcagtgttatctccaatggcagtgtgaagggcaaggttgacaggtagggtaaggatgcttgatgccaggtgtgatatccaaaaactgagcagtcattcatcacgtcagctgcttctgctttctggagacctgtgttagcagccaccaaaggtttaataaacacatacagaggcagaattgactgggaaaattttatcaaccaactacacagtttctgcaatttgtgaaaagaccactctctgctacgagctggaatgggtctctctgctcctgaaactcccttaatgtgaactaggaggtcatccgtatgtcttccacaggtgatgagtggggccaccgtaccatatcaggcctcattgccctcaggaaattccttaaacaccggagtctgatatcggaggtccgcatatactgactcaaatgacatttctagcctttctctcattccaatcctctaatctagctgggtcattctatgcaccattcacctcacatcctttactcttttgcccaccattggaagctcaattcctggcacaaaaattgtactcagtaaatattttatgaatgaataaaaggatggatgggtggatgaatggttggacaggtcagtgaatcctaccactatgccattttctctgattggaataagtctccccagatccagcttgtcttggagaactggctcccaacacttctctagggttcctcttccccagcccactccactgtacatagattacttgttcctcttcattgctggtcatgggtctgccatgctcactgggaaatcaattatgctttgattccacagattgccctgcaatgtctcttatattcctcttggttttgtaattggtttttcatgactttgttcccccaatagcctttcactaccacaagaagaatgaccctatattttattccaagacagtcctggaccattgggccagtccagtaggaactgactaggtgatgatgtgctcacaacaagcccttgttggggagccatgcaaagctgtgagacaccaccagccaggcaaagcaaaattggcctctctctggctttactgctgtgggacattggctgaccacttgcctctggacctccaggacatgcttagtctggctcttctgtggcccttcccttggagaacctccttcacctcctggttctggtagggctgtcagtcatagagcaccttctccaagacatagagatgggcaagtgtctaaaatggcaaagcagcctcatcatccttctgactccaggatagccacatgaccaagtccaggccaactgggagggctttattcaagagcttggaggggaaacatccttcccatacaaatggaaggctgcctttgccgtagaattgaatgaggctgcagctaggcctcacagaagcaaagtcaagggatggcatggcttgattacccaggtctagccacatctgaaccagtctacccctagactgccaattctgagggcctgctaattccctttttacttaacacacttagagttgggcctctaaaatcaagagaatccagagtctaagtcctcccctctgtgccttaagaaggatgagagatgcgcaaattgctccacttccagagagggacagtggggaaaggttatacttggatatcagaagcctcttagaagttcttggcagctcctagaaccttgccccaatcccagggaggcttctgggtggccttcggcagctctgatcctcaatgctcaaagacttctaggtggatagcagagtgaagaagactgctgcctgccatctcctctccagcacagtcatcagcatccacattcccccacctgacaccttccttttcttctgctcttcttgcagccacattatataaacgggcccaccaatagtcacagaggcctggagacacccttttggagggaacagggaaacttctccagcttacctctctgtgaagtgcttctgcggcagaaccactccccagggcctggcaccatctgttgttagaaatcccctttgctaattattaaacttctctgaatggaaatgaatcacggagccaggcaggagggggcttgaggaggcactggcaatttacttagcggcagtaatcatcccagccaggccacacgcggaggctcctgatccatctttggcatgggctccgccacgtgctccgcatcccaatgaggctgtgatttctgaaggagaatccacagggcctgggaggcctgggaatttcctgcagaacttcagtggtctggaacctccttggagcccctaaggaccccactctgcctaggcccaaagagtcagccagggctgaaagtggacagatcctgatggaatggaccaggccttccgtactgattccagcatcttggaagcaaagtaacaggctcacggcaccccagccagctcctggatgaggaaatacaatgatgtaatatgatcttgtccctgaattacaccacagagagagtggaaggggtaggagcagggtcttgagaaacgggaggtgggttctatcctaacaagggctcccacaacctccaggacttcccgttgccactcttattcccctttccctcaggtgggctgagccaggttacgttcagggagtcaaaatgagtgtagggcgctaggaaagaaaatccccatgtcttgagcactttcaagggtccaatctctttgctgttttctcatggaatctgcccaacaaccatgcaagacaggcattattctcatttaacagactagaaaactgaggctcagagaggaaaagtgactcacccaatgtccctcagcaagctgggagcagaagtcggcccagttccatgtgacccttttctctctactagactaggggccaaaggatggggcagaacatctgtgtccagaggaggattcgttgacactcagggaaagcacatgggggcccagggtctccatcatcatcaccatcagttctgagcttgtactaggtgcccactggccttgaaagtacaaagacctgagaggttcccactgtagtcccttgggaagaaagtcaggtatcagtgacccatgccagtctggtatctgccccaggacaacagaggaaaagcaaatctccaggcagtcccttcatgcacctaaccctcccttgttcagatacttccaaagctacccccagcccttaggatagcatacagaggccaccagggccctgcaaagcctgttccctgcctgcctccttagaagcaacactccacccctcctccctgcgttggcggcgctggacttctctggcctaggaaagtgcttgctatatctgcacaccaggcctttccttgagctgtttcttccaccaaaaacacccttcccacactctttgcctggctacctactccttctttgagtgtcagcttagacatcacttctttttcctttttttttttttttttttttgagacagaatctcgctttgtcacccaggctggagtgcagtggcacaatcttggctcaccacaacctccacctcccgggttcaagcaattctcctgtctcagcctccctagtatctgggactacaggcatgcgccaccacgcccggctaattttttttttttttgtatttttaatagagatggggtttcaccatattggtcagactggtcttgaactcgtgacctcaggtgatccacctaccttggcctcccaaagtgctgggattacaggcatgagccaccgcgctgggcctagacatcacttctttagggaaaaactctctcaaagcatgaaatgaggcatgaaaaatgatttcagatgacgtaggagacgtttatgatgctgcgtgccacatcctcccagctcacctgatttcagaagagctgtcatggacagtaccctgcccttgtctcacctgaattttgggaaggtcactcagcccctcatgagaaagcaggaagtgtgagggggaagtaacataatgggtgttggaaattgcagacatgtgcccagcttctctgtcctccagtgagatgactctgtggtgtgttttgctcggttcttcaggccttcatgggattgaggccccagcaaacccatgaaatactgggcagcagccagctcagcatttcattggcttttatcccttccctgcctcagtttctccacacctgcactcctgcttcctcccaagtaaactacctgccctcacgtccttattttaggctgtgctttcagggcaggtgatcacagaaaactctttttattaggttggtgcaaaagtcattgcatttttggccattactttcaatgacagaaaccgcagttacttttgcaccaacttaatcctttattagttatgtacctatgggttaaaatatgttaacatatatatgtttaacacatgcatatattaaaatataaacagcacagataatagcccaaaggtggaaacaacccaaatgtccatccttgatgaatgggtaaacaatgtggtataaacacaaatgaaatattattcagccttaaaaaggaatgccagccgggagtggtggctcacacctgtaatcccagcattttgggaggctgaggcgggtggatcacgaggtcaggagatcgagaccatcctggctaacacagtgaaaccccatctctactaaaaatacaaaaaaaattagccgggcgtggtggtgggcgcctgtagtccgagccaatcgggaggctgaggcaggagaatggtgtggacccaggaggcggagcttgcagtgagctgacattgcgccactgctctccagcctgggtgacagagcgagactctgtctcaaaaaaaaaaaaacaaaaaaaaaggaatgccattctgatacatgctacaatatggattaacctctaagtcatgctaagtgaaataggcaaaacacgaaaagacaaatattgtatttattccacctatatgaggtacctagaataggcacctttatagagacagcaagtaggacagaagttaccaggggctgggaggaggggtaatggggaactattgtttcatgggtacagagtttctgtttgagatgataaaacagttctggaaatggacagtggtgatagatgtacaagattgtgaatctacttaatgttacggaatcagatacttaaaaactgttaaaatggtaatttttatgttctatataggtatcacaataaaacattttttaaaactttaaatatacataaatagcacattgggactcaggttttcacagataacatcacccaggacaaggctaaaaaatcaatgagcttatctaaagttggttttttttttttttttttttgagagggagtcttgctctgtcgcccaggctcgagttagtgcagtggcacgatctcagctcactgcaacctccacctcctgggcttaagtgattctcctgcctcagcttcttgagtagctgagactatgggtgcatgccaccatgcccagctgattttttgtatttttagtagagacagggtttcactgtattagccagtatggtctcgatctccggacctcgtgatctcccgccttggcctcccaaagtgccgggattataggcatgagccactgcgcccagcctaaagcttttaaaaagcaaaacaatgagaagtaaatgatcatggagatcggtatgctgctgggcaaaaattgtgaaggaggaatttaaactatcggttttgggaagccctgccctgaaggagatgatatccccactgctgcgtgctcctgaggcaccctccactttctcctttggtgccgctcattacagctgcaaattcttatttccttgtctgtttccccactggcctgtaggtcacatgagaggtcacatgacagcagtaagccgtctaccccattcctttctgtatcccagcatgtagcaggtgggaagtgttaataaacaagtgctaaattgaatgacatgaaattcgaatgagcaggaaggcctcctgaaagaggagagtctccaaaagtgaacaggatttgctttaacagcaaagaagcaaaagaagcagaagagcatcccaaggagcaacccaaagtaggaagacctgtgatgtgttctggaagcactgggttctcctgcttggctacagcaggggatggacacatgggagggtgtgtgtagtggggtagtcagagaggaagctggatgtgcgatgggcccttgaatgccaacctcaggcatttgagtgaatccttgtaagccaacaggacagtgacaggggaggctctcgactccttcccttttgccagagttttaaatctcagctacattccccccaagacaggaggtcctacagggcatctacgacttcttacattctatgcaacttattatatgaatgtgcattttttttcgggggaaaagcgtttatcattttcatcaggtctgaaaaacctttgtgacctcttaagcagtaagatgctcctggctctggggaataagccaattgggcagggtcccactcaaattgtccccatccccatgggccatggaccttggcagacaagaatgccaaggtggacaaggtctacccagtgatctcagtcactatccggcttcacaactgcccagattgaggattgggacccaggaggtatgaaatcgactgcatctcaaggtatgctattggttgaagggatgatccgtgctgatctttaccccctccccatggttcttggatctctccatccttcctggggctctgagtcatcatctgagttacagtcccttcaattctataccagcacagtcccaaagcaccagagctctcagttgacctcccttatgagcctcacttcaggggttagggtgggctgatcgatcccctccccagtcacccacacttctgaaacacatccctctgccaaaaaggcttctagacacaggacagatgagagtccctcatttctctgtcctgacccagcatctggcacagaacagccaatcacaatctaagagtccaagcgggtgtgaccagcagcaatcatgggcagtcctgcttggtcactccctccagaggctggctgtcagtcccctcccctccccacaggaagccagtccacatcatccctctggtgttggagtcaggtagatgtggattcaaatcccgcatggaccatttgccagctcagtgcaaattacttccttgagaatcctccatttctttagctctgaaatgggttagtaatccttacttcattgaatccttatagggtaacaaatgaaatcatgcctgcctctcccaaaccaggtcccattgtcttaaagatttgagactcatatctccctcttggagatgtataagatgcactattatactaaaggttctgagaagttctggataaaagaaacccagagctggaccatgaaattctaatatgagagcactcttaccattgtgtgcacagccagctgagaagcagagctgatgtatgtaaaaacagcagcttgagcttggcaggcagtagatgctcaattaacaggctctgtcttcccctttgcagagctggatatgcaaaaaatgtagaaaattaagagaataaagccattcccctgcgatgcttcctgtgacagctctgaaggtggtcttaggggagggggctggagagactgaggacccaaggcaacagttttctgggaccagctggttgattctggggaggctgccctgccttgctgaagagggtgggtgaatcctgacagatttgaatgcttcctaattctcctgagggtttctcttctgtcagccaagacccacccacccattagcaggactcggttgccagagcattgagaagagaaaatcagtgaaaaggaaacaagccaataaacagagtccacccactgccagaggccccagaactccatgtggagccaactctgggggcaggccctgcagggcaagacctcccctgcacagccacagggacccaatggggctgctctctgcacatcactccccctacactgtgtccgctgattatggcagtgttccctactacagcataaacgaatgcattatgtctttgttatgctaatgtcatagcacgacgcaatttaaatagcacttccagaaaaattaagtatgttcattgacacagtgaaatgttttcaccctcgatgtaaccttcacagattctgtacaaaatccatcagtcagtgagctattcatttgtgaatgcttagcaattattatgctaatgcatcacaatgcattacagcaaattctctgtaagtggcaggaagtgcagctgcctggcacgcactgcacccagattacggagcatctatcaatatactgagccatcactgcaacttgagtccaaccatattttgagtcttgccttccaggagcagacctccacaggtttatggactcggctagaaagcaaacatcaacacatccttaaagttctcccagcagggaggtgtatcagttagctactgctgcataacaaatcttcacaaaattcagtggcttaaagcaataagcatttgctattgctcaggagtctatggatcaactagattaatctactgatctgggcaagctaggcagacctagggtgggctcactactgtatctgtggtctgcgggggttagctggtctaggatggcctcgtttcatgactgacagttggctggctatcaactggggcaaggagggtgacttggccactcatctctcatcatctaacatgcacgccaggctagtccatatgacagtagcaggattctgagagagagtaaaagcatgcaaggagcctttgcagaggtctaggcttagaactggcacgatgtccctcctgtcacattctattggccaaagtaagtcacacggccagctagatttgaggggtagggaaacaaactccgcctcttgatagcagatggtagtcatgttgtatagatcattgatacatggaggaatgaagaactgcagacatttaccatcaatctgctattggagaactgtctgaattatacatattggaagaccaaggtaggctggccttgaccatgctcagttgctaccttacaatgttggagcagtacagcttgctaagcagatcagggttgctactgattatggtgacttctataaactgaattgcccctctaggtatggtatccacctccaatttaatagaccagtcattgcaatagaagagggcttcagatccaccagccctcgctacaacacatgctctacctgcaggattggcctgcaaggaaccattcacactccttgtttggaccaatggcatgtgccaatgaaccaacaggccaggtcttacctgtggttggggattggtgtccagttctggtccatccataactcaaaggctggttttggtctcttgacacaaccaattgagcagtcagatctagaaggctcggggcttgaagctcaggtgcaggaatgctctcgatttggaatgagctcatactgtgcctgccctatctgcaccctttccaagggaactgccctattcatagcctttgcttccctggagatcaggttttgtatcacatgctccttagacacagatgattgggtgaagggagaggaacttgactcaaagaaaaacaacctatgacctggctcataaagaagagttgatccagagttcttctcttgggaatctcaactaagaaacacagaaaagccttgctggtcagtggtggcaggagctgcagttgaaaggccatgaggtggagtcaggccagagagggcatgatgggctgtggggcacagaagccacagattgcagaggatgtggatggagggagaacaagcctggctcaagtttcacagggttgaaaccatactgctcctgagatgagggtaaggaggggtttgcaagagaagagagaaagaatgttccctagagtcccctggatttcagaaggctttccaggtatagctccaatccacatgcctcttgagaggacaccctcttgagtggcaactcagcaaacctgaccacaacaccacaagctcacatattcccgagtgtctggatctccgggtttccctgtgtcttttcctagtaaagctccctctgagaatctgactttattgtagtggaaccagcagaagcaaaccatgaacctccaacttgttctctacacagtaatcagagggatattttaaaaatgcaaacctgatcaggccataaccctgcttaatgccttcaaatacttctcattgctcttaagatcaaacctaaatcctcccaaagtctacagagcgccgtgtgatccagcctctgctcagccctccagccccacttcccgtgctctgcccctgccttgcacactgtgttccacgtgggcacccagccccctgcagcatgaaggtgccatgctgcttctcacacagatcttctctttgctcctccctctgcttgggacactctccctcctccttttgtggtgccacttgcctccttggctactgggatccagtttgtgtggtttggactctggatgcctggatttcctcacccctgaacccttcccacctggactcagggaccgccccccaccccacacccagattgacaggtgtgactaacaggcacctgggatgctgcaggcctgggcagtcagctctgcccattcccagggtcccgcaaggtctggcttccctcagtaggtatcttcttccctacccagtcccacacatggggaacagagcataaccgaagcaacaaataagaagggtcagtttaggctccacagtggcagagaatcccttcccaaggaccctgatggaatatgtccactcagcagatgaaccatcacaaaatcccagcctggaaaccgtgagagaactgccttgcccttttatttacagatgaggaaactaaagctcccagtatctgtccatccctttgcccccttcctgtcccatcagcttggccaagaaacaatgagtggatgattatatcctcaaaaaacgatgaccatagctgaaacatactgattgctggatgtataccagcactaagtgttttacgtgggttattttagtttatccttacaacacattaaacagatggagaaactgaggctcagggaagtattaagtgtctcacactcattacatgcagacactgggatttaaacccaggcagtcttgttccagggctaatgtcttctctgctaccctgagttgccttggtcaactcgggttatctggggtttctccatggaagcaagtggctggagggcaggtgaacagagaggggtttgcagtgcccacccgccattgccacagggctgggctgggcctctgggagggtgagtgggtcacccatcaccatgcccctttagttgcctgcctggtgaccagagagagggggcagtgagccagccagccaaggtcagggatgatggagggacaggtaaagggaaactgccaccatgagagctctattcagcagatgctttgagactccttacagccacacagtaagatggagatccttgttcccatttcacagttgagaaaactgagtcctggagagaagaatttgtctacagcacatagcctgtaagtgacaaactagggaatgcagccaggcctgtctgattgcagtctgctccacttcacctagaatccagcctagatgttcctccaggagggccagggtcgggggagggggctgagtcatgtgtctctttattactcttgtgtatccatcccaggaggctatataggctgcctacagcattcctgctgttaatgtttttgagcacctactgtgtaccaggcactgttctgggcattgcagataggacagcctggagcttggtcaaaggagtcactataacccaataaaggcagaaggcaatgccgaggagcagcgccccagctgagctgcagaggagtcatgtgtgcgtctcagagcacgtgtgcaaaggaacatgagctaataagcaaacggggagcgggagtgtggaggaggtgctgcaggtggaacagagtcctccccaggcacccagcgctgctcccagttcctccctactccctccggctcctgaatcccactcttgctgccacagctcagcccactcagccaggacaggttaggacatcccacgcggcatgtctccaataaactctcaggaatgtgccagtttgttacagctaaactgggtgggagggaggagtgagtgcgtggtgctggtgaaaggtgagtacctgggacaggactctgatggtcagggccccgggctggcagccaaaggtgctgtggctgtggtcctcaggggcagggtctcacatgaggctactgctcccacagcttctggaggaggcggccctgcttggcgcaccatccagaggagctgggaggacacgagtccttggagaaggccactctgccagcagctgaaagcctcgcgtccttgctacttaatgtgtggcatatggactgcagcatctgcaccactaggaggctggttaggaacacacagtccagggccaaaagaatagatgtgcatatgaacaattcgtggattcaagctggagaagaagcaccttaggtgacttacttaagggaaaaatcccatgggtctgcagggaaggggaaagtccccgccctcagccaggccaagccttctaagggatggtcaagtcactggcctttccagtcaactcactggtcaggaaggaagggtggaaggggcagcccagcgaccggggtctttaagcaggcaggaaagtggaggggtcaggaacagagctgaggccgggagagggagggaagtgagcaggaagtgggggtggtgggggaaggagggggagcgcctgccaggctgggtgaaggctgttggccaacaagtagggcaaggagccgactgcagctctcagagggccgctgacagctccccagaacccgatcatctccgcggacaattaaaacccggctgtctcaagagcgagccctggccgagcccagcccacctgctgcagcagtggctctggctccagccctcttcttattgcacacacatgggctctctcacacagccacacaatcgcacattctctacaatcctcacaccactcatcagggtgcagctacgcatgtgcacacccgagcagcatgcggagtcttcccgacaccgacaccgaggactgcctgtgctactggaatctctgcctctctggggcatggtgcacacacaaacacacccttcccacaaaccggggatactcacattgtaacacgtatgaaagcattcacacacacactctgggatgtagggcaacatctattctgccccatgcacacactcccacacgcatgttctactcacatacctgcaggtacacacggcacaacggcacactcccacatgcatgcataccccttctggcaccgggtgtaggaggggtgataactccagggaacactcataagagcttcctgtgtgccagggactgtccttggtgctctccacgtctttattcctcactgcaaccctaggaggtaggggccatcatcattctcatttcacagatatggaggcacagagaggtcaaggcatttgctcaaggtcacgcagccaataagcagcagcagagctaggccttgaatccatgctcttgaccactactctataatactctatcccatgatgctcatggggggaaaccttcaaaacaggccctccttgacccccccagtttaaattaagttcccctgttatacggtcttggagtgcctctaggattttctttgatgtgaattatcacagttaataatatatttatgaaattttagatttccactcattctttctacaaatgcttattgggcatccacgaggtgcctggcagtgttctgggcactgaggcctgctctagtctctgtctgccccactgctgcccacccatgggggtggggatgccgcccatagtacccagcagggtgactttgacacagagcagcacccaataagaatccaaagagtgaattagtgagggcattcataaaacagactagactgcaacagcatgttcttccacactcgcacacacaggcgaagagccttgggatccaaaccttgcatgcctgcaatgtcccactcagcctcggcaaccacataccaccactcatgggccacacacatgcttatgctctaacacactcacacgtttgcacacacattcactctctctcatgacatcatacccaggcacactcacacccacacacgtgcacacttgctctaatctaatgctcacaccatactcaaagctacccatcctcacacatgcacactatctcctaccacattcacatccctcatcccacacttgtgaggacaggggcctgagtcaggagctccagtgggagacagggctagtgtaaagacgaaagctgtcactcagggcacctggccccagaaagtgaccatcttaggcagccagagatcctcctccaaatccacaaatggctccttcctgcttacccaaactccagaacttatgagctctgggcaccatgaagacagagttagtgtggacagcgaggtgtctttggggcattaaatgcctctgggtctagcagggaggagtggggcatggatggaagagtgcacggtggctacaaacccttgggagagaagaaagaaggtggtaaattcctgtcggaaactgtcccaatcccctttttcatggcccttcgtctgcatggctgaaggggtgcccccacgctgggatcatctgaccacgtgggctgtgaggtgcagagcccaggccagaagggctgcagtgaatgacagcaaagttgaaagttagccaggacattccaggcctcaggggtgtctcaggcagagcctgacacatgcacagtgggcagcggagggggtggcggggccaggctggacagcagggagaaaggtcccagctcaggctgggatgtggcttgaagcctgggcagggaccagcacagtggtcaagggctccgtgaagcccgggcaggaacagaaagatgattctgggcactggcattcagagcaccctaaaacgggatcatccctacggtgggggtccaggcatgcgggcaagggctctcagttctggggcaggccagaggggccaaagaagagggggtgggagaggaaaaaacacaggttcttaggtggtggtggcaggccctttctcgttagcactctccaggaagagactgagatggggctggggttgctactttgaccctgccttgccccctcctctggctccaaagcagagcagggtggtcctgggtgtccctaacaaagctgtccaaagtgctaaaagcctggtctttccctgtacctggagcaccctccctaccagccccaagccctcttgtgtcaaattacctcccagagctgccatcattcggggacatgggcctcacagcatgatcttcatggagctttccttgatctctggagtgggggctgcaagagcaggcagtggaaagtttatgcccacctgcatacctgcctcaggtccttgtcctgctgggcaaaagatgtgggcactggtccatccccaaggtgccctggatgggtctcaggtgtggcagtgggatgatctttcctgctggggcattgaggggcagaggaaaggcccagggatccggaccttcctcctatacaacagtgactgctgaatggcagagggcaactcttcagaggctatgccctaagctgctgtcatttgacctcaaaggcactcatgcttcctgccactccccagaactcctgccacagagttgtgtgtgggctccccgtctccctgctgtgcacatcacacttggggcccttctctgtccgatctcccacagagtaggacccagcaatgaagggtgagtgtggccccttccggctgagttccctccccctcctcctcactgtggtgtccttgtaaggagtgtaggggcagggatggtggagagacatgcccgctccaggagaaggtagagacgaaatctccctggagcacagcttcccccagctattcctcacccagcccaagaagaagggaccccacccttcagcctagaggagccctctccctgcccccgggacccagactctctatctcctcctctctgagcttccagagggaatcctaaggagctggatgcccaagaagacagccactgtagaaagctgatcagtcttagttctaaggcctggcttcaacacagaatgccatgattcctcaacatccaaccaatgcatccatccacccactcaccccaccagtccacccatacatcagtctgttcatccatctgtccgcccatccatccatccatccatccatccgtcagtccgcccatccatccatccatccatccatcctgtccccatctctctgtccatccatccatccatccatccatccatccatccatccatccatcagcccatccatccatccatccatccatccatccatccatccatccattaattaaggtcatgttccctgagctctgtctgtaccaagccccgggttctagggtcaaagagatgaataggaacaatctctaccctcaaggagctcccagcctgatcagagagatatgaaggaagagaagtgacaaggcagtgtgataagtgcagttaccaagccctgagcagggagctgctgaagcacatctgccaaagcctggaggagctgaggaaggcctggcagaggaggtgacatttaagctgagtcttaaagaatgagtggcagtcttccagccagagttgtgggggagaacacattccgacttaccttagaggtgtcttgtgacagttttagctccacaattaataactttggggtcaaactaaattctccccagccactgagctcaaaactaatgcagtcatttcagatctcggtctaggaattgcagcctcacagaaaaaaatagtcacccacccaacccaaggatacaaccctcccttagaaatcctagcacatccatttaggggactatgctgcagccctggctggctgagcactcctctgcccactcacagaaattctgatcaaggttgaagtatcagaagcagatcccaaagcaatgaacacaccatgtccaaagtcaagccagtgggttggggaggcagagttaaggtcacagctccaagtccatcaggtgggcagcactgaggttcgattccatgtctgctcagcagagctcccctggcagcactgaggttcgattccatgtctgctcagcagagctcccctggcagcactgaggttcgattccatgtctgctcagcagagctccccaggcagcagaccctgaggcaaggatctgagttcaagcgctttatttgggacttgctcctaggaaacactggtgaagagaggggaggtgaggcagggaagggaatggagccaagaaggggagtgttgctgagcagataatcatcaagggcaacttgggctcaatcccatggggaggtgctgggagacatatagactacctcccaggatgatcctgccagaggagcaaagaagctggggtattcatcctccaatccccatccattattcaccaaggctgctcctgaggcttcagcaccccagcttccctggcctggagaatgtctccatggactcttgggtgcttgcagcaaaatcctgctggcatgactggaacggtgggtgcatgggtatatgggtacagcccaggccaggacctccaccgacaatagcaggaaggtcacgacagtgatagatgggctgtcctctgagatgaggcaagtcttaagttccagacactcaaaagaaatctaagtactgtacctaggaagacccaactttgcacaatgatcagggactacccaagcagataaatgtcatccagatggcaagtgcctgctttaatagaactcaggcagggcacgaaagtcaccaggtcagaggggccaagagctttcatgcaaacgaaaacctgagcctgaggccgagtatggtggctcatgcctgtaatcccagcactttgggaggccgaggtgggtggatcacttgaggtcaggagttcaagaccagcctggtcaacatagtgaaaccctgtctctaccaaaaacacaaaaatcagctgggtgtggtggcacgtgcctgggatctcagctactccagaagctgagacatgagaatagcttgaactcaggaggtggaggttgcagtgagccgaggtcgcaccactgcaccccagcctgggccacagagccagactctgtctcaaagaagaaaagaaaacctgagcctgggcccatccttccagagtcccagctccggttccagggcattgctgacccagtggggcaggagcaatgctgcagccagcacttgccctcccatctctggggcagcaggaagaagcatctgcaggcgttgggaacacccaagcccgcccagaggccctgctggcagggcaagaagcaaccgtggccgccggccagatgggcagcgacctgagagccctttccgtgggaggacttgggatgtgcccagagttcctgtaagtgaagaataactttactcctgagtgttgcaaagtgaaactccacaaagtgccgagtcacagaaaacgccaagattcttcacacatagaataatgaggcaataaaactcaactataaagttaaataatttaccataaatatctaaagctctcaaattattctctacattaactgcctatgtttaaaatgatctttgcattcactatgtcacagatggcaaaagcagacaagagagtccttgacaactctaactgcaattagcccttcccagctgcggtgatttaaaggccttttcagttaagctgaatgaaacacccgcgctttataaataaaggctttaccagggctgacaatgaagtatttgaaacgtacaggcccgagctggtggagagggggcggcggggaaaggactgtcactacatcctaaaactgaagccctacacacccttcaacccaccacctccccagcctcacactcacgtgatgctcagacacacctccctccctgcacaaacacaggctcacgccccactcccctccccatagacacaccctcactcccccttcacattcccgtacacatgctccatggtcccgcaaccaagtacacgcatcctctctccacacacacacgcatgcacataactgaagaggttgtgcgtctccaagaaaggtggctggggtcatgagaaatattccagcacgtaaaggccaaatgaggtcagttgtcttgagtgggacacccaagtgccagtgcttgtggccaggcccaggagccctcgcctgcacagctccagctggcagaggaggaggaggaggaggagttctgtctgtgctggggaggagttgcccttcaacaacacacaagcaccttggagacaagagttaggaggcggctgcggcagtgtgcgaaggaggtcaaggttaccctgattgccgccaagcgctcctcccgggggcctggctggttaattgcttggagtctggcatggcagagggagctgtcagcaaaatggcccctctgaatcacatgcttggatctctgggatcctcctgggggaccaagtctgggcccccactgcttccctgcccagtctctcccgtggcacagtggacacaggccaggtcccagactggctcagaaaagctgggtccatggggtcttcttcctgcatctcctgtgggaaccagagcttgtcccaaccacaatctcagcctgaagtagccctaacccatagcctctcccatcctgtaccaacaatacagtgataaccgtaccccacttttactgagcaatcacttcataccaggcaccatgctaagcccctcccagacattattccttttgaggctcattaaaatcctatgaagcaaatactattattcttacgcttgattcggatgggagaatggaagcacagggaggctaaggtaccttgcataagggagggcagcagggatcaagtggggcggtgtagcttctgagtggacccttcagcactgcactggacaaggacctcctgcttcatgcccctgaagcaggccgtcctgaccacagccttccagaaacccggacctgcctggttgagccctgagcccccgcccagcccttccagtgcctcccttaggcttgggatcctgtttctgaaatatgagccagccttgacagtcacgatgccccatccacccgactgggcacctcctgtcctgacaccatcctgctgtatccgctgagctaggctgtccctgcatagacatgtctaccactcctgggccgccatctgggtctcccatcacaagatcctgcttctcttcccaacttggaagggcagtacccttgcaccagggccagcaatgttccctgggtctgggagaactcccaggaggagctggcttcaggcagtctctgaggctgctggaggactggcaagaagttctggaaaagcatttgggctcctgaagggctccaccccagactagctctcattaatttgctgtttataatatttaaattccagggagctgcctgggctgggactcaacttgagaaggagaaaaataaaacttattctatttctgatgacaaatgaaggcatttataggagcttgagataaagggatgggagggtgactatagatgcagtcacaaggggctggtctgaggtctagagccactgggcagttgcaaatcgctgagcccagggccctgggagttggtggccagagttccagggagtggagagggtggcccctggagataggacagctggggtcagatgagaaggcaagtggctttgctgcagactcaagtctcgaccttgctggggccatgagcctcctggaaagaggcaatacttttacctccacagtcagtgtgggtctggagagtggcttcagggccccaccccacctgaccatcctcacttccccacaactgctccttccttggcagggggcagagagtataaattgattaccctgaggtgcctaaggaaagcacttgagccccagagtctgtatcaccacttccttgctgtgtgacctcaggcaaatcacttcacctctctgagcctgtcttctcatctgtaaaccaggaacactaaaccgcagctcatccaggattcaacaggctcgtgtgcatgaggcatctagaacggtgtaggtatatcataggtgcatcataaatgcagttccctttgctctttcttcttcccttttctggactccccttcacaggagtcctagatgatcacagatatgaccctaaaggggccacagacaccatcttccttaacttctgcatttcacagggccagagtgaggcagtgagcagcctcaaccacagagtaggccaacagcagaggctgggctcaagcctcagcccagcctccctagcaccccagctgtcccagagggtcacctccatgggaggctgctggataagcttcctgtctacaaccttcattttacagatgaaatcaggctcgggtgtgaaaagcaacgtgcctaccacaggccacaccaccagccagggagagactggaacgccaactcatgtctcactgactccaaagggagctcttcccaggaacctcacattccccagttgaactccaagatccctgagggctgtagccctgtttcaggtcatttgctttccctggcatctgctgagggttcagccaaggtccagggaacaaagagtgattgtaacagcaaaggttctcagtcgggtggtgaagagggaccaggaccagtggctgcctctgcacagaagtgccctgtatcctggcatgtcccaagaggctgtgactgatggacaagacttggcttggggcagtgtgctgggcagagctggtgtggccagccctcagctgttcccagcagtagatgggctgggaaggggactgggaatctgggcaggccaagcctggcagtaaaagaggacctggggggtggttcccaggagaaagcccgactcctagtctccagtggagctgacactcttccattgtctgcttctccttgtgctcaaatttactcatatctctaaggatttggaccctgggcatagagatgaacacgatgccatcttccgcccttcccaagtttgggaaagcaatggaggttgacctcaaagacaaaagtgcccagatgagagaggtcctgaggcaggatgtgcaaggaaaaaaccaggagtgtagtgaggcaagaccctgtgggcctgcaggcagggagaggctggagagggaggtgtgggtgggatggtggggtcatagacgcccaccttgggaaatcagacagcctgagggcaacagggaggcatggaatgactggaagcagaagagggccataatgaaatgttcacgttacaaagtcaaattctggtggttgaatgacagaggctggatggggtgggcttcctaaaaaatactgagtccagtgaaagatggggccagccacagctgaggtgctgttaaaggggaaggcaaagagggatgcatggctaagatgtagagaggtgaagaggaggagacatgatggttgatggatgtaaacagtgaggggacacctgttgagtgctcctacctaggctcagtggagggcagtacttataaacatcgtcatgagcaagaatcagaatagctcacatttatggagtgctgactcagcatcctaagcggcttccatgcatcagctcagcagatcctcacgactctgtgaggtgagtacaccatcactacccacattttacagatgggaaagccgaagcacaaaaaggctactgaaccaggattggaactggacagtctgatcccagggcctgaactcttgttactttactgccctgcagccctgagatgggatggtaagtcagtgctggacatggggactccaagctgtcccttggacatctgggttcaataaccaggagaaaatggaagttttagaaacatcagtgcgaacatggcagatgaagtattagggtgggggtaaagggggcaaggggaggggcatgttcaatggatcagccatggaagaagagccagagaggtgaccatacatggcaaacctagggtgccatgtgaataggtagcgtgggagagtgctgggacctgatgcaagaagcactccagctggagtcaggaggctgggcctgagagtaccactttgcctcttgttggatgtacatactgttttatttctatttagatatggagtattgttctgtcacccaggctggagtgcagtggtgctataacagctcactgcagcttagaactgggctcaagtgattctccgcctcagcctcctgagttgctgggactacaggcacacgccaccccaccccgcctggatgtgcatccttgaaccaatctctcaactctctgagcacttgtgcccattttcaataaagcaggacattaataatactcagtgcatagagcatttgggaggataaaacacaacatccaaaagacttgttaacaggagctctgatggacattaatatgcatcctcacggtgaagtgatgtgaggctggcaaggtatatgcagacaacaagtgtgaggcagagagggggtgtggtgggcactgtgatgtgctcctgggttagtcccctagagccaggagtgccctcagccagcacctgcttttaggattgcctcagctaaagaaaactcacccaaggtcatgcctccttccaggggtggcccatatcgaataactgaccaacacaggggctacaggcctggccctcttgccccaatacaactcacctctgcagggcaatacagctgcagagccccactggggctgacagaggccttttttatgactgcactgcagctcaatctaagcctaatcctgcttccctcccttcttccccaggggaggatcacaagcacagtcctaatacataccctgccagaagcccaccacaaccacacttcaccatccagaccaaaagactccatctgtctaggggacccagcccatgcatggacagtgctggcccaatgggctgctatgatgacctctctgaggattccacgcatggtccagctgtggggtcaacatagatcagggttacccccttttccattctcagttcggtgacctaaaatatgttacctcacctctctgagccttggtatccccatctgtcaaatggggataataacccctaccttacacaattgcggtaaactaggaaactcttctaaagagcttcacacgctacctgttaggtaatacaggctctgccttcaaccgtttaaccattaaattttcttattcccatttatcaaacaatttacaaatgtccaagtttcaagttatttaagctgagtaaccttaagcaagttacttaacctctctgttcttcagttttattacctatgaaatggcatcaatctcatagggttgttgtgaggataagcaagttcatctgtggaacactgatagagcagtatcttacacacagtgattctccataagtgtcagctgttaccttcagaactctccttttgtgagttggtaccaagaacttaatgcaatactcttggctgtggcctctcccatgcagagcaatgtggtactatctcctcctctattgtagagcctttatttttaataatgccatccagaatttttggatagtgattcttttcagctgtcacaccaccctgggcatcattctaaacttcctggcaaaaaaaataacaataataaaaacgaaagaactctaaattttttaacacacacttccagggtacgtgttccctttttgactcaggttagattctgaacctgcattgggaatcacacctttctctctgtgacagttctccttgttcaacttcattcagcccggtgagagaccttcacaaacagcagaccaaagagagctcacacatgagacggacagacgctgccggtgacctttgcagagcggcaggcctgagagcaagctgcggaagcctggagcttcacagatgcccaccagagggagggagtggtttcatgaaacctacagagccatctagatccttgcaaatgttgctgctgtcatccgatgtaattgcaatttcccacaatttgacactacacatgaatttaataagcagacgtatacctgccaccccatcaataataatcatcatcattattgttcatggtgatcatgttcagtcaccacagattgatcatggtcagtccaccacatctgtcgaaggagcagcccttgggcacctttgttttgcattttaagacccctgctctcagcttcaaatgattgactaagcctgggggctcatccacgggatggccagggtccacaaacatggcctccatgtgaaaagtactaggtaacagccattatggttacttctggctatttctctaagcctgttctgtacattggctcaatgtctcagcatttgaaactcctggggaatgatgtcttccaggaatcacatcacttctcacaagccttcatcatcaaccatcactccttttccatccttggaatgtgtctgccataaattcagtctcacccaagagcttcctaagaaaccacacagtttcctcaggaaccagcctgttgccttatcttcccctgggttggtgtgcagccacactgccagaaacaggggcctgcagttttcccagttctctgagatccccgtctcaggccatggaaccctgctcccgtgtcctctgagcttcaaaagttcaggctgcatccttcccagacctcacaaacagagctggcaaggcacttcctcccaagttctcatcatgccccttcaccagccgccttcttggccagaattagatcctaagtagctcttttggtcacattctctttgtgctgggagctgggctgtgatcaggtgagtcaagaattgatcagaggctctgtgctgggctgagtatactcgtagctgatgtctggtggcccgagatcctccaccacctgcctctgtgttagcctgtggtcagcaccatccacttcttccacgtcaggccaaggtcagagagagcaccttcatggaccagatccaaagtgtccaaggccctgcttccaggatcttacggaaaaaggctcctgacaacaagtgggaagagatggcctgtgttgccgcaggcaagtctgtctaagccttgatttcttcacccataaaatcacacctagctaatcacgcctaatccaccaggctggaggctgaaatgagatgacgcacattgaacacaaggcttatgggtagcagctcattctaagactcttactccctctgggaccacttggtgagctgagcaatggacagaccttccctgttggcccactctggtcaggacaaatggcattcccaagacctggattctcagtgccaaaaccgggacaagccaagacacgcggggcagctgacctgcaggtcctaaccagaggacagggctactcaaagagacttgactccatgtcatcctaagctgagaaggaggtgggagaagaggtgaagaccaaaaagatgtgagaaaaaagttggatcttcacacagacaggtgtgtctgtggcctctacctgtcagcttccccaccgggcgctttcctcattcctggtggggaacagcggtgtctctgtctgtagctcccattctgctagaacttggtcacgtgtggagggataagaatgagcttccaggggctgtccagctctccccagctccgcatatccaaggatgttgggctggcgcctccctgtaggacagtggctctcaatcggggatgattccatctccccaaggatatttggccatgacggaagacatttttggttatcacagttgtgggggagggtgctactggccagggatgctgcgaagcattctacaatgcacaagatagcccccacaacaaagaattatacctggccccaaatgccaagagtgctgaggctgagaaggctggttctagggacagccagaagaagccaattccatgtagggaattgggaccccaagggttcagggagcccatccctctatctctaggagctccacctccaaggacttacagattgggcctccacccaaccaagtcacaaccaaaagtagacaaatgtcagcggcaggccctggaagcaggagacagagggtaggggcaggcactttgggcgtgaggctggcaaggagcaaggtttatggcgcgttctgttcagagttttaattacgtgtctcaaatcaggatttaattgggctgtaacaagccaggctattgtatgcaagagaaacacctggggattattagaaaacatttttaaggcagtaaagctgcagcaaacactcgcagttgttaaatcaagaaatataattccagagctcaatgacaaacacagagagagggagctggcccccctatactccatggcactgggcaggggggcacgcgagctctagagagatggacccaggtgggtcaggttgcaaccacatctggagcggtggaggtgcccccaggcagagggactcagtccaaagctgttgccagcttctggggaaagtgagggtggccaggcccaccttgggaggggccgggggtgaccacactcagtctgaggagtgccgtggtggtcaggcccagtctgagtcctaagagggaccaggaatgaccaggcttaaagctgagtggtgcccagggtggtcaagcctagcccacatcctggaaaggaccaagggtgaccagatacagcctgggagggtttggagctgaccaatccagtctaggaggagccagaagtggccataccaggcctagggagagctagaggtgaccaggcccattttcctggccatctctatctctccctcaactagaatttaagccctattaatccagggtccagggtctgctttatttcctgctgtgacttcagagcatagaacaatgcctggcacatagcagcaggcatagctgactgactgactgactgaatgaatgaatgggagggggcagtgttgtccaggctcatcttataggggccaaatttgggcctctagtccaagtctctgactggaagacactgggacaccagcaaaacaggtagacattaatctgatccatatttggggacagaaggccctggctaaaatgcagctgccttctactagtgaagaggcctagcaccccaacatcagtggctcttcccgtcaggttaaaataggaatcttccctgaccgtgtcctactgctggactccccaacaccctgtctcatgtctgttagggcctgaccatagggcttgtaacttagcattgccttcccagtaagactgtggactccacaagagacagcccatgtctagttgactctgtatctctagcatcagccaagggtatagacacagaagatgcttaatgaatgtctgctggagaggttgatgcatgaacgggttattgacacgcatatgacagcagcgtcttcttcactgtggtcatcactgatcggactccccatgtgccaagcactgtgttcagcacatcatctcacctgagcctcccgatgggtttgtgccatggggttatcatctccattttatagaagaggaacttctacaaaagctcagagaagccccctttacttcactctgttgctcttcccagggtcccatagtgtcaaagggagaccctctccagtgacagtttgaatttcagtttgaggcagtaaggaggagcatagcaagcctccaggtccccagaaccactgaagggcccctccaagtggctaaagcccaaggggcttctgaggctcctgccacagtgattgaatgtccatctagcagggtttgcagctcccataagagcctctctaacctctgccctaccctactctgcagaactttggaagtgtgtgtgtgtgtgtgtgtgtgtgtgtatgtgtgtgtgtgttgggggtggggagggaaggagcagggatgggccccccaaccatgaacagacctgggagggtggctcaggggaacagatggggcatggagtagagtggaaggttcaagtgcccaacgttggagctcaagtacataaagtagagggtggggtgagtcagttacacatggagggaaccccaggaatcagggagggatgttcaggagcacagagttgggggtctgaggggcatggtctgggaaaggtgcccaggtgcaccgaggtgggagaggaagctgcaggggcaggtagaggagcagagaatccctgtccgagagcagatgctgctttctcaaaaagaagtgaactgcaagtcgggagccgggttggggagccaggtgagcaccagggcaggtagacagcacaggacacagcatctgaccttcccacttgcctcctgaaaaggtcctttctggaaaggaccctgaggtcctaattccatctcccctactcaccacccacagaggcctgaggcagctggaaaggggccttaaggtaatgatcattttaatctgccccacctcagccaagatccttcagccccctcccctagaagcattgatctatcacaggtccaacacagggcctctcagggaacactgagcccgctcctacagaaagcacctgcagggcaggcaccaatcacagtgccccttgtgggggtgacatatcccagctgtttcaggtctttgcttaaacagtcttctcaatgaggccctggcaatcctgaccccatcttctatttcttatccctgcttactttgtccccttagaacttaccattactaaattggctgggcatggtggtgggcacctgtaatcccagctacttgggaggctgaggcaggagaatcgcttgaacctgggaggcagaggttgtagtgagccgagatcacaccattgcactccagcctgggtgacagagcgagactccgtctcagaaaaaaaaagagaacttaatattactgagcacactccacattttactttaattatcatgcttctggtgaatgtccccataggatgcaggctctctgaggcccaggagttttgctcttttgctttctgttccctccctaatgcctggaaagtactggttcacaggaagcactcaagaaatagttgttgaatggatgaccttcagaagtccactgtctcatttcagccctcctacggttaaggttgacaagacaggtgttatttttattaccttcatcacatacatgagtgaataataattacagtaataatggctacttttattgagcatttactatgtgccatgtcctgtgaaaaatgtttcatgtataacctctaattaattcagtctttacaacaattatatggggtaagtgctattaacccaatttgacagagggggaaaatgaagttcagagaggaaaatgaagttgagagaggaaaatgaagttgagagaggaaaatgaagttcagagaggtaaaataacttgcccaaggtcacacagccacttgccaggcaccaggctgagtactttatgtggacaattatatcattcaatgcctacaactattttacaaggcaataaactctattttacagaaaaggaaactgaggtccagggagttgcagtgacttgttaaaagtcacacagctggcagggtgcagaaccaatattcaactccatggctgtctgaatccaaattcagtctcctttcccttaggcagtaagcatcccatcagaaagggcattcagagggactggaaatcacagtgggagaaaaggtgagctttgaaaacagcagcgcagatccaaattcctttctcaggtcagaaagcccaagggagtctttcatctccaagatccacattcaacaaatatccactggcaaataccgaagcattgcactgggcacctgattccacttaatcctctgccaggaaggtggtcagtggtacctggctacagaggttaggatgtaaaaggtataagatttaagcagtccctgcttcagttcccgtcaataactgtccagagagattcctgggattatcaaccagcaattttcattcagaacttaaagaatcaaatgcctttagatgctgcaaatgtgtgctccatgtccccatcctcactgtccatagcactcagaaagacgagctcccatgagccaatggcttcttttcattgtcacaaagcaggaatggctgtgatagacaagtggtccttcatctgcctattgtcagaaagaatagtctgagatcaattgttctaaagcaaaaatcaattgtatttggcagttgtcctctcaaatttaacaagtttatattcaataactccatacattagggaacttaacttagttacttccaggatgttctgcagccaattcccctggcaggaaactacactgtaccagtcctggccttccccaggtgcacgatggaatttctccctgctcatggtggggacctggaatgtctggtaaggaaatcttccaggctagaatcatcacaccaagcagaggcctggccatttgctcatttgtgggaatagactgagttactgtcttaaagaaaaaaaaaacgtggatcctcctccttgccaaagtgagaaaaccagatccttgagaggttcctcaatttcctcaaaagaaaactcttagtttggattttcccagaggcaaaacctgagataaagattgaagtggaggtagtttatttgggaggtgatctcaggatacacaggtaggggagaaggaaatgagaaaggtgaaggacggctgtgcataacaggtgtgttgtcaagcaaattaccactgtgggtgaccggagctcagtcttaccactggggacctctaggagacaatgtggaactgcctcagaggcctcacaactagggagagaggaagctggggttgtgatacactaagtccatctgtcattggatgaggcaccaactctgccccttccagcaggatgttcctgaagccagaaaaatgctctcagagagcaacaagcatccaaaggggagtgtacccagcctcaggactgcaaaagacaatcccctgcagaagagaaagaaagtactagcttctgccaatgttgatttgaatctcatccctttcaattacttattttggggtatgatttacaaaatacatagtagattaagctagttgcatataacaaagaaaaaattagatttactgggggcatactaaaccttgttactggttgggcatatagtcaaagaagcctgatgatggctgctctaaattaaatgagagtttcctccaacccaacaaccagctgagtcagaccttgctggggatggctgccttaaccacctactgcccaatatgaagtaaaggtgcgatggagagaaaaacagcatttcggagagtgggttgagaagcaggccagccaccactttctctagatagtctaggatttatccttggatcaagctgtgcacttgaactgcatcctcggctccttgcgtagtttcactccctaaactgtgtttcatcatcatgtcttcaggtgacatggagaaacagacagtaccagacatggtttatgaaatctgctagccactggttagaaagatgttgcatttattttctttctttcttttttttttttttttttgagattttgagccagagacttactctgtcacccaggctggagtgcagggacacaatcttggctcactgcaacctctgcctcccgggttcaagtaagtgtgtgccaccatgcccagctaatgttggtatttttagtagagatgagattttgccatgttgcccaggctggtctcaaactcctggcctcaagtgatccacccgccttggcctcctaaagtgctaggattacaggtgtgagccactgcacggccaatgttgcatttcttacagcctttcacataaagctccagataagaaaacatattttaaaataaagggttaataaaagctgttgtttttttttttttttttgtcccagaggtactagggtgactttttccccataggaaagatacagtttcccttttccctttggccaccagggagcgtagagtcaaatgtttggcccgattatagcaactattggacatcatgacttaactatagcattttagttttgctgctaagaaatataaactttctagtttatatttttcctagtattaaattatttgaatgaaaagtgagctatcatattaaatgtaattcatgtaaacaactttaaatcatttttgtgaaatgaaatggaatagttactatttcattcattaaaaattaagcccagccaatggcccaaattatactttcagacactactatgaaacattatcaatgccctcccaggtcaatcccatatttcagctcagttggccttggacatgcatatctttcttcagcctccatggtatcagcctcaaaaagtgaagatgtctgagcttctggatccggaggtggtgggggtctgtctggccaagtagctcccagcctctccttcctgcccctggcccaaatggcactgccactcactttgttttcatctgtacccttaagtcagcttctggcttttctgagcactggctacaaacccatgtctctccccaaactcatcttgacctctccttaacttgtcttgcaacttttcctttggtccccaagacagccccttgggtgggtactagagagccaggctgtccttcctctctgctgtctccatatttacaaagtctgagtccagctccataacctgccaccctgctgggctgaaggggccatctcccacctcctgtgcccccctcgtcaccccacaggctccccagctcccacactcttctgctggatgctgccccactgcagaaagaagggagaggagggagggggctgggaatggttcctgccacctgttaggagccccaaaacgaacttgaggtagtggggaggaagatgaaatactcgaggcagcactcggcccaatctctgccttggcacccctcttagacacacggaccccagaaaacatcagggccttgtagacaaaggaagccaccttctaaaaaaaaccccacacatcagagggcagaagaaaatgcaacagggcaggaagtcacatgcttctgtttcgatctaatccctgctccagagcccaccctccgagggggctcggacaagccacagcaccttctctgagtctcaatgtccttatctataaagcagagataataataccagcctatctcacaggagggtgtatcaaatggaaaactgcataaaagggctttgaaaaggataaagaatcacacaaagaggtagggaattgttactgcaattgttccctctgagagctaagtgaccccagaagaaccagggagaaattgagcttcgggttgtggagggcagtgggggtctggggtctgatcagcagactcccagcccccactttcctgccccttgcccaaacggaatcaccactcacttggttttcatttgtgctcttgaatcaacaggctttaagtcttcacagcaggtcttacggggaccatggcagggagggacatcaggtccctccccaagcttcatgcctggcatgctatggtcatagctgaactctgtgtttgcgtatgtgtgtcctcaaaagctgtccaatggaagagatggcacatgtgtgacttaggcagggtgacaacaatggggacagcgattaactgcagtgcctgcagcccacactgaaaatacacctgttatgtgtaacttgacttcctcatccctcttcccactcttgagaccgctgtgttcccacctgcaggcccagccaagaaaaaagggacttgaccagcccggcccagcactgcaggaagtcagcaccatcaacggccccagttggccagctggagccctaactaggcccctgggtgtgatgcagggttcctgccttgtttcctgggcttaagtgcctgtctcagacacctatctaacagcctcttccctctaaagacagtttctctaatgagagaaccctcaattctattttcacctgctgaacttaacctactcctgcgactcccactctgggctctgttactttctggccattgtatgccccatgctttgcctccctgatggccctgcttgcctgggtccccacctgatgccagatgccagcctctttggacatcataatctgtctgaaaggaccaggccccataccttacctgtggctgcatctctgtccccaccttgcagcccactagggctgactctggcctcctgggcagctccagtcccatgtttcccatcacatccactgaaagccacagaggaatgctgggcgctgctgggaggccaaggaggttaaggcatgcttatgtcctagatctcaaggggtgtgtagccaagtccaaaagcagacacaatccccagaaagtcagagaacaacaaaggcactgggtccctaacaacagtgctggagttagcaggagggatcgccaggggctgggccagccagggggaagtgggccaagccttaaagcacagaacgatggtgcacaataaagacgggagggctggcctggctgcaagtggctgtcagagcaaagacgtgacagtggggaaactgcagatcatggcatcgtttgttcacttgtcagtcattcatttgttcagcaaatattaattgagcacctacaatgttctagttactcttcaaggcactgggcaacctggaataaataaagctgacaaaatcctctgtccccgtggagttaactctcaaggggatttagggctgcttctggggacacagaggtagatgggggccagattgtggaaggccttgaatgctgagaaggctggacttcatcttataggcagtggggagcccttgagggtttctcagggagggtgaggtgacctgcagagacatactggagactgtcagaatcgctagcctgaaaggggataaggcccggagttaaggaggatgctgtagccaccgggagaaggcggtgcatttgaatctgtgggagtgagatgatactgactcaaggaggcctggtgctgggaagcctcctccttttgaaggctgtctgcatccttggggactgtggctccctggggtctcctgctaaatgcacaattttcagagccatgtatgaatcctagaccttggagggcagactccagcggtgttgactggggcagagcttctcctcctgccctccaggccttagccctctggcacccacagtgacctcgataacgcaacgagggaggaattcaaaggcctggcaaggcctaaatatagccagcaggccacgtgcagaaatgctcccctgattttactaaagaacagaggttgccacgttccactggggactgcactttgtttcaaaatcatgccagccaggctgagcctgatgggcccttggagctttctttaaacacagagaaaacattaaatgattttctgcaaaagcctcagcatgagaggaggaggcagctaatgggaggtttgagtcaatgccccacaggactcaggtgaacttactctttaaaaatgtaaatccctctggacaaagggcagtctccatgcaaaccaggcacgtgggctagacatcagagcaggagctctgttctgagttacctgcgggcgccgcagagtgagggaggtggggcaatcaagaccagcctgcaatgaactgttggcagctatgcgatggatcctggaggggctggagcttggctgtgctcagcaccttaggaggggggtacaattattgtcttcacttcacaggtgagaaaattgaggcctgggaggcgttaaggaactttccaaaggccagggagcaagctagtggtgcaaccaggactggaactcaggtctgcctatcaccagactcgcttcctatgacccagatgctgctccatggcccgagtccagcagccgtcttccctctgctgtgcaaggctcttagatgggaatggaggcagggagtcagaggacaggcccacatccctgccttcctgaggccactcctagggggcacagctagcagaggctgtagcctagacaaaagaaagggaacacggcatagggcaccactacatgcaggcactgagcagatgctccccacatcctaactcatttaggtctcccaatgaggtgggtgctgttattacgcccattttgcaggtgaggaaactgaggcacagagaagaaaagtaacttacccaaggtcaggtagccagtaagtaacagagctgggagtcaaacagagctgggagtcaggctggcacctgactctttgcttctaacactgagttcaggtgctggagagtggaagaagagggaagagtccattccttctgggagtgtcttagaaaacctgctagaggaggtgggatccgatcttgatgggtgttgggaagggccctccagagaaagaggacgaaatgaacaaggctcaggagaactgatgcatggtggcattcgggagccaccgggcctggctggggatggggtatcaagctccttgggaaattccagatgaggacgcacaaacgctcccgcactatgtgcctactatgcgtcaggccttgggctaggcacttttgaggcgttttcccagcactatcagccacttacaattggttcaacaatgacttctttacttcatggctgaagaatggtgatcccgcaaaagcagtgaagtgacttgtctgaggatggttgagcacagtagaagccatagaagggttatgaggagggcagtgatgggacacaggcttcactgtggaaaaccgagcagcagcagtgggaggtggaagtgggggccctaatgcagggagcatcatgagcccagaagccaccgcctgtgctgagggctcgagtgctcttcagtgccctggatcctgcattcccagaagccccaggagtagagtcattgctgcaaaggtgaacgtgcccagcacaaacctccaagagaaacaccttgtgtctcacctccacctcttcttctctgaccaccacatatgtcccctcccagcacgcggaggggcctggttgagaggctttgcctgccactgccaagtggacttacggggtctcgcaggaaaagcagaggctggggtagaaaggaagagccagacttggggctcagagggctctaggtgcaaaggctggctctacccttaccgagcggggttcccctgggcaagtttcttcatctgctgagcctcagcatcctcatctataaaatgggagcaagaagcctccttccattgggtttgtgtgaggactgaaatgattgcataaagaaatcgcccaggacagtgccttcacaagctgcagatggagagcgaacaaacgccatgtgggcacaggggcattcactgtaaaagtctttcaactttactgtgtgttcaaaatctttcataattaaatgatggagaaaaaataaataccacattttccctccctgacattggcccagacaaagcaatctactttgccacatcttcctggctgttccacatgaagagacggggacacaggagggtgggcaggtcacagggagggcctgggcagtgccaggccagtgtcctgtctccctggagagctccatgcactcaccacccctgctcccagacagggatggccccgcttgcctgatgtggtctgagctccactgcctccaggacagcgaggtcagaaaattctgacatactgatttctgagaaatgccagggagatgaatggtagccaatatcttgccctgagtcaggagagaattaagtcattatcatagaattacaacaatggaataattccagcccatctccctgattcttttcttgctaaaaaggaagaggcagctgtgatatcgttaagaccacggactctgaagccagactgtccgcagtcaaatccaatctccaccatttacttgctgtgtgaccttgagaaagctacttacccctctgagcctcaatttcctcatctgtaaaatggagatgtaataataataataataataataataataatatcaacctcgaactgttgttgtgagaattaactagttagtgcatgtgaaatgcctgacagatggtgagcactcaggaaatgttaagctactttatttggcttgattaaggaagaaaatttccaaggacttaatttcagaatgagtgggaacaaggtgaggattatggtatgatgtaggacttgtgatttttctcttctgatgatctcaagaggaagaggaaactgaggcctgggcaagctcagtgactcaaagagaaggggcaggtcaaggccaggccagagcctgggccccctcacacccccagccccagattctctgtggagctaggctctggcagcctctccaggctcaactcccagggagctcgccgaagcgaagtctgcatataaatcgccttagaggaaaaatacttcttcattttctcccttttcatttaaaaaaagaatccacagcactggggctgaaacggcagtgtgtatggctggaggggtgtgtgtgtatgtgtgtgtgtggtccattcgtggggagcccatgttaccagagttcagggaaatgtcagactcttggagaaggagattttaattaggctagagttgcctccaaaaagtactaaaattaaatatgaatccataatgcatcgcatcatagctaatggtatgcaaatggggctgggctgggctggactgaagtagggacttgggcaatcgtggtaatgaggaaaaatggcccctggctgacagcgacagtcctgaggatgctgtgggaggaagcaggggtggggactgttggggggagcttggagggggtggcctatgccctgttaatgggagaagaggaggcaagtactgggccagctgagcaggggaggcctcggcaccaacacagacacctagaaagaggggggagcagagtcttcagagaggccagctctgctgtatttaccgacatctttgggggtggctgggtttccaagcacggggcacttggaacaggagggcaactgtagtgcaggagaaaaagatccacagatgtgaatttgagttgtgcttctcttctagccagctgtgtgaccttggacacgtcacccaagccgggccactccttgctcagctgcaaattaagaaagacaaactcaaggcttcaatctcccagagttgcctgaggctcagaatgagttgtaaatatgttaagagccatagaaatggatacttattctttttactttttacatttattcttgagaaaaataaataagaggtaatgtctactgagtgctttctgttcaccaggcctcttatcccacaagatcctttctacaatcctggggaaaccaaggcacagtcaggaagtggtggagccgggattcaaatccagtgattttgattcgtgaacctactctggtaacagctgtgctacaatgatgctcctggagtgaagggggtgctattcataattacacaaggcaacagacagagccaggattaccccagcagtctccagtgtgcagtgtccggctgtaatgcttgtagaaagcacccaggagttgcccaaccttcccgtctgtgtgcgctccagcgagtcactgcgccatcgcaggtgtcagttttctcacctgtaccactttttttttttttttttttttttttgagatggagtctcgctctgtcacccaggccggactgcggactgcagtggcgcaatctcggctcactgcaagctccgcttcccgggttcacgccattctcctgcctcagcctcccgagtagctgggactacaggcgcccaccaccgcgcccggctaattttttgtatttttagtagagacggggtttcaccttgttagccaggatgatctcgatctcctgacctcatgatccacccgcctccgcctcccaaagtgctgggattacaggcgtgagccaccacgcccggcctacctgtaccacttttgtcccgccagtccaagtgtcttccatgtgctttccaactccagagcactatgattgcaccaggaagtccagcactatggaaaaatgctccgagctggagtcagggtggccacgtttaaatctctgctctgaaatcctgggtaagatgctagacctaaagaagtctcagttttcccatctgtaaaatggggagactaacggttcttgtcttgtaacattgttgtgacagtgaaatgagatgatgatgatactagcttacaagccctgagctctatgtagcagacactgctctgaacacttcacactattagttaattttgccctcagcagcgaaaggcagctaacatgagccagcacacagtgcttcccatagtcactcagttcatctcttccacaaccctatggggtaaatgcttttctagtcattttacaggtggagaaactcaagcacagagaggttaagaactcgcctgaagtcaggagtcaggattcaaagataggcagtggcttcatccgaagcaagtatgctcagcccaacacctgccttttattagcatgcagtggaggctggtgtgaagtctaagggggtaaaagttaacttcaaacatttgccctttggtaaggatccattaagattacatacacatggtaaactcccagcacagtagaagggctcaaaaaatgtacatgagtgaacaaatgagtgaatttcagggaagaccatgggcctgttatgactcctagctcttccatgcagagacgcatttctcccagcaaggctacgaatgatgggtcttgcaggcacaaggaggatgccaagcaacagtgatgccagggcttccagagtgccctggaaagcaaacctttttggggggacgtgggcagatggattaactccacctcccatgcaccacctcccccatgccttgggccagaataatctctgtctatggccccagagatctccaagtcctgtctgggcaggtgctggccgaggcagcaacacctgggagtgatacacagaggagaaaaatgggacaggaaatggcaccaaggtttttgaaatggaaaaagtgtaaaagtccttcctttgtgtgggaacgagtgccagggggccattgcctattgagttttcatcaaagtaatttattgatcaatacagctaacatggctagttcagcgattttgtaaaaaataaccatgtgttggatgcgagaagcactttgctggattgcgacaagcagggccaggcaggatcactgtattttatggccttctgggaactgggccctggcagctaagtctctgtggctttatcttcatgacaccaaaacatttggctgaagaggaaaaaagatgggccaatcttccagatgttttgtctacctggcagcaaatatcaagacgtttcctgtgcaaggtcacaattgcaaaccacgaggccaggaagagggttacatgttaagaaacgtgctggcccagagtcagaaggccagagtggaagggagttttacatttactaagcacctactgtttaccaggccctgagctaagcattttgacaccacatttctctgtgttttcagatgagaaaaacgaggtgggtactgtgttcccaaggtgacagagcaactaaacgctaaaggaatgattcacctccagatgtgacttcaagactttcctaacgcagcttttactagtttgacctggaataagcgatgtgaccttgctgagcctcagtttcttcatgtgcaaactggggctcctcagtcctgctctgcctaccctgctcactgttgggaggatcaaacaagacactcatatgaacacacttggcaagtcaaagagaattccactactgcagacggtggtttctcttcctgggataccccaaagcacctagcctggcccctgtattagtctgttttcacactgctgataaacacatacccgagactgggtaatttataaagaaaaaggtttaatggacacacagttccacatggctggggaggcctcacaatcatggcagaaggtaaaaggcacgtcttacatggtgacaggcaagagagaatgagagccaagcaaaaggggaaaccccttataaaaccatcagatctcgtgagacgtatttactaccaagagaacagtatgggggaaactgctctcatgattcaattatctcccattggttccctcccacaacatgtaggaattatgggagctacaagatgagatctgggtggggacacagccaaaccatatcagccccagacacaaatatgtgttaaataattcagcagtggattgagccagacagcccggcatcttgtcctccaaacatctgggtgcttggatgagtgtgtgtatgcccttccttcagatgcctgggctactcctctggcatgcacttcatggaaggagccaaccagaacttttgccactaaacttcccacttgtcttcagaataagtaggctcccttagggctctacagttccctcacctggattgaggactggccaaaagaccctgggagagaaggcccctccgctgccgagagctctgcttcttagccgtgcaatgctggatcctccattgctgtatcaagcacatgtttggaccaggctttggtgaggtccctagctggaaggggtgtcactcaccaagagcagctccagggaagaatgcagaggagggagaatgaggctgagccctgaagcctgaaagggccaaatatatcaagggtctacagtgtgaggctggcctgtgcctcagaccagaacctgggccagctggggaaagccccaagacaaagttggagcagggctttggaaatccacctcatcacatgcccaccctcatcgaatgccttgccccagccccttgcaccccaagccctagccacatgggccttctttctgttctttgaccttgccaagctcttcccacctcaaggcctcatacgctctgttccctctgcctggagtgctcctgcattcttcacaaggcaggcttctctcattattcaggccttagccacctctccagagaggcccttcctactcccaaaccatagcatggccttccaattgtttccatgcataacatctgctgtaattaagaactatgcattatttgttaattgtttgttgccctaagtagagtagatgaggtcccatgaaaatggaaatctcacctctttgatcatcaatctatattcagcacctaggaatgtgcctggcacatagtaggtgctcaaccaacatttattgaaggaaagaaagaagagaggaggaaagaaaggaggaagggagggatagggagggggaaagaagccaggcaagctgaaccgcagaccagcttctgagagccagcaaagacagatgtattccatctatagagttccttttctggcagattcttggacatcttttcatacctgaatggagtaatgaggtcttatcatgtgtgccccatctggtttctccaggaaaactccaccaggtaacctgttgagccccactctgtgccaggcaggcacaatcttaagcattttatggtacttatccaatagaagataaaccacacccagtggcctttgctgggaagctagagataagcagaggccagaaacacaggttggggttagagaacagttatcccaattgggctcctaggacattcacacctgccattttgaccgtgaggatgctttgactccactgggcatttgaggacttggtcatcccagtaacagaacccatttagccatttagcctcttttcttatcttttcttttcttttcttttcttttcttttctcatctattctcttctctctctctatctctgtttctctctctctctctctgtttttgtctctctctctctctctctctctctctctgtatctctgtctcaatcactggctctcactttctgactcattcttcatctctcaataagaattccctacattggttcattcaggggttaaaatagcagggtcagaatatcctggtcccatctctgcatcaagagattctgaagcctaggaaacttctgcccagattctatctggttggtgcaatggggaaagatatttctgtccaccttgggtaggagagaaaggaaaagccacatctccctggagatgatgtgctaaagcagagaccccaaggggcagacagcaaagggagcctgtggggataactcacacacccaaagtaaaccccagcaggtgggaaagcaaagccagccccaaatgtcaagaaagtaagagcccttattttatccagaacttaatccacttgcctagaaagccggaggttccgcaaagaaaacatctcccaaattaatctgaagcttcccactgccacctggctccaaagggctggcagaataataaaatctcaggatttgagcaaggtgggatttacagacactgttctgggctggggagccagtgctttgttcattactaaatctcccttctgcagccacctcctgacaatgtccacaggggactcttgacaccaaagagcccacactcttgccacaggggcccccaggtccatagcctagccagggagagggtgccaagcaccctgttcctgtctagggtgggcaggtcagcctctccccatttcccccaactccggctccagcagaaggtggcagctttggaaagcctcccacgttgcagtccaggaggggaatgcgaaggggcttgtgtctgtgtggtttgttatccaggcccaattagttgctgggtctgtgttggagagatgggcctgcggccactgcgaggactacagggagcgaacaaggacagaggttgttaaaatgctcctgccaagatctggtgcctgcaccatgtccacacacctcaaagacatggtaatgcaaaacggagccacagcagatttcctgcccagcacatgttaactgaactctgggtaatgccacccaagagacacacagcagccacttgtgcccaggcaggcaccaaaggaaggaaggaagaatcaggagtatcctaaatgtgccactgttcactttaaggttagaagtttcccacctggccccatcccatctgtgactctggaattcaagttgacttgtctggcacttattaattgccaattgtgggcattgctaggggcagctgctaggaatacacaggggattacaatggagtcaggcagacaggagttcaagtcttagtgacacccatcacttactcactccactgggtaccttcacctcattaaggctcagattccttatctggaaagtgggaatgattagactcaccttagggttaaatgagctcagaaaagggctcaataaacaattgctgttatcatcacaataaacaggaatgggacaagatccctccctctgagttgctctttgcccatgtggtaggtcagtggctcaatgcctgcagggccagcagaaacctagagtgaaacagggctggtgagagaaacaaatttgaaaaaattggccctcctagtctgtcttttgtttactcctgaaaataaaaacattttacttttccttcttaactttactgaaagaaaaacagcagcagcaggacagtgactggccctggaacaggaaatgactataaggaggggtggggactgaggcatatgtgaatgtgggaagagaagctggaaacccaaaatttcatatgaaacgtcccaatttttgaatgttggctgattcaacttaaaaaaccaattaaaattaaaatgatgagggtgtggaaggggtcataacccagaaatagagtttagaaagagaatttcttgaattccaagcaaagaggttagtcttcagaagagtgagacatcaaaagatgttgagggccaggcgcggtggctcaaacctgtaatcccagcactttgggagaccaaggcaggtggatcacctgaggtcaggagtttaagaccaacctagccaacatggtgaaactctgtctctaataaaagtacaaaaattagctgggtatgatggcacacacctgtagtcccagctacttgggacagctgaggggggaggatcgcttgaacctagaggtgggggttgcagtgagccgagattgcaccactgcagtccagcctgggacacagagtgagactttgtctcaaaaaaaaaaaacgaaaaaaagaaaggtgttgagctaggctgggtgtggtggctcacacctgtaattccagcactctgggaggccgaggcaggaggataacttgagcccaggagtttgagaccagcctgggcaacatagtgagaccctgtctcttaaaaaaaaaaaaaaaaaaaaaaaaaagaagaagaaaaaaaggtgttgagctgttttctttaaaaagatttctaaaaaccataaaaaagaagcttaagagtattcttcacaaccactaccaggcttgaccttcctggagtttgcatagccaggagcaggcactggccttttcagggagctcggaaaacctggatttttatggcatctcttgccgcacagttgggcgtgcctagaatttcacagtgaaaggaatccagggccccttgataatacccctggccaatctgtgcttgagaagccgagggcaaacctgaataggcttgtcaaaccttagccagctttgcttgcttttagctgtttttttaaaaagactctctccaacctcactagagataacacctctgacgtatggatcacaatgctaacggttgtctaagttgtttttcaggaatttagagtctgctcctgtccagttcaaactgagtgagaccactgacccttcaactggacctccacaaatgatggatgggtaatgagtcctcttttgacgtcacagggccaagagctccaccctcaggtcatgctgatgctgccatttttttcagactttgtcctatgaagggccatgaagcttgactacgcttgtgcagaaactgattgcctcacttctccttacccccaatcacctttccccatgcttcagaccactctgcttctctatcccataaacaaccctaaacctcatctttgggaaggtggatttgaaacctgttttcctgtctcctcgcttggctgccacatgaataaaccctttctctgctgcaaaactcatcgtctcagtgattggcatactgcacggtgggcaaaacaggcctggttcggtaacaccagaatctggcccataataggaagcccactaggtcccaaggcatcttactgaatctttaaaaagcactgaatatggatagctggtattgaatcaaaatctgccttctcggaccatcactcactggccccgattctactgggacctttaacaccagatctgctccttctcatacaccgcaacccttagagatttacagatggccactcccacctgcatgcctccaaattctggtctctgagcactctttctggtcctttgtctctataaactgcacaatggggacagagcttactgcaccttatttctctctggcagagcagagactaataaggagaaagcattaatatttttgctgaagagcccctgaccctccttaactgcaggcctcagatccaggatcagggagcaaagtcacttgtagaaaaagccaccttttgccagatgagtcaggctcaaaggctgtctgccctcacacagccccagggggagattgatgcctgcattgatggatcactccaatgtattaggtagataaagaaattgattattccataaatcattgtctccatgaaaaaaaaactccaatttttttaaaaaagaaaatattataaatctacccaggcccccaggagcaaaagtacagccatttcaatttaattgcctgagagcctctttgctgcaaccccagaaataaaagcccccgaagcgactgacttccaagctagattttccctcccaccctccaagaacagccatgtccaggaaaatccacggacgagatggatttacactgcatcaggaatgatctgggttagtcagaaagaagaatttcctcaccagaggagacagactatgtcccttggagacttacaaattgggtactaaccccttcctttagctttcaccccctacttacacatgcatccatccatctagaaaagttaaggttcagttctgctaaaagacagggaactggccaaagtgaaccctggagggggataaatgtgacagctcaggggtgaaagaacactctcagaacaacgtaagtgataaactgatttagaaggggcaagggcaggaaggagggcaggagtgaagggtgaaatggagatgcagcctccctgccaactcgactgtgcgactttcagttcgtctcttcatctctctgagcctcattactcctccccaggactccagggaatgaggaagatccaagtgcaagactctggtctaaactgtacatactgaaatgttcaaggaaccacagctatttctaaaggtcacctaattggacctaccatgaggacattcaaataccaccaagcccaggagtgctgtttcattgcccccgcatcctggagcccccgcaaatcccctgaccctatgtactctgcagtacacagagtgggtgctccataaatgtttggtgaatcaatgagtcagcccagaacccatgtgaaaaagacaggaaataaacacaaaattacaaacagcataaaaataaccacaatttccaaagcagatttttctgattctgcgaatcccagcaggagcatcaaaaagccccaaatcccctcatactgagaaatcttcagccagagcccctgaagtagccctcactttgtagctaccatagctcacttcctccctgaccatctggatttttctatttgctgtgtgacgtccaagatgccatcttacctcttaaatccttggggtccatttgcctaaacctcatttcttgttcagaggcaaattcctcagaggcaagtgaaacaattcctctgactctatcattctaacactcttcaccttctctggtcctttgagctctagtccaggtgttcccagccaactctccataccccagtgatggataaaagtgcaccatttttctgagaaacactgaggtcactcctggcacgacttttctgtctgggagaggctttgtcaatgcccacccccaccacaagccttcccagacacatccaggtggtagagcacctggaaccgctggggttgtttagggaatgccaccaagctgtgacacatttaattcccatcacctgaatgaggaataattttatttactagcagaaaatatggctctattataggtatgcaggtctccacaactcaggaaataataacacacaaaatacttttaagaaatcacatttggcaggataaaaatacagaacacaatcctacttacaaaatgcgatgtgaaagatgaggctgacaagccgaaccaagatgcttggtatcaggtgtgacatttgacaatggaatgctcactcgttttgtcatctgctgctgctccctagcagacaagccgtacaaggcaccaaaggttaatgaacaatttatgtggaaaggaaaaaaaaaaggagaaaattccatctattaccttgattttcttttaccatgcgttattctatttgaacaacaacaaataacagttcttactagcctaccagagttctaaaggaatagcatttgaaaaaaaagaatgcctgtttagcaagaccttacaataaccccaccacccatactagaaaagccagcatgcagatggcgccaccggctacccccggccctggctgctctccgtggtgctgaacacagaggttggggtgtctctcaatctccctggctcttgctgaaccacacggtgcatctgttatttatgacttcttctaaacacatatgaatacaatttgtatttctctcgcagtgtggaagagtgtttcacaggttggtttttccacattggaaaagtctaggctcttttgttctcttaagactgcaaatgtaaaacttcaaatttgcaagtgtgtgtgtgtgtgtgtgtgtgtgtgtgtgtctgtgagagagagagagagagagagagagaataggagcgtagatcaggttttcttaataggatgagggtcagaggacccatacagttgtctgtttttttcccatggctcaccaagggacatgacacaagtcattttctcttttctgtcttcagcatcccaacccgtgaaagaaaaaaaaatggggacaggtagtgctcctgtagccccagcatttggggtgcctccatttgtgttctggttcttccatgggctcggagaccaccaaacaagattaccttgctggcctggcttcctcaagtgctgaaagatttcctggatccagaaggaagacgcaaggctctgcttctcttgcaagaagacagggattcaatttctttgctcaactctcccccagcccacagtccccatagaccagccataattcagctaaacctgagagttcacccatattttatttactgattcaatgttacgagacaagtaaaatagacggctgtcacctctattaaactgggcaggaaaaatggtcatgtaggcaacaggctctttctgctcatgatgtgtcatgtttccccagggagggaagcaagaaaaggaggggcctggcctcaggggagagctcagttctgttgtgttcaggaggggaagctcagggctccattgcaaacctgccccatcctcactctcagtcacattggtacagtagacagatcagcccagtcagtcaggaactgggaccagcctttaagtcctcagtttccccactgatacaaaggaaagtcactactcactcatcaggcttgggataaagaaagactgttgagccccagtttgagaagtctgtgctagagaagcaaacttccatatggtcatctcctgcaaggacacaaaaacatgtgcacacactcactttcctcagaacctggtgtggaggatgcatatattcccagggctaaatggcctccgttgactgtctatacagcctgaatctccaggttaactgtcaacacctctgctttacaccaagctgtcatgttgaccagttgtctacatacccttgcaggagccagtgatgtggtaaagacagagacctgacctatgatgggcagcagagcaatggcccagccacatttctgcctcacagctgtcctgagtgctcagcctattaacgacagcacagcagaggttctcttccttggttcagctcccagaaagagcagccgagatgctgacggacaagtgggaaggagagaggggtgaggtcagaaaaggcaggaggactgtgatctctcctccagtctcttctttaagaagacagtttgtctctctcaagaaattcatcatgataggaacaagacaatgaatgtaaagtccaatcctaggcttgagaaagaagggctcactcccacaaatattccagctctgcccaaaagactaaatctaaaaggtcctggcacagaaaaagttgcagaactggtgtgtcagaagaccaccatagacagcatgagcatcttgacttcgtggaagaatctaacaacatccttcataaaatcctcattgacaaaatggaaaaagtgttgagctgcatgccggggcagttaggtggacttacattcaaatgaccatattcaccattgcattcatttattcaacaaatatttattaattatctactaggagtcctgcactgtgctagaagcactggataaggtggtgaacaacctggctatggcccatactggtacagcacttatctctaaagtaactaagaattataatacagcaagtgctacaacaggaaaagtagagggtgctgtgggactcagaaggggatggaggttgagaaatgcttcctggaggaaaagacatgttcattgaaaccttagtatgagtagaagttggccagaaagaaatagagtgccggccgggtgcagtggctcacgtctgtaatctgagcactttgggaggccatggtgggcagatcacgaggtcaggagttcgagaccagcctggccaacatggtgaaaccccatctctactaaaaatacacaaatgagccaggcatggtggcatgcacctgtagtcccagctacttgggaggctgaggcaggagaatcacttgaacccaggaggcagaggttgtggtgagctgagatcacgccactgcactccagcctaagcaacagagtgagactctatctcaaaaaaaaaaaaaagaaagaaagaaaaaggaaagaaaaaaggaaatccagtgcagagtcccagagtgtgggggaaagcacagtgccttctggggacttagatgttcaatgcagtggatcagagagggtgaagcaaggagggacagtctatgagtccagagatgccaaccatggcagatcataaagggcctgagggcataaggaagccagtggaattctgaagctcgttaaagtgtaggatagtggatccaagaccatttgaataaagccatcagactctgacattgctcattttctttttaatgtgtttatggcagacctggctgaagggagggaggatatgtttatcccaggctcagatggcaggaagcatgcgagacatcagaatgggaatccccaaaagcttcactattcagaacagtgattcccaaccccaaccatactataggctaataaccacttaacctctctaacacagaccccaggagggaggcagtggttagaagagggtgtaatccatacctgctttccaagcatggagacatggtaataggctctggtggtccagaaacaatgagtaagaataactgcctgaaggttcaatgatagaacttactgggagataaatgataggttctgcctttaggctcaaaatatcaactactaaagggaggataagaaaagttatagatcagcagcaatacttgtggaaaagatctcatgtatctcatgagaacaacagcttaggataaatcaacagactgaatggctgctaaaaagcctgaaacaatctggggttgtataactagacaccaaagctgagatctgaggaggtgatgatcttactggtttcaataaataagtagcactgtggtcatcttttgatgccatgctggaggaattaagcctctttagtctgaagaaataaatgcctttgtgtttctgcagagctctagtgtaggacagggaacaaactcaagccagagtcagtgggcatggtgatcataatagtaggaataatagacaacatgtattgagtgcttaccacggctgtgttctaagcacttcatatgcattaactcattcaatcctcacaaaaaccctgtgaggcaggtacaactattattattattattattattattattattattttgagatattaaatactttgctcttgggaggctgaagcgggcagatcacaaggtcaggagttcgaccagcctggccaatatggtgaaaccccatctctactaaaaatagaaaaattagccaggcatggtggcaggtgcctgtagtgccagctcctcaggaggctgaggcaggagaattgcttgaacccaggaagtggaggttgcagtgaggtgagattgtgccactgcactccagcctgggcaacagagcaagactccatctcaaaaaaaaaaaaaaaaaaaaagagtttgctcaagattacacaggtgggaagtgagggaggcagccttcaatctcaggctgttagatcttagaatccatgagcttatcctcaagattagattgagagctaaatgcattgagagcttcgtttttgccaggcatgttaattctcacaataatttcatgaggtgaaatctgctattattctcattttacaggtaaggaaatctagacttagagaaagtaagtgacttacccaaagtcacacagccaggagggaagggatcaagagttgaaactcagacagaggaatttcaaacccacactcagaccccagttatattgccctcctagaactgcagggagacacatgttagctttttagaggaaaatttgcaacaaagattagcatgggcaaaacatctgcagtaaagcatggatggggcctacaattggtgagcttcccattacaggtggcattcaatcagagactggctatccacctgtatgtagtggggtcctccattgacctagaacagcagttcttaaagtgtggctcccagatgagcggcatcatcatgatctgggaaactgttaaaaaggcaagcactcaggcctcaccccacacccacggaatcagaagctctgcggatggggcccagcaatctgcatcttaatgagtgctttgggtgattctggcacatgctaatatttgagaaccagaggcctagaatgacccccggggtcttttcagcctagattatttgattcttcaccatagacaggaaatgtgatgcctggagccctggaaagtccttggctccccgctcctgcttttccgcccaattgggcagctttttggaatagcatatttcagttctgcaaagcagatgcagaaaggctttgcagaagtctccctcattcccatatttaaagagctcatccctgcagttgttctgagaactctataaacccccttccatcggcagcctgtctgcatcagtccctttaatagcacaagacttaattgtctcctatgaattggaacccttttaatacaaaccagaatcttagttccttcttgctgcttttccctgctctgctatccttaactaccattcagcatggcaccaaagaatttggagttgaaaccaccactcccccaggatctcactccatttcatcatctccgatctgtatgatcaccatggggactctctcctccctgccttttgcctctgtcctcattacctgctgtcttctaggagagctaaagtgtctatcccctagggcctctagcctcagaccctctccagtctccagtggcctgcccaggaggtgagattgtactccccatctgagaagggctgatcaagactctctggaccagccccttaagaacatcccataaccagggtcttcccagctctgaacatatgcaaaatgcattttaatcaaaatgctgcaaaatcagggaagaacaagcaccccataaataatgggccaggcggtgtctgggagctgacattatgagcatccaagaaagggtacctctgttgctccctatcacagtgaataattggtacagactgctaggcccaccaactccagtgcagggcccatgggtatgtgagcgatgggcatatgccacatacaaggctgcatggagtatggggcactaggggttagcacaaagccaagggcacatgagatgcagacagcctcagagctcagagtcggtggagatgtggccccacccttggggaactctcttttttctcctaaaatttattaagcatcgggcactatgcaaagagctttacgtactttatctcctttaatcctcacaataacgctatgcagacaatactgtaagggtcaaccacaagatttttgtaggtcaacaatagctgcacgtggttcaacctaacgttaatacttctattttatagatgaggaaatggaagctcagaggtgcggtgacttccccaaggtcacacagcaagtacacattggactcacgttcaaaaatagatccaccacatttcatcagacccaagacatgccattctttcttggagtgccaagaaagaaaaaattctgcaagtaaacttagacatgacatgtgagacacgagctgatgtcagagatatgaaaatgtgaaaaaaaaatcccatcttagaatcaatgaaatatattattgactccaaaaaaaatcattctgtttcttggaagtgatgggggagagatggcctgagacacccttgggtagctccttgtctagtgggggaggcacaatgcacatgcattagagaaagcctagataccgactcacccccagaaaaccatggccaaggtcaatactgttagtaaacaaggcataaaggtcaaaggaagcaaggagaaggacctgggcagctgagctgtgactagggagaggcagtgtggaccctggaggcgatttccaaaggaaataaaacaaaggaaggaagggcagacggctctaggggcatggctgctatgaaatgtggctatgagaaacaaaagaaaatctgaacaacctgttgtcctcaaacccagtcccctggccctcaatttggtctgatctctccaaatcatgctcaattaggatttgtctctggagcacaaagataagtgggaggaaaagcatactccagaagcaaattcagatgctgggtcagggccaggatttaaggaggcaccccctctcatggtcagtcatgcaagcaaagggtcctcatttgagggcctccttagagtcagctccctggaggtctccctagcatcaccctacacccagccctgtgcacagactcctccaagggcaaaaagaaacgctcaagtgtggacagcatgtaagctcttttgaaaagacgtcacacgtatttaacccaatgggcagtatcatccccattttacagatggggaaatggaggccctgcaaagtaacataacccttctgaccatgcctgtctcaaatctgtcacctttgtagtgactttgggcagtgcagcttcccctcacttccagacagctcagtccctggcagccaccattatcccaggctcccctggccccatgggagaaggaatactgcagacagagaagggtaagtctgggtttgcctttgctcttgtagacggaatggtggattaggaagactcttgcatccaggtccccatgcccaacccacggtgtctgtgacacagcaacacatgttccaggacccagaggcagcaggcccaatttagaaggtcaggatgtgactcttgcttaaaaataaaacgaccataaaaacctattagccttgaagggatgttggcaagaaggaacaggactaaggaaggaaaacgggaagtgagggaaggaaggaataacaaagacagctaattctccaaccaccttctctttccaggtccctgggtgaggaggatggaggtgaaggagacacagacacgaggcccttgggtttcctcaaggctttgacaatgtctttgaggacagcctggtggttccagtggggacatgtagactacagaccccagaacagtgggatccctgtaggtgaactggcctcacccaagggtgagtccgtcctttatttagggcttagattaaagcctcaagcagagtccagaagccaggacaatgtgggatgtagtacatggaaggatgtgtattggtaggaaggctgggaaagaccatccacacctgggccctggaggaggcaaatatgccacacagctcatcagcaaggccagtctgacactgaaaactagtgctagtggaattcagagtggtagagcccagatggccatcctcccagaggaggaccaacatagcccagccagtgagacctcactcagcaaccagaatggggagtgggggtaggggcaccgcattcagccccttaaaaactgtttcttgccatctccagatggcacagccagctaaatgcatgggatccagaggcaggcacaccatacttcttatcccacttctaccgctcactggctgtgcgatcttgggcaagtgacgccaccaagcttagttccctcacctgtaaaatgggataatgtctgtaggttgtgaaggctacctaagatgaagagaagagccctatggctccatttattgagcacttactatttacccacactatgagtcattgtttgaaaagcatttggcacagtgcttagtggctaataattgcacaataaattggagccatcatatggctgttgtcattgttgtttcattattttgattttgctccagacccaggtggggccccaggcagaagacactgcggtggccgtctcagcacaggcacactgccctctggtgctgctgctgaagaatcagcacctgggagaagagcgattccaggaatcaagcccaaggccaaggcgccagccccatccgcatcagctccgtttccataccaggcaggcccttagtgcatctgtcttcccagagctgcagccctaccacactggcctctggaggacaagcgagtgcctgctgggtgctagcctcaacgagggccctgctcctgcaacattggtcctctctgttgccaggcggggtgtgcaaagtcccccagttcctctccgtgctgcccagtggagtgaagcacccgctgtttcagttccctctggaaggtcctgagcaagcaaggcaagccaggctgcagctgcaaggaagagacaggggcagctgctgtggcaagtagaggaggcgccacctcagcagaccagaaacagtcccagtcactgagatcaaacaggtctcctgctaaaagaacccccttcaccaagcaggcctgcagtctgtcctacatatggccttatacttctctcaagaggaggggtagttccacagcccacgggggcatctgtgcttcctcccccatggaggggactgtttcctgggacaggcacagagtgcctgtgggaacgtggggattcaggaaggcttacagccccacaaaggatcctaaaagccactaggcagcttgcatttctggagtggttggaggcagcttgcatttctggaggggtcggggataaagagccatcctgcaaagccctttgaaaacagcacatgagctggacttctgaggtcagccatcctgccggctacaggaggatgcaggtgaccttggaagagcctagtgaggccagggtgcctggctcaccttgcataaaccacctctaaagaccctaggtcattctgacatcaaaagactgtttagcgaagtgcgaggcaggcatcaggaagaaaattaaactccagttgagaaggaggaaagctggggctaacagcagcagctgggctgaaaagtggaggtagaaattcctcaagttaatgctctctaaggccccgcgggccactcccaggtcttgtctgaagctatttacttccaggggggaaaaccctattgatcttcattcagctgctgtctgctcctacaaggcagcgatgtttcagcgcatcaccagtcactgtgagaaatttctcattgttttatacacagcggctcccaaactcaagagatgaatgtttaggataatttgggtgaaccagtcataggagttacagatgaggccggtttgggaactctgagggagggggtgtctctccccagggatcggctgctgttgcctgctgggcccctgtatattcaggaaactcaggaccttgcagctcagttctgctctatctgtagatgctcagagtccagagctgggccaacccttccttttccccaccccccaccccctccccccccccaacacctgctttatgtctctgcagtcatttggcttcaaacctccccactggctggctggagatcgccaccatccacttgagctcctcaacacacagaagagctggccaggcttccccagctgctgccaccactgtctagttcccttttcaaattccaggctggccctcaatcctacatatgcccataacatgaggagagaactaaccatgaaacctacaatggcataacagtgcccgccagcctgcactaaagggaactttgaaaccacagaacataccaaccattaaggccaaccaaatagtttacagatggagaaactgaggcctggggtgccagggagaggtgtgatttgatggaaatggcccaacaaactggtggcagatgcagcagaaaacccagacctcctggctccaagtccagcagcccctccactacagatttggggtcaggtaacctggaaattcaggtccccacgggaggtcactgaagcccgtttggctgagagaatctatgcattaaactgccttccgtaagttaagactgggattcacccaaacaataataacgacgataataataataaaatgccaaacaatatggcttgaaaaccttcaatgcacaacatttgataatcatacatagaatacatcttccacatattcacataaaataatcaatgatcattttttctcgcagactacaatccaatcattctctctcccttgctctctccctcactctcttttgttacttgcaaaccatccaagcaatcaatgccttgacctctccttctgatagacacaattacaaaaagacagagcaatgcaattcatctattcaagacggattgtttgaacactctgtcacactgctgagctatccatctccttgtctaagaggaaatttcagcccccaaaagaggcacaaagagagggggtgggtacgatgctcctcagcccagagagcccctctggcacctgcaagaaagccctctccgggctggtgctcggcgatgcctggctgctggagaagcattcagctccaagctcagccggctcaggtgccagtcttgagaatcagaagcacctagcacactccagagggcctaaattcttaaagccccagccagaaccctgagatcccagggatgggggggatgggaaaagggagagggcactgggcccagccaaggtggtgtgtttggattttagcatgagattctctctctctcgctcgctcgctctttctgtccatgtccactgtagctccctggctccagctggggttcaagcaggggctcagaaggacagaaactcagctccccaggagtctccagaggcctcagagtcctcccatcctccgcccaaactggcacagctctggcagtcacgtttggcgcaggcacaacaccccagtccatgggctgagaatcaaatggggcagggctcttggatataaatgacctgggctgacacgctaattaatcctggggcttaatacgaagaagattagaagagaggagggctctgccatcctttaatttcattattacacgctgaacccaagaaagggcgggcaggcttggggatgctcttcctaagggctgggaggaactccctaacccattcaatttcacagtaaggatacatcatcctgcgccttcccagcttatccctctgaggctgcccttacggtagcctgtccttctgggcctccaaagacttccatccctgaggctgggctgggagcacacccatcccacccctgtggaagaaggatcaaggaaaagggaactgcaatccgtgcgatgggcaaatagcaccctctcagtccccccacctttttccccaaggacaccctacgacgcaggcccccaaaaaagcagagggaaggagacagggaataaaggaagtgctggtccattactggggggggaaggggaggcttcctgcccctggaatggtgccaggctgggcttggggcaggcaaaggcacagagatagaagacatttcggttgtcaggagcaaccaggctgggctgcaaagggttaagcctgaccataagggttgtccccagtgtcccctcccgtgcctggcctcctctgcctccggtgctggtgtttgcctgccagggtcctgggcatggaccgaaagatctcagcgtgggcagagctgaggactgtgctctgccccatccagatggtgttcaagagggtccggctcccgggcggccgcccaggaggagacccacccgctgggtttctgaccgcctcctaggaaaatctcaagtacggaaaccaagcccgacaccggttccggcacctctttcacgccgctggcagcccaaggtccgccctgaagaagagctgtagaggaggaaggtggccctggctcggcggagtccggctcgcctggtgccaggcgctggtgctggcgccgagtgaacccaggcggcccaggtgtccggcctggtggcgggcgcagggcctgcggtgatggaggctccgtcttagcccggccaggcccagccctgccggtcgtcggcccgggacatgcgcggcgctcaggcctgcagggtgccttgggcggccacaacaaagttaaagaccggagtaagagtctccggcgagaagagacgcggagaagccggagccccggaaagccgcgcgcagccccgccagccgccgccagctgcggaggaattcgggctaactttaaaaaccgctggcgtccctgggccgcctgcccgggccgcactgggcggcctccatcgtcccttccctctacctgcactgccccaggcgggagagaggccttggccccgagggaccagctgcagcgggcagcggggtcctgctcccccaacccccgccccatggcacggggctgaaccggtaccaccgaggccaagggcgaccaccaggagagaagaccggctgccctcgtcatgcgaatctgtgccctgcgacctcgctgcggctgctcgagctatgccagaggtggggacgaagggcccgcggggagtgaggtgggcagaggagagaagttggcgccttccccagggtccccactctgcggagaagcccgatcgcagaactcggtcggctgcggttcatgctggcagtcaccgcgaaatgcgccctcgactcgggatcgcactggaaaccttcgccacactgtgccaggtctgacctcccaggagcgcgccaagggcccctcgcccactgcggcccggcggcctcctccccaataagtaaggcccgtgaccccgactctggaactttgtcctcacagggaggagctcctggtggtcaccgatcggctcagcagctcggagagaggttaggaaaatctctccggaacgcgttgggaggccccctcattcccgccccctcccgggcgcacggagacccccggctccagggagcgcttaccgatccggatgacgtggggcatcccgcgcgagtccgggatccagaaggcgcacacgaggagcccggcccagtattcccaaaccagactccggaggcgccgccagggagcggtcatcgttgggcgccgccgagcgtgcccggggcgcggccgtggcgggctccctggggcggcagctctaggcgcgggcgcgcagcagccccgaaggcgccgcctggcccagccgcccggctcccgagcgccgctgcaagtggggggcgccccgcggcgccgcgcacatcttactggggggccgccccgccggcgcccgccccgcctggctgccgcccacgggctgcccgcgagcgaggctcctgggctccgcccggactccgctcggactcggctccggctccgactcgcgtcggctcggctcccgcgcgggctcccacctgccccggctgccgggctctggcgggcgggctgcacgcgtctccggccgctcctcctccagccgccgccgatgctatcgcccgggctcgcacaaagccccggagtggagttgcacgcgcgcacactctccctcccagccccctcccctgcgccctgcctcccgcctcccgcgccgcccgccgcccgcgctccctccgcgcactcccccgcgcacacacacttcacactcacacttgccgaggcgcacactcgcgcgctcacacctgcgcggggggcggggaaggggaccctggccccattgtagggggacgcccggagaacgaggactctcctcgcttcccagacgtccccacccgccccgccggccccagtcccttctactgcgagggcacggagcccgggagccaggcgtggagcgcgagagctggcaccgcgagctgggagacggcggcagcccagcggccggaccagctggaggagacgcgcccgccgggagcagcgagaccgggagcccgccgtctgcggagcctggcctcgcggctcccacgcggcgggcgctggctggacggcggtggcagcgggagactgacccgggaaccggcttccctccccaaccccattcctcctggcagcagagttggggctgggggttcggagaggcagaattcaaagcgaattgtctacgctgggccaggggagctgagggagttggtagaggtgggagagcccaagtcagaccccctgctgtgggaagctggacttgaccgcgcacaggtcctggggctgcggaggaggaagaccgctcacgccttagatgtaggggggcgtgggcgccgggcccgctccctctcagccctctcccgtaactgtgcaggaagggctggtgccccctccctcattctcctgagaaagaataaagagaaactgtaatttgtcgtgggatggagtaggatccgtgggggagcaagctaaaggggttaaaaagaaaaacaacgttgtttattagcaataataattttttttcaagtggcgctgggtgtgagggaagggaaaggctgtggagcgaggctggagcaggaggctgcgaattactcagttaggcgagtttaatgacctttttgacagagacaaagcggtgccgatacagtagataaataaacggatctgtcaccgggcagcggctaggctgtgtgtgaatttatttttctcatttaaataatttgatctattctatcatttccaatctttcccatttgccagctgtctggtaagagcatggcccccaacatctgaagagcaaatctttaattttcttacaaatattctatgagccgagctctcacccgcctgttaatttccctcttttttcccctccctgtctgggtgcagaggcccgtggcattgtgtggggatgtgaatatctcagtgtggccaatcctgccaattaggaagggacgccctcccacctgaggtggaggccactgtggctgtgggaggaggagagactccctgggctcctcacaaaagaacacagaggggtgcgcccgtcctgaggacatcctcaaaaatccagcaaacaaactgaggttattgagtgtctgtctctgccaaagttgggcctccctcgccctggagcaggagcggctggtttcccaagcagccactggaaaatgttgcccgagggatcggagggaaggacacgcagaccaaagctagggaagcagcagctgccacctcttgataaaaagtaagggctccagtgggcgccagtaaggaggaagtgcaggagagggcagcagagggcgcggcctcccggatatagctgggggagccccttccttggggacgcacacccctccccatcgcctgcctatcagcttccgcaacaggtttggttgccccaaggaaccaaaaggcctagctgttctctaaggaagaaaatttcggtgcgctgatagacaaacggaaagggacctgaacttgaggcaaaggacacagggctaaaacggcattgcccaaggctggtctggggacaggcaaggggagtgcctggatgctaattctgcctgggttgtcctgcagtcagcctgcaagtggcttggcagagaaacagaagcagcagaaaggtagaggtgtggctcccaggagggagcagatccaaggcctgtggaagggagggataaggggaggggagcaggaggagaagcagcagcctccaaaaaagctagcatgaaagtggtgctagaaacgcgaagggaggaaggcagagggggatgctgaggcccccagagggtgagagtgtggctctgccacctgcgagccccctcggcgccccagggaagcagcacaggctgggcctgctcctcctgcatcccagagtgggcgggagttacccagcacgctgcggatcgaggcttttttctgctgccacgtagggctgcggtgggaaagagcctcccagctgcagaggctgtggggcccagtcactggacttggaaggcagctggaaccctgccttccaagttggggccagagggaagctgccatcgccagcctgggactgggcctttttcttgacctggctgcgagccattttgtgacacagaggtttccccaaaactaacagcagcgtgttccctcccggtctaggggagggtgggatgcattgcaagaacagaaacagcagcaacgatccccataatgacccctagtatttattacatgtttttatgttccagacaatatattcactaccttacacgcatcacttcacctcttgctctccacacccactgcgataggatctttgtctaaaataacaaatccattttacagatgaagactgagcctcagcggggttaagtaagaggtccaaagtcacatcgctggtatgtgacctttctttcttccctccattccccttccctccctctctccctccttccttccctccttccctcccttcctccttccctccctcccttccccccttcctcccctcccctccctccttccctcccttccttcctactttcttctaaaacatattgggcatcaccatttgccaggcactgtgggtgagatgtcaaggttcacatataggctcagccgactcctgagctcatagaattaaccctgtcctctaccatctgggctgagtaggggacaagctgcaggggccaattctcatcactcttgtggagccccactggggctgctgcctgcggtggaaggctaagagcagaatactcagacactttatcagggcagatcggggagcccagtcatccctaactcatgaagagagacctacagccctctctgccggtggcatgacatgcctctccaggctgccccgccaccagcaggcaccagggctggcactatctccagccgcatctcctccgggcattgggagccgccaatcctggcttttcgcattgttggtaaacaagtctacccaccagccaggcctaggctccctgctcccccacgaggcagccagcgccggatttatgaggcctccaaacctcattcagactaatgcagcttttcattcccaaataaaaggggccgctgtctgaaaggacaagtgctcccgcatttcattaacatccctgaaaacggctgagctggcccgagttcctgccagcgagattcatgtctcccactggctcacaggtgggtggtgagggtaggatttccaggaagaaacccaagactcccagccccctccctggcctcgtccccccacccctccccagctactttgggtgagggacggggcacccagtggtggccgatcatgctctttggaggagccccctgtgcacgtgttttgtttagactgatccactctggctctcaaccccccccacaatcgcagtgagtgatgatgccctgggctcgagttaccgagattcatgttctctgcttccctgggaaaccacggagtagacgtgtgcagtggctgagtgcagattcctaggacttgagtgccctctgccgaggcctgcctaccttcagctcccttcctgctacccagtaggcaggctgctggtcgtggctggacgctgaagccctggggcttcagccactcccttaaatgtcctaccatggggccaggctgctctacaagcctgcacctggggtgccttgctgagaatgggggaggggctcccttgccccatctcaccccagcatggggccatgatgagaggaaggcaaccgccagcccttgcctgatctttgccaactgcctgagcagggagggaagagaagaggccttccctgtagcctactctattgtacagtgttctctcaatggcaaagtgcgtgctcaccacaaaagccgtgccccagccctttgcaggacaccgtgacctgccttttggctcagagacagggaccctttcatcaccctggggcttttgtccctcatcccagtcccaagggaacagcacagccaggctgccacctgagcaagcaataagcccagcgaaggttgcgtcaccttagatttttgtcaacagtcaggcaagctccttcccactgaagtcaattcctgtgtttattgtcagcttaacccactgctgtgagttatttctcagcagtgagggatacaggtagacaagccaccggagatatgttattttactgacatctgtgtttcaatagttcgggtgcggttctggtggaggaagaaagggatacacagcaaccccatttgtatctatacataatggaacagaagctgatgggctggaagcagagtgggttctgctgccgtgtgaggagcactgtggggagaattatgcacagggaacgaaccagcacctcctggcctcccaggttctggcaataggctccctttcttcagcaccatgggtggggaccaaagttgcttgctcactcactcgctcattcatccattccctaattaatttattcatgtactcattcattccatcacatccattcactcattcatctgtttataggatcatccatttattttcatccactcaatcactcacttgttcatttactcagtcccttacccattcatctactcaccattcagtgattctctgattacttcttctaatccctcaatgacccactcattcacttattcttccattaattttgcttatttgctcacttgccccctcacgcattttcttacttacattcatctgcttacttattattcactcatccattcattcattgacttagccatctattctttcttcaatcacccagttgttcattcattcatttactttcagtcctctgcttggtcacccactcactcatttactcacacactcatccattcacttgctcaatcactctgtccctcatgcactgcctcctcaccacacccagcaaagacatctgcctgctcctcctgtcctcagtcactttggggtctgagcctcagacactgctgctcccgccagccaccaggtgtcctggcttcttcagagccccactctcatatcctccactttatgatgaaattcagcaaacttcaagattctgccaacatccctgaccctggagagggtctgggcatttgtcctacgagcagggaccaaggcccagaaagacccagagtccacgtctggtgatgggcataacatccgaggtgtcccacagtgccacctcactgagccaagagccatcctggcttccacttacatcatctcttgttgtctttggaacaacccagggatgcaggagggaagaaatgggctcagaggagtcaaatattactggggagggcagaagtaggcccgtattgttgttcagatgatggggagagaacaaatacatgaatgaatgtgagaatgaataaatgaggtaacatgaaagaatgagcaaatgaattaaaaagtggatgaatgaatgactagatgaatgactcctgcccaaaaagtaagtggcaaacagcttctgacccaagtgactgaactcccagtccagtactctctccactgcttaacaattgctgccctggatccctgaccttgcaggaatcggtggggggaggggagacaaaactagagcatgaattagccaacaatagatttttgtagagaagtgtctccctcagaggctgcggtgagccagttctcggctgcacctgtcccctcatgggcaggaggctgccatcatccctccttagagaggcagagagagagagacagagtgatccttgaaaatccaatcactcagtgataagaaaataaacaagtgaacttctccaagtttgccagacttccctgcccgaggccagcttaattaaagttgatgtagaattttaaagtgggaaaataattagggcaagtggcagaaaagagagaggaaaaaacacattgttttgttctgtgttttgctcactcttaattatgccacagactgtctctcctgtggatcccatcccaagtctgccctccgccaagattccagtaggtggtacactgtgtgagtggcacaggcacacctgtgcctctctggcacacaggtatggagcttctctgcctgcaagacaggcaaggcgccagacagccaggcttggagtggagatgagcacgtgtcccggacactcaggaggaggagccagggggagatggagacagaggcaatgggaagagatgctgcctccctgccccaggtccagaggggagtgggcactgggttcctccctccctgtgatgccagacatgggccttagtcaggacatttctaaccccaaccttgagggacggcagatccctaatgatacagcctctgtcctgccttgctccagggagacaagattttccagcaaccaccaaatgttggaggaagtacttggtgtttggcccagaatggggctggggctggttagaatgctggctgcagcaggtgctaggactcaagcctaccccacacccaagcacctctgtgtccagatgtgccttgctttgttgctgttcttccttctggcaacagggcagacaggctgagcaccagcttcatgaactgattagaggcaaaggcagcctgggcaggggagagttacaggctccttgggggaaagaaaaggaggaaattcctttaggtttcattgaggggaactgggcatgaatgaatacctgtccctggtgctgtgcctgtacacacacaagcacaccagtacaggtacatgcccatactactgcacacacacacacacacacacacacacacagaactaccaacatccacccacgactcgggaaagcatgaactctgcagccagacagcctgtcttcaaatcagctgtgcctcttaccagctgagcatccctggacaatttacctaattttctgtgcctctatttcctatctataaaatggggataataatagtatctgccctgcagggctgttgtgaggattaaatgaggtaatacatgtgatatgcttagaactgtgcctggcacattgtaagggcatgtcacacttagcgatcaactgtctctgctgcttggaagtgtcagactcctgagtagagccttgggggaactctctccaagcctccagcaggaagaacagtgtgtttgtgcatgcacgcacacacacacacacacacacacactcagatggatccctggcctccaggttcaccaggttgcatgtgagtggggtagaaaaggctcagaaagactgacacatgtcaggctgctcctctactctcccccatccctgaccacatggagcgggtctgcagaagctgtggggttgctgagttgagggtctttgtgttcatccagcaggctggctggctgccttgagggaaggaaatcctatggcttgcaccccaaacctgctgtcagattttgacatttctccaggatccctcctccctagcaagccctcacccctacccaccttggcttcctcttggtcctgaccttagtgatattccccgcttctccctgcatctctgtccaagatctccccatccccagagaacctgcccagtatctgacctgagggaacaactcaggaggatccatttaaaaagaaggacatgcccctcccagagctacccagaactgggacccttcgtaagcctcggggcagggggtggggggctgggaccctgaggactcagaggcagctccgaggcctgggtgctgagtgttgctctgtctcccaggggccagaaggaatgcagctgtggaggcaggcagtcaggagaggcttgggctggagcctgggcaggggatggaagaagcttagctgtaggaaccagccccagctctgtgttatctccgaggcagcagggggactgtgcggcagggatcccagttctgccaatcagttaatcccaggctccagccttccacctgggtttggttgggttgagtaaatgaaccggggacaggtgccagtggccacagcctcctttctctgagttgccttcatttcattctattcactcagccagccaagtccctttgctctcaagcttacacacatgtctcttccaagcaccaggacactcagagaagcacagaggttgaggacagacaggaaccaggtgatggggatggagaataagcatctgattagccattctttagggataggagggaatccaacaaggcccagcgaccctccctgccaaaaggacaggaggctccctacgcttcaggtcagggcacttgggccattgatggtggcctcactgccccagggaagagaggagcatgaaggagcagctgggatggggccactgatggctttttacaggactcttcttctgggcatacccccacccccactccagagagcccactgggaaggacatgctccagggagtccccagttaggtggtcattatcttgctaatttatgctctgtagccagaagccaggacataaaggcaggggtatggactagaattccacagcctatggtgggaagtttggggctggtcctgcgtccacacagcacacataccattgagtgaaacatagagacaattttctagataatgcaaaggaacactcttacaccaatcacacttcaagttagtcccagaactctacccagctgcttccctcaaccatgtctttatgattttttttcaagcattcctggtgacccactgtcacagggggagtaggaggggccgagatggcacaggagggctgtagggtcatagctgaaatccaaggggacaaatgggagatgctgagggcacaggcaggaagagaggggatgtgggtagagatcagggagactcagagaaagataaagggaatatgtatagggtttgaggggacggatgagaacttgagaacccacacaggggacaaaggacaaactaaaggtcatacacaaggtaggagttttcgacccagactgaagttggaggaagatgggtaggagttataatgacctagagaagagcagaagggagaaagctggggacttggaggacaaggaaagggactctcctctataagcagctcccagccttgaagagagaaaaagcacaaatgaaggctgatggtgggtggaggaggaagaggaggaggagtagaggatgaaatatattgccaagaatagctgctgaaacaaccaagagttgaaggccaagtttagcatatgctcttgagaggacatttgcagagccagatccctgaggccccacctaggtcctgaagcatcatccacacactaaccaggaagccagggatggtgcattcccagagtacccagcgtgtgctcaggggccacctactctgcccagctctgtgtcctcgcttttgagg

SEQ ID NO: 349 - DNA, 25904 bp, Homo sapiens
atcgcagactttggcatgagccggaacctctatgctggggactattaccgtgtgcagggccgggcagtgctgcccatccgctggatggcctgggagtgcatcctcatggtgagcagcccgaggacagccaggttggagcagggcaggtgggagaacactggccgccactcacagccctggtctccatcagtcacacactttctctgggttgcattttacagaatctcatctataatatgaggttctcctagcccaagggactggggaaagcaggagctgcagtgtgatgggcaagaatccaggagccaagagtgggtactggggatggagacagggtggcagagagctcaagagatgaggttgggcgaggaagctggagatagaaggggttgggtagggagaccgaaggtcaggaccagaaagtgggggtggatggagaggaaggaggagcagaaggaagaggtgggccagggccctggagagaggaccagagcatggagaggaaaggcagagcccaagggagaggagttggaaaaggtggccagcggaggagagtggagagcctggcgtcaggagggatcaggcctgagtggagcccagagtggatctggggcttccaataggaagggaggagggtctacgttgcctgatgtccctgtctgtttttgctgccttctctgcatcccaggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtcagagtggaggagagggaagatgggtccgaggcgggggacagaaggggcagagttgtcatcttggagactaaagaatatttgttccctgactctcatccacactgccacaatgcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaactgtgtgagtgggttccttgggaatttggtaactctgcctcctgcacctccctctgaacccacttcccaacccacttcccatcttccttttttcctgcctcctcattccatttcccatcacctgttttgcccagcattgtgttctgtttctggataatccaggcctttgcctgtgggacctcaggagatgcatgaatgtctgagtgcatgaaccttctcaactcagaggggtgctctggtggaggcctggaaggaatgcagtcaggccaggggtgctgaaccttttttgtgccataaacgcctttggcagtctgtagaggtctactgagtcctcctcagaattaggttttaaaacctataaaatggaccaggcatagtggctcacccctgtaatcccagcactttgggaggctgaggtgggtagatcacttgaggccaggagttcgagaccaacctggccaacatagcaaaaccccatctctactaaagatacaaaaattagcagggtgtggtggcatgcgcctgtaatctcagctattcaggaggctgaggcaggagaattgcttagaacccgggaggtgggggttgcagtgagctgagatcacacaactgtgctccagcctgggcaacagagtgagactgtctcaaaaacagaacaacaacaacaacaaaacccataaaatgtataggattataagggaaaccaatggaaacagtttaccaaaatgctaaaaaattatgaaactaatgtgcttctttttcatgtatttaataacaagatctaaaaacaggtgtaataaactgacattttccaaatactaatgagcataagccatatttgagatttctacaacagtcacagtgagacataaaagtagctgtggtgtcaattagtgacaagtcacaggtactgctaatactactggtggttttacccatattcataattggaggaaatgctaaacttctattagaggttagtaaaaggtgtaatttctttttcttgcccaaattctagaacccatctggctccccagggtctggaaatcccaggggagaatccctgggttatgctgatcaagtgtgcaaatgccccactgggggtaggggataggttgttggaatggaaaccagaaccagaaaccagaatcaagagcctcagttatctcagaggcttggaaggatgagctgcaaccaccaagagaacaattaaagggttcaaatttggttggaaagaaaaaatcggccagtggggtggctcatgccctgtaatctcaacactatggaaagctgaggtaggaggatttcttgagcctaggagtttggaaccagcctaggcaacatagcacactctggcccccatttatacatatatatataaaactagctgggcttagtggtgtgcaccagcaactcaggaggccaaggtgggaggataacttgagcccaggaggttgaggctgcagtgagccatgattgcatcacttcactccagcctgggtgacagagcaagaccctgtctcaaaaagaaaattaaaagtcagttgcagggatgggacaaggcagacccatcttgatggccattcatgtgaaataaaaaccctggggttttggttgatgatattcacaaaatgagccaattggataatgaggatcacagtaaagataaatcaatgtgaagttgaattaataggcccttggggcctaggtcccgaatctaatagtcctgctaaaacttacacaggtcaaaccactgtgcactatgatttaagttgtgtaccgataggttagagtttagaggccagatcccagaataatgagcgatggaagccacggcagtgagcctgataacccaaatctctgagctgtctttcaagcagaaacacctggagttaatttttttttttttttttttttgagacctggtctcgctctgtcacccaggctggagtgccgtggcgcaatctcagctcactgcaacctccgcctcctgggttcaagcgattcttctgcctcagcctcccacatagctgggattacaggtgtgcaccaccatgcccagctaatttttttgtatttttagtagagacggggtctcaccatattggccaggctggtctcaaactcctgacctcgtgatccgcccaccttggcctcccaaggtgctgggattacaggcgtgagccaccgtgcccagccccacctgcagttaatttaaaagtcaggccctgcttgtccaaacctgcttctcctccacagtctactgactcagtgaatggcagcatcatccacttagctgcacaagccgcacaaggtggcatccccgagctccttctcccttaccttccacctctcaagtccagtccagcacaaaacgctgttgattttgcctcccaaatctccctggaacttgtcatctctgtctccatcgccctcctggcacatgctgcctccatcttgcctggactcctgcagtggtctcccagctgtcacccagatctgcctctgctcctctctgggttgttttccaccctgcaaccacagttatctttaaaacacacaaatctgaccctaatccttcatttcaaatccagcagtgacttttcattaatcttaaaatgaagaacaaaatccttctggccaaggttggcccccacatacctctccagcgtcctcccccacccgcttgctttcctctgtgggccactggccttctttcagattcacccaatgggccacagtacttcctgccacgtggccttcgtggcatgctgttccctcacctggaacaatgttccctgcagtctgtgccttattaactcctgcttgtccttcagcagtctttcctgacttccccaaccaggtcaaattccctactgataatctcagaggacatgaatctcttctttgtggcacttactacgtgtgtaattttacatatctttttatacctgcccctcccaccaaactataagttgcacaagggcaaaatcttggaacacagggctcaatattggttgaaagaaagaattgtagcaaatatctgatagactaacatagattctatgtagttacagaactagaactaggattaataagtgaaagttacaataatgatgataatatattactgagcacccactatataccaggtattgaaattacgacatattatatcttacttaatacaacaatatatgaagtagttaaaattactttgcacagagaagaaaattctgttaggttaagcagcttgcccaaagtagcagtcagtcaacagtaaagcctgtgggaagtgggtctgtgggctcctggctctctgttcctttttttttttttttttttttttgagacaaagtcttgctctgtcacccaggctggagttcagtggcactatctccgctcactgcaacctccgccttctgggttgaagcgattctcctgcctcagcctcctgagtagctgggattacaggcacctgccaccatgcccggctaatttttgtatttttagtagagactgggtttcaccatgttggccaggctggtcttgaactcctgatgtcttgatccaccctcctcggtctcccaaagtgctgggattacaggtgtgagccaccacgcctggccctggctctctgttctttctctccaggatgctgcctgagaggaggaggtcatgagctccctatcacaggaattttcttttttgaactaccatgcccactaacatgctggccaacacggtgaaaccctgtctgtactaaaaatacaaaaaaaaattagccaggcatggtggttcacgcctgtaatcccaactactcggaaggctgaggcacaagaatcgcttgaatctgggagacagagattgcagtgagccaagattgtgccactgcatttgacctgggtgacactgtaagactctgtcccctcaccccctccaaaagaggtgtgcctatttcaattttttttttttttttttttttttttttttttttttaatttgagacagactctcattttgttgcccagtctggagtgcaatggtgtgatctcagctcactgcaacctccacctccagggctcaaacaaccctcctgcctcagcctctcaagtagctgggcctacaggcatgcaccctcatgcccagctaatttttttattttttgtagagacagggtttcaccatgttgcccaggctggtctcaaacttcggggctcaagtgatctgcctggcttggcctcccttcaaagtgctgagattacaggcatgagctactggacccggcctcaattttcagcaaaagtgtatgagtatgctcctataccctggtcaacattgaggttgtcaatccttaatttcttttttgctgaacttttatattttaattttatttatgtatttattttgagatagagtcttgctctgttgcccaggctggagtgcagtggtgtgatctcggcttactgcaacctcagcctactgggttcaagtgattctcctgcctcagcctcccaagtagctgggattacaggcgcccgccaccatgtctggctaatttttgtattttcagtagagacggggtttcacccgctcaggctagtctcgaacttctgacctcaagtgatccacccgcctcggcctcccaaagtgttgagattataggtgtgagccactgcctccggccgatttatttatttttatttttatttatttatttattttgagatggagtttcactcttgcccaggctggagtgcaatggtgtggtctcagctcactgcaacctctgcctcccgggttcaagtgattctcctgcctcagcctcccaagtagctgggattacaggcgcccgtcaccatgccagctaatttttgtgtttttagtagagacaaggtttctactaaaatgttgaccaggctagtctggaactcctgacctcaggtgatccacccaccttgacctcccaaagtgctggcattacaggtgtgagccatggcgcctggcctatatatttatttttaagagacagtctaattctgcggccaggctggagtgcagtggtgtaactgtagctcactacagccttgaactgctggactcaaccgatcttcctacctcagcctcctgagtagctaggacttcaggtgtgtgcataccgagctaatttctttttctcttttcttttcttttcttttcttttttttttttttttttttttttgagacagggtctcactgtatagctcaggctggagtgcagtggcatgatcacagctcagtgtagccttgacctcctgggtccaaacaatcctcctgcctcagcctcctgagtagctgggaccacagaaccaggcctggctaattttttgaattttttttttttttttttgagacaaagtctcgctcttgtcccccaggctggagtgcaatggtacgatctcagctcactacaaactccacctcccgggttcaagcgattctcctgcctcagcctcccgagtagctgggcttataggcgcctgccaccacgcccggctaatttttgtatttttaggagagacgggtttcaccatgttggccaggctggtctcgaactcctgatctcgggtgatccacccacctcggcctcccaaagtgtcgggattacaggcgtgagccaccgtgcccagccaattttttgatttttgaaacatttctgatattctgtttaactttctttttgctttggccaatctttctttctctttccttctttccccctccctaaccctcccttcctctcccctccccaattctcccctctccagttctcccctgtcctctcctctcttcccctctccttttgggacagggtctcacactgttgctcaggctggagtgcagtggtgctatcattgctcactgcagcctcaatctcctgggcccaagtgatccttctacctcagcctcttgagcagctgggaccgcaggagagcacaccactacacctagctaatttttgttttgttttgtttttgtagcgatagagtttctgtataatgcccaggctggtctggaactcctgagctaaaatgatccaccttctttggcctcccaaagtgttgggattacaggcctgagccaccccgccaggcctctttcttttctttttcttttcttcttctttttttttttttaagctgctccttgctgagcagggctaactagtaagcagtggtctgtcccaatctttctattatgtttctttttcttattgctttgtaacagctttttgtattttgtttatttcatcaaccatttcttcctagattgtaaattgtctttcaaccttacctaaagtttgccataaagaagctctgtcaatttttagcttttctttgaagattttaaaacattaattgctaaaaagacagggacaacagaaaacatgggtgggctacaaagtataaaaagtcttgcatagtcattaccattttgatccctggttgcttgcaaatgtgcttcaaatcccagcttgggcacttcctgtctgattgtagggattttttttttaatttttttttttttagagatgggcatctcaggttgggctcagtggctcatgcctgtaatcccaacactttgggaagctgaggcaggtgggtcacctgaggtcaggagtttgagactagcctggccaacatgttgaaaccctatctctactaaaaataccagaattagccgggcgtggtggcacacacctgtagtcccagctacttgggaggctgaggtaagagaatcgcttgaacccgggaggctgaggttgccgtgagctgagatcatgcaactgcactccagcctgggtgacagagtgagagactccgtttcaaaaaaaaaaaaaaaagagagagagaaatgggggtctccctctgtcacccaggctggtgcgatcatagctcactgtagcctcaaactcctagtctcaagcgatcctcctgcctcagcctcccaagtagctgggggtcacagctctgagccacctcgccaggctgcaggcaaatttcttaatcttgccgggctccagtcttccagtctataaggtgggaataacaaaatttgcatataggaatttggggaaacgtgtagttctgggtttgggtgaagacctccacttttgtagtaggttcataaatcaaatcagagcaaatagttggtgtcttaaaaactgtatttatctgggtcttctaagtaaacggtttgaggagtggtggaggcagaaattaagatttactgagtacttagggtcaagtaaggtgcactggatcgtgttaatcgttaactcgtggaaaccgcccagagtgtgtacgctttctttcttttctttccttttctttttttttgagacggagtttcactcttgtcgcccaggctggcgtgtaatggcatggtcctggctcactgcaactccgcctccagggttcaagcgattcacctgcctcagcctccagagtagctgggattacaggtgcccaccaccacgcccggctaatttttgtatttttagtaaagacgggggtttcaccatgttggccaggatggtctcgaactcctgacctcgggtgattcgccgcctcggcctcccaaagtgctaggattacaggcgtgagtcaccgcgcccggcctggagtgtgtattatcccaattttatggggagtaattgtgctcactcggctcaccaccaagtcgccagagcgcgcctccgcaaggaagccctccaggcacttctactttcccggacccgcctcccgctccagccggttacacgcgccgttagcagcgtgggcggagttggttctgccttcgcggaaccaactggtccagcttctggtgtctcccctcgctcaattaaaagccagctcctctcctttcggcttccccacggtgcctttcgggatttgtagtcagacgcgcttcagccggctctaaggagagcaaaggcaagactccaattcccagcatcccccgcgcccggagagtgcagcgtctattctcatcctcttcacttttccactcctccccttacctcccttctcttctgaattctccattctgggctcttgcctgtgaaatctttctttgctttccccatcttttcctcgcattttttcaccatctttccctcaatctccaggagccaatgcgagactttggctccgattaagcgacggcccgagactcggggtgcgcgaggaggatcgacagagtggtgaggggacctaggagggcgggagtggcagaggtatgagagagagagaggtgagtgggaggcgaagagtgagaggaaggcagggagaagctaggagatcggaaggcgtgggtcagggtgaatgacgtgaagtagacttgggaagggaaaagaggtggctttagatttgggaagcatggaggggagaggttaccgccgtacttagcagaagtgggctaagagatagaagataggaaggacgggcagatttggagcttgtagactggtctgaccaggatgggatggaagagagaggtgtgggctcaattttctttgtccctgtttagccaaagatgagacaagtcattgaaatacaaaatgatcttgcaaacactggacagttaacaattctgtcacttggtaattgagggaagactggagttgaagggcagaaatagggtgaggaggcaagaaagggagggagattggtcaggtttgggagaaaccagaggagatgagtgacatgggaaaggagaccacagaaaaggtggggttattgtggggactgatggatctggaatcagttagaaaggtcaggggtgacactggcatggatggtgaggttgcacttctgacgtttgcattcctcaggtgatggagagcaccccttcaaggggactgaaccgagtacacctacaatgcaggaatctgcaggaattcttagggggcctgagccctggggtattggaccgattgtatgggcaccctgccacatgtctggctgtcttcaggtgagaagccccttcatggcagggaaatgtaatggggtctgcggagtggaataaaatatcataggtaaaagtgtagcagcctggagtcggggtggggactgggggcaagggttggaaattgctctaaagtgtggaggccaaaacagcaggactggtaaagttgtgctggagtgagatgagatgtttgagaggtaattgagggcagagatgcagatacaatgcagcttctgatactaacctttgacctctgttcctgtacagggagctcccatccttggctaagaactgggtgatgcggatgctctttctggagcagcctttgccacaggctgctgtagctctgtgggtaaagaaggaattcagcaagtaagtctcagccagatacaaatttctcaacagctacatttcccaaactgctgttccttggagcacttccaggaagtgttaatagatatatcacaaaacttaaaaataaatacatttgggaaactctgcatattgccttttcccttttatttatttcccagctgagatcttgctttcaaatgtatcttccctcttaaagagttatgtgtgatatctgtaatgaggctctgataagtaatgcagtaaagaatttgtcttaggaagatactaatttcactctgtggaacagtgttccaagggtcagcaagttcagaacaggcagagatggtggcttttatgggcctcctttttgttttccaaataccctactcacctctctgcttctgttccagggctcaggaggaaagtacagggctgctgagcggcctccggatctggcacacacagctgctcccaggcgggctccagggcctcatcctcaaccccattttccgccagaacctccgcattgcccttctgggtgggtatgtcacttctctctcttcctaagctagggcaggggaactgctgcttattaaaccactaattaaactttgggagggggagctcctgggggcctccccagaaccttgtggtctccacgttgggaactcctttaggagtaagttggaccagatgtagtgtgtggtgtaggaaatgtcccccactcatggcccctgaggataagggtggaaagatggcagagggcagcaaggaacacagacagggttccttactctttttttgttgttctgttttgtttgtttttgagacagagtctcactctgtcaccaaggccagagtgcagtggtgtaatcttgactcacggcagcctctacctcctgggttcaagtgattctcctgcctcagcctcctgagtagctgggattacaggcacccaccacgacgccaggctaattttttgtatttttagtagagatggggtttcgccatgttggccaggctggtcttgaactcctgacctcaagtgatccgcccatctcggcctcccaaagtacagggattacaggtgtgagccactgcgcctggccagggttccttactcttggcccatcctggccgtagggggaaggcctggtctgatgacacaagtcagctgggaccagacaagcatgcccgggacgttccctcccttgacaagtacgccgaggagcgatgggaggtaagcacttgggagtgtgtgtgtctctgcttgtgcttctacttcccatggcccttggggcatggtctccctgttctcttctgttcttcaggtggtcttgcacttcatggtgggctcccccagtgcagctgtcagccaggacttggctcagctcctcagccaggctgggctcatgaagaggtgaggaagccggaggtacagcagctctctgctgtgccatctccttgggtccctaagaaatggtatctggggctagtcaagatcagaggacattagctggaaaaggcaagctgagtagaatatagccagagataccaagaaaaaacgtgagtggacaagtggggatagtagtctttctctgcatatcaccatcattgtcctggtctttgtctctagtactgaacctggagagccgccctgcattacttccgctggcttccagttcctgttgctggacaccccggctcagctctggtactttatgttgcagtatttgcagacagcccaggtgaggaggcagggccacttaaccagcatgctctgctcctctcaggtctcactgagagactcctgcctacagactgttccctgattttctcttctctgtccctttcttcccattgtctccctcccatccctcctcctttgtctctgcctctttctccctagagccggggcatggacctggtagagattctctccttcctcttccagctcagcttctctactctgggcaaggtaagcagggggctgaaaggtatagagatgggaaggggaaagcaagttgtggggcagtagagtagactgagaagataagaatgaaaacagaacgaacagagatggagaaagaaagaatgaatgtatggggttgggggtgggtgggttgtgttttggaccccagctggaaacctctgttcctcaggattactctgtggaaggtatgagtgattctctgttgaacttcctgcaacatctgcgtgagtttgggcttgttttccagaggaaggtatgagcgcctagataagtggcttccagggaagaaacagggtggtgtgttgcctttgcctttaaaaaggagtggggtcttggggcagtagcaggaagcagttgccagaactgaatacttgggtctctcgggggagagaagttgggggttgaggttctgcatcttgggagggatctgatatttcaggcaggaagatgtaaggcagtgacttctgagacaaggcatctgcctttctattcttttcagaggaaatctcggcgttactaccccacacgcctggccatcaatctctcatcaggtgtctctggagctgggggcactgtgcatcagccaggtttcattgtcgtggaaaccaattaccgactgtatgcctacacgggtgaggcgggacagagggcccctggaagaggaggttgggggtgagggaatgccagtttatgttcgtgtttacctggcagtctacagagctctctgacatttctcatgacacttgaaagaagggcttgagggagtctgggtgtgggggtggcctcctcatcctctttctatccctggctcagagtcggagctgcagattgccctcattgccctcttctctgagatgctctatcggttccccaacatggtggtggcgcaggtgacccgggagagtgtgcagcaggcaatcgccagtggcatcacagcccagcaggtattcccacttgggagaggtggagcaggaagacaggctgcacttgggctgcgggggacaggggtcacattatggaaggctagctctgagtctgttataataggtggtggtgagttgtctgtgtttgaagagaaatgaaggctttgggtgtgagaataggtagacccttgaggggaaaaaaacatggagggaggaggtatagatctggatttgtgcctcggcactgccacatcctaactgcgtaaactagacatagttgttttgcctctgtgagcctcagtttcctcatctagtaaatgacagttcttacctcagggttgccgggataattcattggaagaataggggcaaagcattgagctcagcacctgtcatgcaataaatgctaaaaaaagaaaatagtagctgctgctattttaaagaaagaaaaacaaaacattactggaaagggcgaatgtgccagaaaaggaatatcccacgttgctgggagcagcaacgtgggataacagctgaactgggatgggtggagttgatgacaggagttatgagtttttagaataagctgatgttccagtgacattaggtgacagctcagatggctttcctgccttcttgctggagccctcatgccattcttgtctgttttcctagataatccatttcctaaggacaagagcccacccagtgatgctcaaacaggtatagacaggctccaagatgtcagaggctggcagctggtgatgacatgatggaaaagaaaaaggggcatccaaatctggggaagaaacagagggccgggttgtctggggcagtattctgagtccctacagtcaacccttgctccttgcagacacctgtgctgccccccaccatcaccgaccagatccggctctgggagctggaaagggacagactccggttcactgagggtgagtagcttctggtggccaagtcttggtcattggccagagaaagggcagacagttcagtctgcattttattttttacttcatggactaggagagaaaagctggcaagacagttttttgttgttttggggtgagtcggtagtaaacaaatcgtcccaaatcaatgcactttggatttggctaggtgagggaataattcacagtaatttgtattaggcctttctgaatatggctggatcacactggtgttaagatgaacccctgagcagacaagcatagagaattagtttgtaaaattgcggtgggggcaagcccagaccgcgtccagggctgccaccaaggagctggggggattcccaataggagctccgagcttcactttctcgtcttctccccgcgcccctcccgtcctgccgaccccaggtgtcctgtataaccagttcctgtcgcaagtggactttgagctgctgctggcccacgcgcgggagctgggcgtgctcgtgttcgagaactcggccaagcggctcatggtggtgaccccggccgggcacagcgacgtcaagcgcttttggaagcggcagaaacatagctcctgagagcgcgggacttggacacggacctcggcgggcgggactgggcggggcggggcatcagaactcaggtgttttttatttacgcgtcagggcttttcttgtttaataaagttatgatagctagcagtgcggtcccgggcgcctccccgtggggtttgccttcgcggcggactcgctcctctggtctacagcctttggaccggtagggagagggtggggccaaagccagctgctgcgcatgcgccggccggggccccgcccccatgcgccgcgcggctccagggccacgttccagggtcgggtttggtggattcctcagtccctgccgccgcggggcgccctgggatagcggcggggcctcctggtgagcgcgcgccggggcggcctccgggaagtgggagacgctgcgggtcctgggcccaggccttgggatgggcgggaaggcttggccgcgccgggctgtgggcactgcaggaggcccctgtgcaggtggagatcgccgcggccctggcgggactccttgctggctcttgggcgcgctgatgcccatcatctccctgagtttctgagccctatctctcatgtgtcagtggtcaccgccgaatccagacactccggccctgttccggaagagccctgatatccgtggctccatggcgctgtctgtcgataccatgcactctagctctcaaggaggaaaggttttgtggaagggaatagagacttggaataacagacctgtgctaattagagacaggaaagatggaacaaggggagtgacccttctccacccccatatcctaatgtgctctctctctatccagaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaaggttaggggtcagacagcttgtccttgggtttctgagacttgagaggggctggaggagaccggctgaaatgcagtctggggtatactggatcccagcctcttctgctttctcttctcagtcacctgcagaatccattaaggcctggaggcctaaggagttagtattgtatgaaatccctacgaaacccggtgaaaagaaaggtaagtagaataagtaagaaggccttttctttcacatatgtgttgcccatttggcctgccgaaatgcagcctgggaacaagttcagtggttagtggagctctcctctgccttcacagatgtctctgggcccctgcctcctgcatacagcccccgatatgttgaggctgcctggtacccgtggtgggtacgagagggcttcttcaaaccagaatatcaggttagtatctggcagggaggggtcctaaattgtctccaggacagagtggcccttgaatacaactggacctcagagttgagctcacattgtagaccttgtcttctttctggctctggtgtctccaaagatttctcttggcaggttccccctggccaattccctcctctccactctcctcttatttgcaggacagttcttccttgaagttctttctgttctggagacagtagagggtgctctttccccaatccaattctctcttgcccctttgactttttttcttcctctaggcccggctgccccaagctacaggggagaccttttccatgtgtatcccacctcccaatgtcactggctccctgcacattggccacgcactcacggtggccatacaggatgccctcgtgcgctggtgagaggggagtgggggctgcttgagttcttggaagggaaataggaagggcaggaatgagtgaggataaacatttaagctcaggggctcacaggagggcatttttgttgcaggcaccggatgcgtggggatcaagtgctgtgggtccctggttcagatcatgcaggaattgctacacaagtatgtcttttgttacctgttccttttcttgggcaaaagcaatttcttcccccaaagcaaccaagcaacctgactctgttcatttgccctgaatccaactgcaggctgtggtggagaaacaactgtggaaggaacggggagtgaggagacatgagctgagccgggaggccttccttagggaggtgtggcagtggaaggaggcgtgagtatgatgggcaggactcggggggcccagatggcagatttggtttcttgcctcccaccactatcactcctgacttgtaatccttggctcttcccgacacagctctgacttcctcagagatggaagctctggagcctgttaacatttggtggagtttctaagccttatgtgtgtggatattatatatgcattagaatattcgtgtgtgtgtgtgtgtgtgtgtgtatttatatatatatatatattttctttctctttacttaccccaatttctcttgtctaaatctcaccttcttccactcgcccattcccacctttcaattcccatggaattaccctcattcttctgggtctgttatctcatgccatctctgtgaagcatccttggatttcccacaatatggctatccctcctctcttcctatagaatcttttgcctcttttaatatcttagaaaaccccatactgggtttgtaagtccatttctattagcctctagaggctagatcaatgccatcctcacttgattttcctccaacacctggcattgctgggggcatcgctgggcctggtacataggaagtgcttgggaagtgtttgctgacaaggatctctctgggcacaggaaaggtggagagatctgtgagcagctgcgagctctgggtgcctccctggactgggatcgagagtgttttaccatggatgttgtgagtgttctgtgccttggtccctgtgagtgatgggcgatgtttagggatctgtgtggggcagggaggaagcaatgcctgggtccctgagcagggtgatgggctgagaagtggctcttagaggtggacactcaggtcattccagggctcctcagtggctgtgactgaagcttttgtgcggctctacaaggcggggttgctgtaccggaaccatcagcttgtcaactggtcatgtgctttaagatcagccatctcggacattgaggtgaggcggagagagggaagcaggtttgtgagagctctgaggcagagtggtcaatgattaagagctcagactctggagccagggtgcctggattcaaatctgatgcctgcctgttacagctgtgtggcttttggcaggccgtttagtctctttaagcctcagcttcctcagtctgtaaattagagatgatggaatgcttgcatcgtgggggtgttgtaaaaattaaatgagaattcacataggtgcttggcaagatacctggccatggcttaagtgctcagtgaatatttattagaagtgtgactgcacgagcattgggtgagggcagagggaggtagctcccgaatcctccaaatggcttttagatggattgcagggaggctgggcagatggatgagtggcagagtgaagcctgggcatgagccttgcagaaaggctgccctctgacccagctttctcggtgcctccaggtggagaaccggcccctgcctggccacacacagcttcgactgcctggctgccccacccccgtgtcttttggcctcctattttctgttgccttccccgtggatggagagcctggtgagcatagtactctgcagggtcacccgtttacctccatttttcctgttttctgaagcccatgttgggctgctaggaacccatcagtccatctctcacatgtaccttggtagtgttcacctcagcgtgggcacttacccagggtcttctgggggatgtacaaaaagtgcatgtggtcactgccctttgagagtgtggtgtgattcttcaggagtgcgctacccaggaaagagatcagttctaaggtatgttttgttttgtttgtttgtttgtttgttttgagacagagtctcactctgtcacccaggctgcagtgcaatggcacgatctcggctcctgcaacctctgcttcccaggttcaagcgattctcctgtctcagcctcctgagtagctgggattacaggcgcgtgccaccaggcctggctaatttttgtatttttagtagagacggggtttcaccatgttggtcaggttggtctcgaactcctgacctcgtgatctgcccgccttggcctcccaaagtgctgggattacgggcgtgagccactgcacctggcctctaaggtgtggtttttacggtaaatgttctgaagagctcagagaaagggaagacagatgagctggaattgtcagtggaagcttcttgtaggagctggtgctccccctgaggaatgtacagcatttgtgattaggacactgagaatccccagtgtcctctgggcacccagcaagaattctattatagttgctttaattaatgctgcccccatttcttccatgcaaattatcagggaattctttagcaccagagaccctctcagacctctggtcatcagcttatgggaaaccctgggttcctataaacactgctcctacttttttctagtcactcctgggggcctcttccaccttgactactccctgccccttcccctttccagttctactgcctttagctatgttggcagtgagaggtgaggatgatgaccagctgtaagtgtttaaatgtttatcttcagatgcagaggttgtggtaggaaccacaaggccagagacgctgcctggagatgtggctgtggccgttcatccagacgactcgcgatacacagtaatacccagtgcgctcctgcactctggcccgccccgccaatggccttctcttctcttgggttttaaatggtggctctttctctcttgcttctacttccttttcctgagacttctctcagtggttctgattggactccctcctcctcttatagtttttctgtagctcaggggttgacaaactggcccatggtcctaatccagcttgcggcctttttttttgagacagagtctcgctctgtcaccaaggctggagggcagtggtgtgatcttggctcactgcaacctccacctcctgggttcaagcaattctcctgcctcagcctcctgagtagctgggagcgtggcaccatgcccggcacgtgccaccacacccagctaattttttgtatttttacaaaaattagtaattaattttttttaagtaatgtaatttttaagtaatgttatttagtagagacggagtgtcactgtgttagccaggatagtctcgatctcctgacctcgtgatctgcccacctcggcctcccaaagtgctgggattacaggcgtgagccgccgcgcctggctgcttgcagcctttatattatctatggctgctattatataccctctccagctctgctgcagtggcataatagagtaattgtgctgagaatgaatttgtctctaggcccaaaagcctaaaatatctacattctggccccttaagagtttgctgaccttgctctagcttgctaccttccactttctaccttcttattcctggggttctcacgccccagcccagacccttccaaccctcacaggtgcctgtccttgatccctctcccttcccttcagcatctacacgggcgacagcttcgtcaccccttgatggggcagcctcttcccctcatcacagactatgctgttcagccacatgtgggcacgggtgagtggaagtcaggggagggagagaaagttgggggtcctggaggagaggggagggaaccaggaggaagaggaaggtgggagtgggagatcctcatatagggtggtctgagtggggaatgggagggaggcacagacagagaaagtcgcaggggctggggcggtgcaggtgatgatgatacatctggaaaagcaaaagccaaggtcaggttcagtactcaccatggctgtgctccccaaggggcagtgaaggtgactccagctcacagtcctgccgatgctgagatgggggcccgacatggcttgagccccttgaatgtcattgcggaggatgggaccatgacctccctctgcggggactggctgcaggtggtaccaccctatgttaccccatcctttgggggctctctgtccccctaatcctcctcctagtttcttatttctctagaggccttcagtctttactcttgccgctttttctccagggtcttcaccggtttgtggcccgggaaaagataatgtctgtgctgagtgaatggggcctgttccggggcctccagaaccaccccatggtactgcccatctgcaggtaacctcattttaactcctttactaagggctaccccaaaagggaatgtatggagcttaagggtgacaataggatgggctctgcacccctccgttagaatacgagctccgtgtcggttttattcgctattgtatcctcagtaccaagggcctggcatggcatggggtcttgtgcccctgggagaagtcacagggccggaagagcagtggactcaccctgtctctctttcagccgttctggggatgtgatagaatacctgctgaagaaccagtggtttgtccgctgccaggaaatgggggcccgagctgccaaggtgaggctgcagtgtaggaaggactggggccaggggttgggggagctccctgagaattggaatgaagaaatgggaagcaggagacctcctgccctgaagacctctccagctgtggtaactgagaggatgtgtgggatggaggctgggcggcccagcaagggctggctcatatccttactcaagcccagaatcttggcaagaggcttgggaggtcctttctgagttttaaaatgacctcagaggccactcgtcctatctgtggaggtgcggccgtgcaggaagggcaacattgtctaaagtcccctttctctccaggctgtggagtcgggggccctggagctcagtccctccttccaccagaagaactggcagcactggttttcccatattgggtaagggtagggtaaggggagctcttgtggagatggggaggggggactgactggttattctaagacttcacgaatgtcctcccggcagggactggtgtgtctcccggcagctgtggtggggccatcagattccagcctacctggttgtagaggaccatgcgcaggtgggtaggaagaagcacccggagggccgagtgtggcacagagcacctagcccaggagtcagagctccgcagggccaagtcccgctcctgcctggtcatgtgcttcatgctcatagtcatgtaaccttctgcgcgatcaaggctccctgaagtggcatttctttatctcacccctgggggaacctggccactctaagaccacatgaggacgtgaaaaccaagtgacatttacacctgtcagctgttcttcctcactctccccaaccccttcctacttttgcagggagaagaggactgttgggtggttgggcggtcagaggctgaggccagagaggtagcagcggaactgacagggaggccaggggcagagctgaccctggagaggggtgagtgcctgagctggggagggatgtacaggggagcgggggcctgggcatctgggcctttgaggggaacagatcccaagatacagaaggtagggtcaggaaagttgggaatggagccaaaggggacagccctggtctctgggggtgggggttggcctagaatggtggcagcagtggtctgaggtcctagaagccaaggttccaactgtccccattctttttctgtttcccagatcctgatgtcctagacacatggttttcttctgccctgttccccttttctgccctgggctggccccaagaggtgaggtgggttgagagggcgaaagtgaaggggaaacgataaggaagggatggctgggcccccacagaggcttgaggggggcctggggcctgggcctcttactgctcctcttccccctagaccccagaccttgctcgtttctaccccctgtcacttttggaaacgggcagcgaccttctgctgttctgggtgggccgcatggtcatgttggggacccagctcacagggcagctgcccttcagcaaggtaagagcccttcagtgccctgccgctttctgtgactccagtgttccccaaaccttgtcctcccttctaacccctaatgtggtcctttccacgttgctgattcctttttcctaattcacttcctaccctacccccaaaagtatggaggccagagatcccaaggcacctccaaggaaacccccctctgttgacccctccctgcccccaggtgcttcttcatcccatggttcgggacaggcagggccggaagatgagcaagtccctggggaatgtgctggacccaagagacatcatcagtggggtggagatgcaggtgaggacgaagcacccactagagggacaaggtttgcagggtttgcaggagagaggaaggcaggctgagggaggagtgaggccagcaggtgtgacccttatagaggcagggccttcgacctgggtcgtgaattgcccccttccatccccaggtgctgcaggaaaagctgagaagcggaaatttggaccctgcagagctggccattgtggctgcagcacaggtgagtcatcgctgcctgccccccaccagctctagctcaccacctctggcttcctctgcaacccaggtcctggccctgcagccacaaaggcatctgccacccttcttcttcctctggttgcagaaaaaggactttcctcacgggatccctgagtgtgggacagatgccctgagattcacactctgctcccatggagttcagggtaagcctgggcgaggggtgtcggggtgagcagagggcagcgggcacctgtgcaggggcagggcaggggcaggacttctggtgctgctgccacctacatgcagactacctcgattcttcccttccagcgggcgacttgcacctgtcagtctctgaggtccagagctgccgacatttctgcaacaagatctggaatgctcttcgctttatcctcaatgctttaggggagaaatttgtgccacagcctgctgaggaggtaagagaaaacagaggtgcttgggagtagggtagtcaggtgtcagagggccaaggtggcatctggaaggaaaggaggcaggggagggggagtcaggccatcctgccccctctgcctgcagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggtgagtgaggctgggggaggcttggtattcccatgcctgcttctaattcctctggaaatttccaaggcagagagctctggagttaataagttcccaattgtcccctcagttaggagaggagaggagacgagggagtctcagttcccctcttcctgggactggttttggcagtgcagcccaggcactgttgcctgcctgtcacctggggagaggaggaggagggagacttctagaaatgtctgacaagtcggtgtcagaaggcagaggggaattttttcagtccctgtagttgctgagtttggcccatgggcaggctgcgtgctgagagaggcctgggagggactagcagcggtctttagaccaggggttctcacgctgtcctacgtccaaagcacctggagggcttgttgacggtggatcccccccgctccactgccaccccagagtggctcctttagcaggttggggtgggggtgggtggtgtaatgaatattcatttcttgtcccaagtggtgctgctgctgctggctgtggaccactgccctagctcagccttttaaaaacctctgtcccctgttgataagcaaaaaactcaatg

SEQ ID NO: 350 - DNA, 37329 bp, Homo sapiens
gggatctccctctcctaatgcaaatgtggccaccatcccactggctgacgcctgcccttggaagtcacaaggcagctccgagtgagagtagaggaagcacagcagtcaccctggctgtgttgagggagccaacatggaagctgctccccgtcctgctggagggatagagacccctggagagacctcaccatgcacagagaccctcctcatggtcaacactcacaaagcattgtcttgtatctgactcagattgctactggggcagccatgagaagggaccttgcggagctccaactacaggaagcataactgaccaagggcctacggctgtgcttggaagtccaaggcagggtttgcacagaggcctcgtccccttcatgcctgctcctagccaatgtcccagggcatgtaggtataccacagtgggcaaggctcctggggcacacaggactcctccggctcctcttggatgaccttgccagcttacatccaactgaagtctagggcacattcacctcccctctgcccatctccttcacatgcagaactttctgaaggtctctacctttcacagttgccactccatgtttttcctcacaggtgtttcctctactgcaatctgcacacttgatctagtttgggcttctgtttctcagaagacccagattcagacaccactcccacatctttgagtcagaagcctcaataacaccttccctgctacagtgtctggccccagaattggcgaatatgttgggcaagcagtcttatctcagtggtggtcacacacttacccttgaaaaaattggggctgcaggtcaagcatgttcaattcacatgtaaatggatacgattgcacgtaaactttctatgactgtaattttttgaaaggtaggtgttaacattggagaataaaatctcttgggatgtaccaaaaatgtttgtaaacacttataatcgtagagcatataattgtcatttttgtcaccacaaggtagttgcaaactaataaaagagggaagaaataaagcaagaagacagagaggaatatgtttaaccatctcaattttatagaaagataaggacatttaaaagacacgtgggaaagatggtgggggtgggcctgttgaagggacagtattcaaatgaagtaattacatgctaagctggaactatggtgtaagatatcattactcaccggcatgggggatcatcagcacactggtgaggagaaacgcaatcatagcaggagaacaaaggatggggcttaggcagcaactggaacggactcctgggagagaagccagcagaataggatggaagcattttcagaattcccatgaaagaacccatgggacccccatgtcctttcttggtcccacaaggcatgtggtaaaaggagaaagccctgaaagggtgtaggtcccagttttgccactaactgacaatgtgcctctaagaagattatgttccctccttgagactcagtttacccatctgtaaaatggaaatgtagccatgagctccctgaagacacagccgtgggcttctgtatttactgattgattccatggtcatttcttccaggcctgcctcgtgtcaggcatcaaaggattgaggatccaggagtgcaaagtgaggagaaaacactccttacctgagttgctcatagactaatgcggaagggaggcaaggtaacaagtgctgtagtttgacttttgttaattgaattttaaatagcccgtactttatgatatacccagcattcccaatgcacctttggcatgtaggttttgaacctttcaacgatcacttgacatagaaataaatccgacaaccacatggtggcgctgcatgctagcaaacaaagcttttccggcagcatctccctcttccttcccttcctcggcttttgagtatttcgaatactttgttgaggtcctgagagttcaatagatactcctcggaggatgctttgggggcaaaggggagaagcgggcagagtccagcaaccctactgcttttcaattgtagctgccgtctgctgagatcagcaaatatttaacttcaataagcccttaacggactctagccaatccattatatgtttaacagggggacggggtgggaggcgcagggaaaagaccagagggattttaaaataatatttgcccccttagaatataactccataaataatgtaaatacggttggttgtcttgtgcatattctgcttttagaacatgtttttgggacaaagtatgaatgataacacatcttgatccataccaccctagtggcacacacagggctgctgggtagggctgtacatgttgtgcactgcacaaaagcgcttggtcaggagggtcaactagatgctgaaaaagccagagcttgactctgaagcttgtcctctgcagtgttgcatcaacccgaaggaaggagcactttgtaaaatttgttctcccagagaccaagactgccccgtattctggtggtcttgcatatgtacccagggccgtgacgggtcattctgcctgtgagcaaggcttggtattagggaaagtgtcccagaggagaagacattgtaggttgtacaatcactactctatggacctatcccagggtctagcacaagctctggtggctgcaaaataaatgtttgttgaatgaatttttttaaaaagggtagagtgtgagttctttgagattcttactcagctcaagaattctctagtaatctggttactgtctcattggtgcaacgctctgcttagagccttttttagccacacaaattcctaaagctggttaactttcaaggtgagacagtctccctcactgtttggtggaaattcagttctgaatgattccttctcaggccatgaaacaaggctgaaaattaagggggagacaagagaggtctccaaatggaaagtggtatgccctggaaagtcttgtggttagcagaaggcacttcagaggagcccagagacctcattgaaatgatacccacatgaatgggtccaacatgaacttggacaatgtagtcactttctgccactcagtatgtcaggtattttattgtgaccatcacaccatgacaggttgccagcatgtctgaacttggagtggcattgggatcttccagtccaagctcctgttttacagatgagatcattgaggtttagagcctggcaaatcatggcaagaatgtccagcttcccaggtctcctgactccaagtccagtgtcatcataataacagtacctatctgtgaggctgttgtgaagactgaaatgagttaatctttgtgaggcacatacaacagcgcctgacatagagaagttgctcaaaagcattaagaattacaatgatggcatctggctcgaggtcaaaggctcaataagtagtagctgctacaatgaaggcctttgtgctgttccctaatcccctgtaagagtggaaggccctgtctggtgaatgaagaagaatgatcagttttgcacagtggatctctgtttttcttttgtgacacatgtttcaggggtgcattcccctggggagttctgcagctcagataagacggcctgaaggtcatgttccattacctccttgaaacatgttgcttgaatgcaaatgagccaaaatgactttattagagacataattttgactatgctctaatttatttttgcaataagttataaggaggtatgattgggtgttcttcgataatggggagagtttcagtaggggaagatgaaaaagtcctggaggtggacagtggcgtgattgcatatcaatgtgaatgcacttaatgctcctcagctgtacacttaaaagtggctgacatggtcaatattatgtatattttaccacaactttttaaaaagtaagtaataatcttcatgaccttattcctttaaacacaacatttcatggattaggtcattctttgtgtcaggtgttccactgagcatgccccacttgctgtctggtgacaaccctccaagactttggctatcaagacgtctcactttctagaccaggaaactgggctcagagggtgagtcacttgccagggtggcccttgcccagaagggggcgctctggcaatgaccagacccaggtgggccagtctgacttgttctggctccaataccctaaactgctaggccggtcctttgagacaaactaagcattccagtgatgactcactgcgtaactgtcacaattatcggtagtacttgcttgggaagacccttagggtggccagcttcttgctagggtgtggtgaaacacagcaggtgacagcttccttgctgcgcacaaagaaggaaagtcagtgccagctagaaggtgccagttagaagcacgtggtcagccctgggcaacagtgaggatgacccgaatctggggtacgtgcacattagggtacgtgggtgggatggtgtggggctgcttctgaaatccagtatcctcctgttggccaagtcaggcgcccttggctgtggggctgtgtctacctggaggaaagacctccttctcctaatttgcccaaggaagtctctggggctgtcgtggcctcatgggtcagtgctgtccttgtgggcctgagaaggctcccgaagcctcgccttggtctgcatgccaggtttggagtcccggctcccctagctgtctcccaatggccggtctcatggctgcatagccagtgtctgagcccaaggccttgctggtcggacagacctgggctggggtcagggagttcaggctctgccttttgcttgtcgagtgccctgagccaggcactgaagatgcctggaactcattttcctgggcagcgaaatgcatataatggtgttttttcatcagggaatcatgagggttaaatctgatgagtcttataaaggtagaacaccatctccggcacttgctcagtgctcagtgaggactgcccataattaatgctgattgtgtttccacaccaggtgccgtgggcggggtcattgcccagggctatgtaggatcctcactaatgtgaagtggtggatttttcccccgggtaaatttgccaggtgctctctgtctggcattgcatcttttcacagatcgactcagagcaatttgggttttcagctatatcctggagcaacatccaggtctcagacagccctgagagcatcccctaccaccttatcctccattcatttatctcctcatttcccctccattcttctctcccttcctccctctttccctctctccctccctcccttctaccctctctttctccctccttttcttccttcatcaatttctcctacttttcttccctcccctccttcctcctaccctttctgcctctttccatctcccaaccatttccctccctccctcactcttttcctccatccctccctctccccctccttctctttctccctcccttcttctcttctcccattcatttccctcctttacttgctgtcttcctccctccctccctcccctgctctctgtctccccaaccatcaggaataacagatgcctaccgtgaaggctccactggagtgcagctggatgaatgatgctagggtttgaacaggtgcagactgagtcctttataccccaaggaaagacccttagccatgtgatgcctctccccactcctcacatcaagaaggaagcctttcatgaatgttggcaggtgggctgcctctgaagggaggaggcatcataatactatagcttggaacaggtgaaggctccatattaagaagccccatcttgagcctcagaggagacctcaggctctaattagagaacaatgggttccctgttctaccccacctcacctcaaaggctaggaggcccatggattatgtctcagggtcatcatgggaactctcgggggatgaaagactgatgaaagtcatgtgggctctcctgcaagataaagggctggctttgtctggtctagttcattctttagcaagaggatttctagcgtgattcttcttatatgttcttggcctcagatctcggaatttgatgcctctttcctttagggcttttctgcccaagctgtggggtagggtgaggtggggctttataatcagacacccaaggttcctctgccagccctgctactgagtagcagtgtgaccttgagtttgtcactgctcagctttagcttccacatctgttaaatgggcttaatcctactaagatttcgaggctgaagaaagccatatatagtgtgtggtatgggggctcattaagtcctagttctttttgtcacttcctcatatcgccttgtgaagggttttctttcctgattttgaaaggagaactggcatttattgagtacgtgtaatgtaccacaagtgttttataggattttgccctcatcatccctgcagcagcccttccattactgctttcataatcctaggagcaaggattaattagctccactttacagatgagaaaaaatggtgtcgttgaggttgaggcattgtagaagctcacgtgtaatggaagcattctggaatgcaggttagcctggctgtgaaccctctgagttgctcactctatggccacctcctgaagaagcaggactcctcaaacgattaaatcagggcacaattgagcctctatggaagaacccattgaagggcttcttcaaataagtaattactctcattcattgaggcttgtgtttgtagatcattaactattgttcagcatctcatgtgatttgaggaatgaagatgcattgtctgtaatattttctcattagcaccaaagacccaccatctctaaaatgactaagcccgtgggcatctatggctcagtgcagcaaaatccatcttttcagcatctcaagagcatagctgagattgttattatgctcaagagcataactgagattgttattatgcctgagcaatacaaaggcataacaatctacataggtatcttgttcgagacatttcatggggttttgagaaggatcattttttcccatagcttacaacagagtatcttaatcttagcactgttgacatttgggccaaattattctttttttgtaggagttgtcccgagcattgcaatatcgcaggtctctactcagctgatgccagtagcactccctaccttgttgtgacaaccaaaaatgtctccaaacattgccaagtgtcccctgggggccaaatcacccctgattgaaaaccactggccttcaatatccctggaaccttggccttttaccattctgttggtggaataaagtgagagtgaagttttcacaagaacccagacataagaggataaagtctgttctaaatgagagtttaaaattttagatttaattatgacagcacctaaatgtctcgttcacacaaacccacagcactagtgcacctgtgcagaaatagggagccacacgcacacacacacaaacacttagaaccatgcactggggccaagaaacaaacacaatctttctcctctctcccccttctcctccccctttccctctcctctttcccttcccctccttcctttccctctccctcatcttctccctctcccttcctccttctctctgtccctctctttctttctcttgacaacttagctggtcttctgggcatgaatgaaataaacagaaatgtgcctgcacctttgctacctggaagaatgaagtttaatgacgttacgcatgtaactgcacaatctccttcatcagaacagatacagtcactgtcccatctctttcacctcatctgctaaccactggtggccacatacatacacactaattagtaggagttccagatcagtagcaccccctgaggctttcttattgccctagctatcccctaaatcaggacacattcagctcagaaggggtcaaacctcttatgaactccaggagaccagttggactccaggcagtcgtcagccactcctgggccctgttttccttctgcctttgctgctgttgtggctgatggtatgactgtagaaaactggccccaaggagtcctctgagcctttgtccttgatgctaggccagatccttgcataagcctcagaggtattccgcatttgagcttcttaaagattatagtcatgctcagtcattattcccaaagtatggggtaactgggttcacatgggtttccccacaagtgaatagccccagtcttgggcccaagccatccatccattcttcaccttccttgatgataagttactctttgaggaaccttgaggaccctctcctgtcaaaggtccttaattaatatccacgcaagggttgaatcaaattaatccatgcttaatgagtttgcttggttcctatccaggtagaagtccctttgcctcccagaaaatttgctgtatcctcttcatctttgcaaaagtcatgataatatacatttatgagcttgacatttgcataacttggagagtctttcaagtgttctggagaataaaaagaaatctttctgcatatgattagaaagagaaatgtctggctgctcctctctccaatgtccaagttctacctccccaggcaccttgtggttcacaggagtgccagggaactcaggggtcttccaatggcagaaactgttttctacttagatgatgaacagaaagtgactttcctcacccaagggcagccctaggtcacaaaagggtaaaaaaaatactcatggcccagcagagtcctaaggcaagagagtggagaaggagcaccaggcacatcaggagaaaaactgtccctggtaatgagaaataaggggtccgtgcagagccactggagagggcacacatgctctacgtggagactcagcatagatagggatactggagcaaccgcaaacctgaatatagtgaaaaaggaatctgatacaatgaaggtggcaaatcagtatgtggggatgcagaagaaagttgactccacagacgtactccacagatgagctcaaatcctgcacctttcagaggaacatctggtccttgaccagctcctggggaatcccctgtaaatccttggaatatcctgcctgatgagtgtctcttgtacctggggcttcgtgccatgacagatagtttatgttaacaatgtgatttatggtggggccttaggtcgtgcagtatcagcttgacctctagagggactggagactgaataactaagtttagccatgcaggccatgaaggcactccatacctactccatacccccaaacatcccctggacaccaaaacttggatgagctttcctggctgacaatactccacgtgttgttaaacattatttctgggaggattagatgctgactgtgcaaccccactggaagcttgtgcctgggctctcttggactctctctagaggtgcctttcacatttgctgcttttcatctgcatccttttgttgtaataaatgctaaatgtgcatataacagttttccctacctctgagttctactcatgaatcattgaacctgagggtgctcatggggacctctgaatccagtgggtcacacagaagaggaatcaagacaagatgtcaataaaaacaactctctaaacctcctcctaatgataaagttttcattatcgcccacttaagggggcttggaagattatatagatcccataccatggcaagtctgattggttgtacatgtattagttaactatcagtatatgtgaatctctctagagtatgaattcaatattaatttatgcttttgttgtctttcaaaagtctcaagtttaagtcacctcaggtattgtgtcagagtctccatggctgaactggtttgtgcaggctagagtgcccacgcatccccagtttttaaattgtcaggattgcctcaagcattgtaggagtttcttgagcatgaacactagatttccatgattttgaagcaggcaaggagtctggcattactgtattaattgtgaggcctctaacaagaaaacttctaccttcaatgttttgcacagattcacaggagagggaaaaaaaatgctacttccaagaataaccactttaaattaactgatgatctagctggagcctgggtgaattcttcaaatgtagcccacttgggacaagagccagggtggatggcgtatcccctgaagtaattgttatgccctagtgttattttcaaggcctcacacagacttgcagatattctcaaggcacttttgctttaaggctgaaaaaaaagcagaagaagaaggaactcaaggtactgagatataaacactgtagagacataaattaaaccctgatgtcgccaacaagggtctagcctcttccggagagcaagtgtggggcagtgcactggacaggggtcactaggggtgagactcagaaggtggaaaagactcatgcaagaccccattgctagttagcatcaaagtctagtgaggagcagcccgtatttctccactcactgcccaatgctcttttccaatacccagctgtatctaacgcatctctagagcttgcacgaggctaatttaaactcattaataagttgttcagtaaatgtaatacgttgtgtgcatagagattttaatgtggcaaggacgaaagaactattgaattatgtgtttgcaagatttcctatttcctctcctcataccagataaagggatttctatctttgatttctgaccaccccacccccactcctaatgcctatatattttttggtcatttaatgcaggatgaaggtgatgataggaagagaagacaggaaaagtgggatggtggacttgcataagaaataaggaccctgtgtttgggaaagaaaaaaataatggaggcagaaggaaagcaaagtaagcagaagaggtaaatggaaacacagagaagagccagagagcttgattttaggagagctactgagtgataagttgaaaaatgaaatataaagagaagttttaagatgatggtttgtgagaagtgagaaacagtggagggcagaaagaataagaagtttctaagaagtgttgacatggatcccagggatcccagctggtattcttcaggacccaaatggaaagattgggttattacactgtttcgtttgtttgttcaaatgtaaaacattgccaagactgagccctgtgagcacccagcttatatttgggttacagtaagaagggattttctatacagtttaatgtaattccatgatatttagaagaccagagtcccttgaggtagttcaggtagatggcatgataatggccaaactatgggttttgggatattttttgcagaagtgagagataaaaaaaagctgatactggaatatctggaaataaatgaagttttgaagctaccaggacaaggagagaggtaccataatgaaacataaattctagtacttcacggtgccttcttttgcatgaattatttgtttgcatttttccttcagtcaagaatttcagtatttgtgggggttgtcccccacaaactgctctgtggcccaggctggagtgcagtggtgcaatctcggcttactgcaagctctgcctcctaggttcatgccattctcctgcctcagcctcccgagtagctgggactacaggcatccaccaccacgcctggctagtttttttgtgtttttagtagagacggggtttcaccatgttagccaggatggtctcgatctcctgacctcgtgatccgcccgccttggcctcccaaagtgctgggattacaggcgtgagccaccgcgcccagccttttatttgtctttttagcttacataggagctctgtggctaagagatttgcctgagttcacgcagagagcaaaagtgcttggtcaggctgactcctgctgtgtttttcccttgaccttattgcaaacatcaagctgttagctgaaagggaataagaaaaatcctaggtgctctttgtcccaaattaatgaggactagatgagctacagcattccaaagacatctgggaatcactcagatttacaggacccttttgtgtaatgcattcactgcaaagttacaacatagtcaagctgtgtacttactgtgcgagtgggacacccttttcaccctctgacagatatatgttgcattcttcagaaaccaggaatagtattcaagacagtatctaaagatttaaatcagagcagggagcaataactatcctgtgatggctattagaagacagccagagttttaaaggtaagcacataaacatgaactatatggccaattattcacagcaaggaaccctctgcccatctttaaagggtgtcagaggagagataggaaagaaggctgggtaggaagaagttcagactttggggccagcaagacttatttttatccctagccccactgcgtactaggatgcatgacttcagggtgataacttaattctctggactttaattttctcatatataaatgaaaggcaataatggaacctatactcgcaggttatataaggataagataacatatgtaaagttcctgaacagtacccagcatacaagaggtgctcaatacatggtgacatttgtctgtttgtttgcttatttattttagtgggagatgagagagagagtggagtgctgctgtcattatcaatgcagcaaacactttgcaaaataacattctgttcttggtcagaggtggcaggagctgcatcagagggctgtggtgaaaagatcactcacccaattaataggaagaagagttctcagtgcaggctgtgtcaactagctcattgtatgactctgggaattcacttctctttcaatctctcacctgatatttgaggaggttgggctaaacattctctaatttctcttccacctctaacattctgtgattctagcacaccctagagagttgtgcaactaattgctcaagtcaagctgtggtagagattttccaagggctatcacccccaatttataggaaagtgcaaagctgaggaaactgaggcacagagattaaatgacttccccaagggatttctggtggtagtattggattttaacccaggtaacccactttatgccagatcacactgtcattctggtaggcaataagatcagtatttgagtcaggaccctgccaggaaagcaggacttggtggttctatagagggactttaatacgatgaatcagtgataaagggctgaaagaaccaacaggggaaggtgtggtaaccccgcattagcagccacagggagttgctgggcctggagggacagacagagaaagtactgtggccaaagcacagagggcaatggccttggtggcagctgggaccgcagagctgaagctgttatgaggattccttgtggaaactggaaccacagaggaaatagagccgctcctggaaatattgcccaaagcagaaagggagggggagaaattccctggcttctcccctctactgccctccaatctcctctcagtatcttctatgggatgaactcactggaatctggttggcagtgtgttctgggaaaggtagtttgcacaagtcagccccttcattaaagagtctactagagaatgggcaggaaatggaaccaagtgtgaagaagcaattgatgaacacatccaggatgctttttgtgagcttacgaacctgtactcttagggagacctttcaaaacttccagagataggatgtcaaggttggccaactcaacagctgacatggccactagatatctggttagcacagctacaacatgtcaagggtgctagcaatgggattcccacttggctgtgggagtggacaagagagcaaccacaacagtgtcttaatcagcaaccacaaagcgcagcgttccaggtaccatgcaggaacaattagatatattatttcatttcattttgttctcacaacactgtcaatatgagactgctgctacccttttacatgaatggtgctcctggagttgtgcaacatgtggtctagaatgtaggcaggactatacccattttgtagatgaacaaactgaggttcagagattgaatgactagctcaagaccacatagcttgtaagtggcagagactaaatttaaacccaggcctgcctggcttcaagccctgccctctctatagctcactaagctacctactagctttgagggccttggctgtatggtctaatcccatttcttcttagccagtgtaacaatctgcaagtcatactttcttacaacagcaacaaaacttcttagaaagcttctgtgatagaggatatcaagcaactttggggcatgatctgctttagaagttcatattgctagatggacaacatcatccaaactaaggtgctctgtgaaactgccaagtgtgaggccaggatttaagttgcagcaaccacagaaacatgacccacaccttcatgagccaaaaagctgccattctgtgcctgaattcactttgaaagtgtacaccgctctcaggatgaatgagaatcttgcctctatgatcaggagagaaactatttaaacacgacatgtcccatccccaagctttctggcagaggcatcccctacagtgataaatgaacaatagataaatgcccctggttattactttgtagggaatggagtcaaagtcctgttcataacaagaatatgtattcctcacatggactggaagaggcatttccttgcagaaaaggctagatggtcttagaagaaaatcagttgttaaggtggcctattttgtttgtcttcagttcttcagggcagatataagctgcaatgccatggctagcatgagctgaaactagtgttgaagcacccatgattacaccagccccttgtaggtatgtctatctaaattcctagcagaccagagctgctgcacgcactgtggagtcagcagcagcctgaatagaagaggagccgtggacacttcactggggcctgaggtagcaaaatttgtaagtcaccagggactgtggctttgttatcctgcaaggagtgtgccccaagaatggttctggggccccaaataagaaagatttcaagagatgaccctgggagggagatgatatgaagagaatgggagtttagattatctcagtttaaaaatggacaggatttagagggctgcacttcaataattctgtatgttttatttattctgaacaaggagggagtagaaagcttggagaagggacagatggagctctagagtgaaagtcaaagagggcatataataagttacccaggtgcttaaaaggcaaggtagtcctgaatagggacatgccagagacttggtctcccatctttgctgcagctacattgaacatctcagtggtccttagatgctccaggctacccgtgactccatctttgcagatgctatttcttttgcctggaaaactcctattcctccataaagccctattagttatttctcctgggatcccatagcatgttattcaggtctgctacagcacttgtcagctgctttgaaatttgtcttcttacattgccaactttcccaccagtgttttttttgtttgtttgtttgtttgttttttatcacagaggctacgttcagcaaacatactgagtaatgccacctcccctactctagtatttttggcctatattcagtgtatgagtttatggaaaaatgtactattcagtgaaaatacacagaaaagaaggaacaagcccaagcaaacaggtgcttcattgctctaaatttaaactcaaacttctctctgaaaatttatgcctttttcatttattcattcagctattatttgcaatatgaatgttttcaaatgtgatattttccaacgggatatgattaacaggtttttgcctggttacgtgacttggttctatgatctataatactatattttgatttgtgtttatgaccatttcttccttccaactatgaaaccctcagtttctgaggctatttctgattcacctctagatccccatggcttgggacagagcatcacagatatacagcagagactcaatacacattgttggttaagttaatgagtaaaggatctcctaaagtgggcttaacctagacaatacagaaagtattgtcgtaaaagttttctttagaataaacctgtgctttgggtctacaggtcttgcttattgccctctatgaatggaggaaatgttcgtactgacgggggggggggggagggggatgaaagattacagctggaaaggggtgatggaaaatggctgtccacctgggcttcagactcagaggcagaaattttaaaagctaatggatcttgagagtagtctttgaaaataacattaaagacaggagagattggtatccaggccactggagcaggagtattcatctatgtaatttagttctgggtttacagccaagaataaatcccagaagaaataacagtatgtcagcattgtaggacagaaaatgtccatgtctagaccttcttaatataaaacaggttctgctttttaatttaagttttccaacttattttgctggtggatgattggtagggatttatgaaagaactggaatttagatagacatatcttctaattattctctcctagcaaatctcgccaggctgagggcatttggattaaagaaccactcaagatcctctgccatgatcctctgccataattctacttaacatgacacaagttaacttaactcaacacaacatatctcaatatagcttaattaatctaaactcaacacaattcaacttatctcaactcaactcaactcatctcaactcaacacagctccactcatctcaactcattacacctcaactcaactcatctcatcacggctaaactcatcccaactcaactcaactcatctcaactcaacacaactcacctcatctcaactcaacacatctcaactcaacacaactcaactcatctcaactcatcactattcaactcatctcatcacagctcagctcatcacaactcaagtcatctcaacttaatacaactcaagtcatcccaactcaacacaactcaactcatctcaactcattacaactcaactcaactcatctcaacacaattcatctcatcacaggtcaattcatctcaactgatcacaactccagtcatctcaactcatcacagcttaagtcatctcaactcaacacaactcaactcatctcaactcaacttatctcaactcatcacaactccaattcaactcaactcaactccaattcaattcacctcaactcaattatacttattgtgtcaggcactgcacttggttctggggaccagctatgaatgagattccatcatgaatctcaaggatgtgactgtctagtaaaggactcactggagagtcccttaccttgaggtaacccctactgcctgtctgtggattgcttattgcctgactgccttgtggcctgcagaaaagccacacggaataagaaagctataaatattccatgtgaaaagaagccactgggccaagttacctcatgtcctctgtcctgggactcctctggctcatgcagaggcattgctggaagaattggcacagctccatcaggcatgggttgagcctctgaatagccagggtgagaggagcagctgccatagctcccaccttgaagagtggctgaggacaccctagaagatgcaatcccagaccaattaaatcagtaagagtttagtaagcatcttctcttcgttaagccctgcatcaggtgaatatagtcttgtcctgatctcacgtagctctgagacagacaggtaaacatagcattcctcaccattacccaataaagctactgtaacagttttaagagtcaggtggaaagaaggtggtgatcgagtttctggaggaaaacagagatagtttcactgagaagcaaatattaaacagagatctaagatgttgaacaggaatgtatcaggtggagggcatttctggtgtaagggacagggcatacaatgactctgcgtgatgtaagggggtgacttgctgagggggatttgagaaaaatttgagtacaggggatatgaggtatgtatatgcatgtgtgtgtgcagggtacatgtgtgtgcatgtgtgtgtatatgtatgtgcatgcatgtgagagcatatggatatgtgtttgcctgtgtgtgtgtgtatgcacgtgcatgtgtatgtgagtgcaaaaaggagagaaagaagggcaggttgaaagatgagactggcatgctgggtcactggagagtcaggctctgcgtttgtgagttctgtgtttccatcaagtgaaagttaattatgtttccgtgaaccagattttcagtgttgtttaatttttagtttttaggaggaaggccaaagataaaagaaggagacaacaaattatttttaataaaaattccaacttgttgggatctgctgagactcagaaagcttcctatggctacacctacatttccttatatggaaaatagggagacccatccctatcatatagaatgactggaaggattaaatgagacaatttatataaagtatattgcatattgaaaagttgtttgcatgaaacaaacaataaataatagcaattattattattatttatttattaaaaatttgttgagctccactacatgctaggcactggtgacagccactagagctacaaaatgaataagaagaaaaagggccttcctctcacagagcttactttctagggactggaaggttatattacaatattactaataatcttccaacaaaggttcactaatcactaccaggaaaaattatctaaaacctggaaataaacaaaaaggattactgaatacccttttaatgcagtttggttattgtctagcagactctctgcggattgtctgggtaaaaataattgtgcaccattaattgactttctattgaataggtgattttacaactagcaaggggtagatgttaaccgatagcaatataaataattcttgtctaagagcaatgctaattatttctgtccatagcaatgtaaatgaattttgtctggtagaggtgcaattgatttttgtccagtaaaaaaaaaaaagagtttattgctgtggaatatcaattcatttgagaattcctttgactgactacataaatcttttcccctcaaattccccattgaagcaatcttcacatctttctggtttcctcattacttaatgagttcaataatatctttgacatgttgacatgtattcattcaatattattctgtcatgtttgaacatttttcaaaattataatttagcagtaattacttatttttattttttatttcttgtagagatggggccttgctatgttgcccaggctggtctgaaactcctgggctcatgtaattctcccacctcagcctcccaaagtgctggaattacaggtgtaaaccaccacatctggccaggaatatatttatttaagtggagaaggggctcataatgttagcagaagactttttaagaaggtagaaagaaaatactttattctgagttaactagaagataaaccctccagaacactgaccaatttccatcaatgtgcccatgagtttttctctatcagttattgagcagttgctatgtatcaggcactctcctaagatctttgcatacattattttatctaattctcataaatcttgtgaagtagacatcagaagtatacagaagaggacacagagggtctgagtaactctgcagttgtatcagttatgcaacagggagtaactccagcaagatctgactctgaagcctgtgctcataaccatcacacttcactacttgaacataattaacattcccaaggcttgatttccatgtcccttgccccaacccaccccatccatccttctctaactcaggaaatgacacttgggatattcacttagttgctcaaacttgggcatgatttttggttccctcctgtgctcactccatcatcaccgcatcctcttggttctatctcctacatatcacccaagtctccctatccacacagtcacctctactttccagtcaccatcaccactggcatcattagcacaacagtcacctcgcaagtttccctgcttccagcttctcctgttcctccccattctgcagtcagaggaacctttctgcaacacaaatctgatcacattactcccacttgcctcagaagtctacactccttgacatggtgacaaagtactgttaatctcactcttggctacctctctagcctcattccacactaccctcactttcagcaccttcaacatcagtccttttaaggtatagtgcctttgcttaagctatgcctttgcttagaatgcaccttgttcaggtgccacattctcaatcaataaactcttgaaccatcccctcacctgaaggtaatctcttcctctctggatatacatagcagtttctgcttctcttaagaatctagtcactcttttttttcaattgcagcttttttttttttcacatatggcatatcttggaaaaggtgacacagaggtgtggaataagcacaagctttgaaattagatctggtgtcaaaatggagtctccttttatatgtagaactcaccataattcctgaatgagatattacctctcctgcagaattattgtgaagagaaagtaaaaataggcctagcatagtacctggcagtacagtaggagcccaataaatatttattaaatggatgaatgagtggatgccaaatactttgtggcatgattttttttttggatgagcagaataagttactgagaaatgccagaacccctttaatttgcaattatgtttttcattacataggtagatagatagatgacagatggataggcaaatatctatgatatggaagttaagaaataaagataaccagatagaaagataaataggtatggatggataggtgggttaattgaaggatggatagatagatggcttggataaatatctattagatagatgacagatgagtgggtaggttaataaatagatagatatggtaaatacctattaggtaagtagatagagctaacaagagagacagatagatatagttatacagatagctatagatacatggatatagatacagatatagatatagatatggatatagacaccaatatagacatagatatagacagagtcaacctgttttctaaaacttgatctcacaacagcctccatctgcaccactgtgtttctttagaactcctgggagaaaagggatataatttccttagtagcataatcacatctttgtgtctgaaaggttcattcactattcactgcaggctgagagtaaggctggggcagatctaaggtgacatgaaaaaggagacggggcagggtccagcagtttaataatgccctgttgacatatgactggatggtccaggagctggtgtacaaaggtattcaggagtgggaggagcctgagaattcaagcagctttgaagcactcactttgtatccatttctttcttatggaatctggctcaacagaaaagaggagagtgagatgtccaaaagcaagctggaaaaatgcagcaaaaaccacagcaactcaagtcctcagcctctgtcaggagttctgaaaacagagctacaaactcaggaaatggtcttcgtctagatccatgagaattaactgtgcagggatggaaagggtaggtatcccttaacacagaacaacaggacatcatacccagcaaatgaggttgcattttgcagtcatcttttttattccttcctccttcactgccaacaaccctgctccttgcaagagcagcttctatttgcaaagtgcccagcatgctacccaatagacattcactcgataaaagttgattgaattaagttctacagagctctatacttccaaaccacttccacaaacattatcttacttaatacaaaaccttgtgggaaagataaaaaaacaggcatttttagtgcccacaaaaattgcaattattcttgctttacagttgagggaactgaatcttggaagttgagtactggaggccacctcaccagtaaatggctgagctaagatttgaatcccatgagtctgattttctaaatttaccgaacaaacctctccttattctactacatgaccttgttcaaaataaacacaagcaatagtaatgactgggcactggtacttacttgaaacttgatggggtcttgggaccaggactggctcttcaccagcagtgaatggccactctgcagagagatcacctgcaaagggcaggaatggccttccagaagtcagaatggaattaccttaggtgatacacacagcaagaaatttataacatcttaaaggtaaatcattcttgaaatctataggaaaatgatagccaaaaaaggggaagtgatttatggaagaccacacggaaatttagcagcacggcaaggcttataaaccagttctcctgactcttttcctgcaggaaacaataaagcagagtaacctgcttagattgcttactggtaccccatcccaccacgcccttgtccccaagcttcccacccctcccatcccccacccccaaacccccacttccgtactgagtttctcacctgtttgtggatatctgggggctgttgccttggttggactcggagtctgtgtgccatgggtgaatgctcctgggaggagatgagagagaggtgagcctgcatctcttctagggggccctgagggagaagatgaccagggccacctatcctgccctatccaaccaatgttggttaagccaggtaccaggcagggctttaagaagcagagatgagtaagaaataaaacccacaatggagtgtgaaaaaggaaatgggaaaatcccatcattactgtgatacagcgtgatggttgccattggaaaccagctgacattggtaagttatggtgaccctgcacaggagagcgatggtgttgtacaggaagtgtccaatgtgggtgatccagggcaaagaaaaaatgagttaaaatgagttgcttctcattcatctgagtcttagtgtacaccttgatccatcccacccccgacaaattgcctgtcatattcatgacagagtacgggctcagttcaacaatttttgtatcatgttcatgaagccttagtttaagggtcacttcaggacttgatcgtttctgttaagattctggcctctggcgaaaccagcaatacagtctccttgtaggagaccagtgagagagaagctcaagcaggcaagttccgtcatatggataagtggaaggaaagaggtgaggctgagaaacagccgaggcacaggcgatggacacccagttcagctgggtcaggtgacatctactctaagtcaagcagcacagcagttctggaggagagtgggctttgcaggcacacaaagtgcatacataaagatcaggagatgtgggcagtaagcagtgtgctgtggctggagtctagaggaggaaggtggaggggcgaggtgaggctgagcagcaggcagggctcatgcctggaatttcaggcccgggtccatccatcacagttgtcatactgcttgttaatggacaatgaaacagggaaaaagagaagaaattggggagtgcgattacataaaagagagaggaactggggaatgaaagaaggagctttcattcatctacagatgggaagaaagaggtagggcaaaggaaaggagaaggaagagtttgcttcatgatcattatgttttcttagttttctgtgtgtgtattatattccaaaaatttagaaagtttatcaaaacagacaatgctaagtttaatttaaaacgggagaggtagaagtgagcaccctctcttacccaaggtagggctggcctgggatgggctgccaggtgtggccattatctcagcagcaggcgccaaaaggcttgtagtgttcatggcttcctcggtccctgcagtagtcggtggggaagaacgagtttcccagagagaccctccaggttttttctcactgatggtctgagcccagggcacggacgatatggaagcccacgtctgtctgtcagctgtcaaccactgagttctggccaccctcctggtagctgcacattcaaagtgacagtaacagggtacagacatgcttgaccacttcgattcagacatgaaattgctgagacattgaaacgttatcaaagggcaaatgcaatgtgaacgtgtaatataagtaatccaggggcttaaactttactctgaactgaaataaatggaccaaagtaagcattgttttcctaagcaccaataaacacacacacacacacacacacacacacacacacacacacaacctctaaatctctaggaccccaggcgtgtgtgtttgggggtcagttagctgtctctcaaatttatttaatacatttctaatcatgtgacatagtgaaaagattgtggggtctgaggtgaggagatgcaaacagattagttgtgcctctgtctcctccatggtgtgaactttggggcaaattgcttaactccttttagcttcctcatgaaaatgaggataccagtgttaataataacacctgccctccaacatcacaggattgttattagttaagaaaaatccttggctcatgctatttaatggagttgatttattttcctctacaccacccagtcatccttgtttccttgcctgctgacacctatcaattcttatctcttggggaagcctgtgtctcctctatgccggggtaggagccctctctgtgttctctgtgtacaatagttctttgtaggctggatcataactattggtttacttgcctgggctctctcctaggtctgagagctcaggaaagagagagaacatttatagagctgtgtttttaacagctagcctcctgtctggaaggaaatatgttttgatgagtaaataaatgaatgaattctgatgactgaatgaatgaattctgatgacaatattgtctcagtgggtccattgttggaacccactgagaaaatattgactcttttttgtttgtttgttttttctgcactttattttattttaagtcttaggttacatgtgcacaacttgcaggtttgttacatatgtatacatgtgccatgttggtgtgctgcacccattaactcttcatttaacattaggtatatctcctaatgctatccctaatgagctacctccattttatattatttccaaataggaaaaataagataagcatgccttttgtgtctttagtgatgacactgctgatcatgtacgcaagatgctggggaggcaggggcctcctgcaggtcattggcggcagctttcccactggtgttaagtcattaacatattcttggcatcattatgaaaccagctacagactgacctaaccatgccataaaatattgacttcacttcaccgtttcatgtgaatttcaggagcgatatcgctaaatgctttgctgaaatataaatacttttgccacaatgtactgtgattatgtaagacattagcattgaaggaggctgggtgaagggtaccagggaactctctatattatttttgcaagtcttcgtgagtcttaaactatttcagaataaaaaggcatcaaaatacatattagaaacacattatgtcaatggcattttctgcctttgtttgatcttgtagaacccataccggctcatacagatctgttatttaagtaagctgaagcgtaacttcagttggtggagaagggattaaggtaaggattttgcttatatatgtgagcctagaggtaacaggagcgagacatagcaaaggggaggaaagggtgagaatgcatcttacccaaggctgggagagtgtgggaggcactgaaccatgtggctgtggccctggctggaagctcaggaggcctgcctgtgttcagggtctcctctgtttctgaaggagcagctgtctctgtccagggagaggatctcagagcagatgcccagggtgtgctctgggtccagtgtccggggcttgtacttggtagtgttttctggcttttggttgtgggctttgaagtcctggcagttcccctggtagctgcaccttcagggaggcagtcaatggtaacattaacatgcttgacactttgggcataaaaaaactgaaaggtcactggactgcaaatatatgaatgtggagattcaaacctttctctaattaaaagtatcaggcatttgctatgtttcctgaacagattctgacccctgtcagagcctttcttccacctccagccctcagcctctccaggactctggtacatgtctttggaagaggaattagtctcctccatatgccttatggatacaactaaatttcatgtgcgtccgtgtgaagagaccaccaaacaggctttgtgtgagcaataaagctgtttatttcacctgggtgcaggcgggctgagtccgaaaagagagtcagtgaagggagataagggtggggccgttttataggatttgggtaggtaaaggaaaattacagtcaaagggggtttgttctctggcgggcaggagtgggggtctcaaggtgctcagtgggggtgctttttgagccaggatgagccaggaagaggactttcacaaggtaatgtcatcagttaaggcaaggaccagccatttacacttcttttgtggtggaatgtcatcagttaaggtggggcagggcatattcacttcttttgtgattcttcagttacttcaggccatctgggcgtataggtgcaagtcacaggggttgcgatggcttggcttgggctcagaggcctgacatgcctgccttcttatattaataagaaaaataaaatagtgttgaagtgttggggtggcgaaaatttttggggggtggtatggagagagaatgggcgatgtttctcagggctgcttcaagcgggattaggggcagcgtgggaacctagagtgggagagattaagctgaagggaggtcttgtggtaaggggtgatattgtggggatgttagaagaaacatttgttgtatagaatgataggtgatggcctggatacagttttgtatgaattgaaaaactaaatggaataagagaaggagaaaaacaggtataaaaggactaagaattgggaggacctaggacatctaattagagagtgcctaaggagattcagcatagtcctgccagcaaagattatttatttacttcaagagttaagagtggcagtttggggatagcaccagtagatatcagctgtgatggcttgcaaaaaaacagtgtaaaccggcagtgtaaacaagagcagggcatgtatgagtagttgagaacggtgaataggtgtatgactagacagaagatagtagggatgacaagttttttggggcacagtctaagttggtctggtgtctggaatgagaagcatctatacaggagcctaaatgggctgtaccctgtagcattccgaggacaggcctgaattctgagaagggaaagtggtaaaagtattgtccagtcctttttaagttggtggctgagcttggtgaggtgtgtttttaaaagacctttagtccattctacttttcttgaagacggaggaccgtaagggatataaagctttcactgaatactaagagcctgaaaaactgcttggctgatttgactaataaaggctcatctgttatcagactgtattgaggtgggaaggcttaactgaggaattatgtctgacagaacagaagaaatgactgcggtggccttctcagaccctgtaggaaaggcttctacctatccagtgaaagtgtctacctagactaagaggtattttagttatctgactcagggcatgttgagtaaagctaatttgccagtcctgggtggcgcaaatcctcgagcttcatgtgtacggaagggagggggcctgaataatccctgaggagtagtagaatagcagatgggacactgagaagttatttccttgaggatagatttccacgatggaaaggaaatgagaggttctaagaggtgggctagtggcttgtactatagtataacctgcctttgctggtgtgtggcgattaggcctggtggaactgccatcaataaatcaagcgtgatcagggtgaggaacaggaaagaaggaaatttggggaaatggggtgaatgtcaggtggatcagagagatacagtaatgggggccaggtgtggtatcaggaataatgtgggaggccggactgaagtccaggccaggaacaatggtaattgtgggagactcaacaaagagtgagtatagctgaaggagccaggaagcagaaagtatatgcatcagctatgaggaagaaaatagattttggaagttatgagaactgtagagagtgagttgagcatagtttgtgattttgagggcctctaaaagcattaaagcagcagcagccgctgcacgcagacatgagggctaggctaaaacagtaaggtcaagttgtttggacagaaaggctacagggtgtggtcctggctcttgtgtaagaattctgaccacactaaccatgcctaggaaagaaaggagttgttgttttgtagaagatgctggggtttgagagatcagtcggacatgattggcagggagagcacgtgtgtttttatgagaattatgccgagataggtaacagatgaggaagaaatttgggcttgattgaagtaatgggggctgtctgtgaagctttgcagcagtacagccttggtaatttgctgagcctaatgggtgtcagagtcagtctaagtgaaagcaaagagaggctgggacgaggggtgcaggggaatagtgaaaaaagcatctttaagatcaagcacggaatagtgagttgtggaggaaggtattgaggacaaaagagggtacgggttgggcaccacagggtggacaggcaaaacaatttcgttgataaggtgcagatcctgaactaacttgtaaggcttgtctggttttaggacaggtaaaatgagggaattgtaaggagagtttatagggtttaaaaggccatgctgtagcaggtgagtgataacaggctttaatctttttaaagcgtgctgtgggatgggatattggcattgagtggggtaagggtgattaggttttaatgagatggtaaggggtgcatgattggtcgccaaggagggagtagaggtatcttatacttgtgggttaaggtgggggggatacaagaggaggacgcaaaggaggctttggattgggaagaagggtggcaatgagatatagctgtagtccaggaatagtcagggaagcagataatttagttaaagtatctcagcctaataagggaaatgcacaggtggggataactaaaaaggagtgcttaaaagagtattgtctaagttggcaccagagttggggagttttaagaggtttagaagcctggccgtcaatacccacaacagttatggaggcaagggaaacaggcccttgaaaagaaggtaatgtggagtgggtagcctccgtattgattaagaaggggacgggcttaccttccactgtgagagttacccgaagcttggcgtccgtgatggtctagggggcttccgaggcaatcgggcagtgtcagtcttcagccgctaagccaagaagatctgggaaggagtcagtcagagagccttgggccagcgttccaagggctctgggagtggctgccaggtgagttgaacagtccgattttcagtggggtcccacacagatgggacgcggcttaggaggaatcccaggctgcgggcattccttggcccagtggccagatttccagcacatgtagcaagctcctgtgggaggaggttctggaggaacgcctggccgctgcggttcgggcgtttggaagttcttgtgtgctggagatgtggctggggtttgtctcacagtggaggcaaggaattgcaacttttttctattattgtacaccttgaaggcaaggttaattaaatcctgttgtggggtttgagggccggaatttaatttttggagttttatttaatgtcgggagcagattgggtgataaaatgtattttgagaataagacggccttttgaccttttagggtctagggctataaagtgtctcagggttgctgccaaacaagtcatgaactgggctggatttttatatttgatgaaaaagagcctaaatgctatctgatttgggataaagaaaaaggagcattaaccttgactatgcctttggctccagccacctttttaagagtaaattgctgggcaggtgggggagggctagtcagggaacgaaactgtaagccggaccaggtgtgaggaggggaggtgataaaaagattatagggtggaggagcggaggctgagggagaattgggacctagctcggcctggcgaggagcagcctggggaggaagggagaggtcagatgggtctgtagaaaaggaagattagaaagactcagcgacgcttggggttggtactgaggggacaggctggagggaaagaaggaagatttgggacgagttgcactgggcacagggactaggaaggactgagtgtgtaaaagaatgcctggacgtcaggcacctcagacagtttgcctattttacgacaagaattatttagattttgcaggatggagaaattcaaagtgccattttctggctatttggaactactgtcgagtttgtactggggtcaagcggcattgcagaagaaaataaggcatttaggttttaggtcaggtgtgagttgaagaggttttaaatttttgagaacacaggctaagggataagaaggaggaatggaaggtggaagcttacccatagtgaaggaggcaagcctagagaaaagacttgagacacagagaaggggtgggggtggtggttcttgccctccagaaaagtagagaaggggttggggcacagaaataagggattggggcacagagataagaggttggggtgtggaaataagcgattggggggttcttgccgcctaggaaagcaggacttgccgctaagggtgaaggagaaggggttgaggggtacttgcccctgccccaggaaagtgggatgtgccgctaagggtgaaggagaaggggttgaggggtatttgcccctgccccaggaaagcagagaaggggtagagacaaggagagaaggggttggagtacttgccccttccccagaaaagtgggacttgccgctaagggtgaaggaccaaggcaggcatccctgcgtggtctgacacccttgaaacgtgagtgtataatcagagaggcatccctgcaatgattaaacaccaagggaaggctgccttcccagtccgtgaccggcgctggagttttgggttcacggataaaacatatctcctttgcctctaccagaaaatgaaaggaattgaaattaagagaagggagagattgaagtgtggtgccaagattgaaaggagaaagaggttgagggatagtgagggaggttggagatgagagtaaaaagaggccgcttaccggatttgaaattggtgagatgtttcttgggctggtctgtctgaggacctgaggtcgtaggtggatctttctcatggagcaaagaacaggaggacggggattgatttcccaagggaggtcccccgatccgagtgacggcaccaaatttcatgcgcgtccgtgtgaagagaccaccaaacaggctttgtgtgagcaataaagctgtttatttcacctgggtgcaggcgggctgagtccgaaaagagagtcagtgaagggagataagggtggggccgttttataggatttgggtaggtaaaggaaaattacagtcaaagggggtttgttctctggcgggcaggagtgggggtctcaaggtgctcagtgggggtgctttttgagccaggatgagccaggaagaggactttcacaaggtaatgtcatcagttaaggcaaggaccggccatttacacttcttttgtggtggaatgtcatcagttaaggtggggcagggcatattcacttcttttgtgattcttcagttacttcaggccatctgggcgtataggtgcaagtcacaggggttgcgatggcttggcttgggctcagaggcctgacactaaaaaccaaaagtgaaatttgggggaataagaagctcccagacagaaacagcttgaaaaacaggctcccatagagttagcaggagggcttaattcagagggaaatctacccagcatccttggttgctccatgaagaaaagaaggaagtgggctcagatattagtttcactttatatcttccctagggaaggctcaagaggtggcagcagtggatatgacgatgacaggctcctattagcccatagagtcccgttgggaagacaaagactggcctatagtctggtgggcagagcctgtgttggattttggccctcacctcccccagaatgcatgtagaatgtgaactgtctaattgcaggagtggccttgcagcctcatttcctctctctgtgctacttggcccattaacaccctgcgtgcaacaccagcctgagccttgctcccagatcaaccagacatggggctaagtacatccagccaaactatcactcagccaggtacttgctttcaggcacatcaactttagcatcagcttgtaaatatgttctctcttcctaagcatttgttcttgttgaaggagcacaaagtgggacaattaattgagactggcgtgtgtgtgtgttgaggggggtgtggtgggaatgtcatggaaagactctccaaataaatgagattgactcaaccctaagatctgtcctgagaatcgggcaggtgaaggtaatctaccaactgcccatttcatcttcttatcaagtagtcttgtcccatacaaactgaggttccttccatagcataatcaaaagatgccctacaataaatataaagcaaagtagcccctgaagtggagttgcagatttattgtatccttcattgcacttcaagagaaagtaatgaagagcccactatgtgcaaggcaccaaggggaaggcaggctgtgaggctgaaggaaactacttattctaccttaaagttcctttcattgaggagacacacatagaaatgtcaactgtgttgcaacctggagtaacgtagagtccaaatgacatacaagtgctgtgttatgggaccgtagaagacaaagactgacttttattgggggatatttaaaaaagaggaggtagtgtctaagctggcaattgacaggcaaatagggttctgaaatatggaaaagtagggaaggagttccagatggagacaacagcatgcccaatgtggcacagaggggcatgagggtggggcatggttaggtagggactgggtattacagagtggccaggtctccagcatggggtcacaaattcaaatatctacaaaacccaagtagttaatatgagaaaaaagtggaaggcaacagggggcagacaggactatggaaaagaaggaaaaggtgcccttcctagtgggggaatgagagtggcagttactcagctccagttgcttattgccatgtgttggggggaagatctagaattgccagaccttttgcaagagaatccagaaattcatttttttaaaatgacgaagttctctgatttttaatacagtatagcgaaacacaacacctgagggcagctttcagtcattagtgtgccaggtgggaccctggtctggagagtctatgggaggagtttgggaggttggtactcacccagaacaccagacaagccgctggtaaatgtgtaattgataatgggatatttttcttctatctcccagaagtcagaaagattccttcctgcaaaaatcacaccaacagggtcagatcttgggtttcatctgctggacagttttgtctatttctcagcccagagagcttgtcaaagaatgtctagtggtttacctgactttcctgtcatcacacagatgaagatgcaatctgattcattgctttgattcactgtaagacaaacgagtatacaataagacttagccatgggtctgaagctgtaagtctttgattgaaatgaaaattaagttgaaagtacctaacttaggataatataggaaaataagcctgactctttactcttaaggcagtcctcattttccaatttctttattttatttggctgggtttgggggatggtgtagtggctaaggcagagtctctgaggtcagcttctagggttacatcagctctgccacttactagctatgcaaacatgaatgaattgcttgacctcttcaggactcagtttgcccctttataaaatggtgaaaattcaaatcccacaatccctcatttgtaattcccaaatgcccacatctctgtaagacaacatgttttgtgtgagcttggtacccaaatttgaaaaatgtgaagctatgatagtttttatctatcctacttagtgtaaagagctgaacgttttaccaaattactactaacgtgtttgattacactgggcttctctggatgctgttggagaagttacatcaggtaggatgtgcacactttattagatcttcaaagcctgaaaacttctgaattcctaaacatacttttccctgacgatgctgcctaaagaactgtggacatggggttgcatgtctctcataggataacaggaaaatccaaggagataatgggagtgatgcactaggtatggtgcccagcagatagaagagcacagtagccagagtaatcattattgttattattaatgtattactatgattatatatattaggatagtgacataagagcacaggctaagagccagatcacctggtttagaattctgcttctgcagagtgattttgagcaatttacttaacccctctgtgacagtttcctcacctgtcaagtagggataaatatagtagctgccccaaaaggttgtagtgaggatccaatgagagaatacatggaaagcccttacaagattatctgacacctaatgatagctgttactatttctctttctccctccctcctgcttttaaaacagtagctgctccacagtgcatcacaccgtctttctgctgagaccagttgttggactgttgaatagatccttgcttttcaaagtgggtccctaaggaaatgtgattttcctgggggttacatgaaaccaccttataaatgaggtgtatcattcttaactgtactccaaacatgggcttaggctccatatagatttaaacctgaattctggcaccaaacttaagcaaaatattcaacctctctggatctcagttttgtcctccttaaaatgggggtatatctactcaccagatgttttcttgagtctgcctacgttccttaaacttttgagctttggattcttcctccaactttgtggatcccagaaatatgaagacttaaatattggtgcatttactggtgtggaaactggaccacactgattatctaaataaagattacatgaacgtttctggcagcctggcctatagcaggggttggggtgaggaacataatatgcttcattatctaccacaacagatgctaaacctcaaagttgccaaagcgttttcaagatgaacacacctgagaggatggaggttgacttaaaaatctctgtgaggtagctggtagaattgccgatgatatctaccagtagagctgtaaaatctgcaagacaaatttaggaggtttaaatttctgcttcagagacaaaaggagaaaagtatactgtgtttggatttttcagagtaaattttacaagtttgatttagtttagtgtattgaggaatatcaacaatgatacagagaaatactactaattctaaaaaatgaaaagtcttgatttcaggccggaaggaaactttggatccactgttaaaatcccctttcttcttctatcatcctctctcccaaccccttctctgctaacatctaagagctatgaagggccacattgttgaataatggtctttctggcggcttttccccattgtttcgtctaattgtttttagaatgccaactccatctgataggaagcagccccacagatatgtaatgtaaatttacagacttgggggttggaaaatgaaaatgcaatgtggaatttagtggtgagttataaactatgaacaatagagacaagacaagacactttctaaaattatcaccaggaacctttccttctgccccctttttaaaggaactgatggtggtgctggtggggagtggtgtctgagataactttttcagcatttcaggttatagaatcattgtgaactttctttctcagctgggtttgaacagggccattgcctgacatggtgggcactattgactgtgaaaattcctaatattcttctagtcaaacagctgtcatctccttctttgttcatttatggctttccacgatccagcaaattcttgacttctaaacaaggcgaatgtgtttgaggagccccagtcattttctaaagaggaagcttcttgggtccagtggatgatttcccatcatgctgtgtaaatgctcctttcactcattaatgggatcaggagtttgtgcaggagcaagctaacttgaaaatacagaaccaagagaggtaggaaaatgttatgtgacaattagtggaatgtgtagccaagaccaacagatgatgggcactactatgcaagaaccaaagccatgaggtggtcttactatatccgcacaggcacattttaacctcctggagggagaacacctatgcagtatgtagtatacctatgcaggtatagacacctgtatatgcagaaggtaggcaaacatgggcaccctctttctctctctttttttttttttttttttttgagatggagtctcgctctgtggcccaggctggcgtgcagtggcgcaatctcggctcactgcaagttccgcctcccaggttcacgccattctcctacctcagcctcccaagtatctgggactacaggcgcccgccaacacgcccagctaatttttttgtatttttagtagagacagggtttcaccgtgttagccaggatggtctcgatctcctgaccttgtgctccacccgcctcggcctccttctctgtctctttagaccagtctgttcttagtcatttgtggaaactgaggaagggtattatctcttagttattccatatattttctttctgct

SEQ ID NO: 351 - DNA, 29035 bp, Homo sapiens
cttgttttgtggcttaacataggctctctccctgaaaacgttccatgtgttcatgaaaggagtgtacattctgtagtgttagatagaatgctctataaatatctgttagctttatttggtgtaaaattctgtttaaatccaatgtttctttcttgattttctatgtagatgatctgtctcatgctgaggttgggatgttgaagtcccctactattattgtattggagtctatctttcttgttagatgtagtaatatttgttttatgagtctaggttctccagtgtttagtgcatatatatttagaattgttctattctcttcttggaaggatctctttatgattacgtgatggccttccttatcttttaaaaaagttgttcttgacttacagtttattttatctgctataagtatagctactcctgctcacttttggtttccatagataacctcttgccattcttttaccttctgtctctatggattgtggtgaggtggtattaccggtgagtttttctgtaagcagaatgtagttagatcatgttttctacccattcagccattctaaatcttataagtggagaatttaatctgtttacattccagatttttattaatatgtgaggctttgtgccgagactagctcagttgggaagaccctaacccagtggcactagaggaatcaaagacacacacacagaaatatagaggtgtgaagtgggaaatcagggatctcacagccttcagagctgacagccttgaacagagatttacccccatatttattaactcaagccagtgataagcattgtttctatagattatagattaactaaaagtattccttatgggaaacaaacggatgggccaaaataaagggatgggtttggctagttatctgcagcaggagcatgtccttaaggcacagatcactcatgctattgtttgtggtttaagaacgactttaagcagttttccgccctgggtgggccaggtgttccttgccctcattccggtaaacccacaaccttccagcgtgggcatcatggccatcatgagcatgtcacagtgctgcagagattttgtttatggccagttttggggccagtttacggccagatttttggaggcctgttcccaacagctttgttcctatcacattgttgttttcgggttgttttatatgtcctttattactgtctttttctcttattgcttgtcattatggtttggtggatttctgtagtaggaccatttgagacctttctcttcctcttttgtgtgattgctttaccagtgagttttatacttgtgtatgttttcatggtgataatgtggaaatgttgaaaatgtcgtttcaattccaggtttaggactttcttgagcatttcctgtaggccctgtctagtggtaatgaagcctttcagcatttgcttgtcttggaaagataatttcttttttcaattatgaagaatacttatgttttgtttattactcttggcttggcagttcttttccttcaggactttgattatactatcctattctcttctggcctgtaagatttctgctaagaaatctgctgttagagctgggcacagtggctcacacctgtaatcccagcactttgggaggctgaggtgggtggatcatgatgtcaagagattgagaccatcctggccaacttggtgaaatcccgtctctactaaaaatacaaaaaaaaaaaaaaaaattagctgtgtgtggtggcgtgtgcctgtcatcccagctacttggcaggctgggggaggagaatcacctgaacccaggaggcagaggttgcagtgaaccgagatcatgccactgcaccccagcctggcagcacagcgagactccatctcaaaaaaaaaagaaagaaaaaagaaaaagaaatctgctgttagtctgatggggtttcctttataggtgactaaacactttcctcttgctatttttaggatttgcgttttaccttatactatagaaagtctgattatatgccatggtgaggaactttttgcattgtatttttctcagaattattgaacattttgtatctgaatgtctaaatcacttgctagagttgggaattattcatctattctttcattaaataggttttctaatctgttctttgtctctttgctcttgagaataccaataatttgaatatttggttgtttatattgtaccaaatgtcacaaaggctttgctcattctttttttgtgtgtgtttttgtcttattgaattatttcactatgtatatcttcaagttttggaattcttccttctgcctgacctagtatgttgttgaagctttcaaatgtatttggaatttcatgtcatgaattctttaattccagaatttctgtttttttttttaaatctatatcttttgtaaacttcttatttgtatcctgaattatttttatgttttctttgtatttttttcagaattcttttgtatctcactgaacttctgtaaaatgaatgttttgagtcctttatctagaatcttgaaaatttctttttgattaagatctattgtcttcctttgcggctttttttttcttttttgctttttcatgtttctgtgtcctaacgttaatatttttgcatctgatataacagtcagttcttcctatttttgaattttgtttcatagtggagagcattttcctgaagatgagtctatggtgttggttgcgtggggtactttggatttgattctgggtgtagtacatagtagagtactatggcctctgtataatttctttggctgtagacagtgttaatggtatctgtgatttcttctgtgcattagggtgtggttattagtgaggctgtggtgaaaatgtgctggggactgagatgccacatgagacagtcttcaggctccagtggtggcagtggtgtgctgagtgttcctatctttgtgccccaaggtggtatatactggcatttgtgttggtggttactggtgggctgattcctgggcttccaggtggcttgcttggatggcagtagtggcagtggttgactgggtaggtgctggggacttcggctcctgggcagccagcttggcagtggcagtggtgggctgcttctctgggtcccaagcagtgtgcactgttagcggcagatgcgataggctgggtgggatgcccataggtggtgtttgcaggtaggtgacagctaaggtgattgcatccaacctcaggtacccaggaggagtgcacaggtgcccaaggtggtggattgggttgaggaattcccaggccctggggctgtgttctctgtctcagtgggagggggcgatgaagttgtctcttcatcattaaatgctgtgccaactagtcccttaattttctttttgcctagaggactgaaacatttattatagtttaggtctgctggttattttttcactccctgtatgtctaaaatccatttgtttgtttgtttgtttgtttgtttatttttgagacagagtctcactctattgcccaggctggagtgcaatggtgtgatattggcctactgcaacctccgcctcccattttcaagtgattctcctgcctcagcctcctgagtagctgggaattacaggagcatgccaccatgcctagctaatgtttgcatttttagtagagacgaggtttcaccatgttggtcaggctggtcttgactcctgacttcgtgatctacctacctcggcctcccaaagtgttgggatgacaggcatgagccaccatgcctggcctaaaatccctttattttttgatagatatattcaaggtgtgttagcttaatttaatcattacatagggtacacatatatcaatacattaaacaatatctcacgaatgtattatactttgtcaattaaaactatacatatatatttgaaaaaggcattattttctgggaatagaatctagtttcacagcattttccttttaggactctaaagatgttgctcatctgtctcctcatttgcattgtttccaatgaaataactgctgtcatctttattattattcttattttttcactttcgctttttcaattttctcttcttctgtggttttcaacaaatacgtgctttttttttaacccagaattatagagtgaacgtgagaaacaatctctagggagggctttttgactattgcttgtaaatttttagaaacagttgtttgctccttgttttattagatcacaggctaatttcctcagagtattcttatattgaagaatgtcataattaattttactgatcatccctaaaaccataaaaaccctagaagaaaacctaggcaatacctttcaggccataggcatgggcaaggacttcgtgactaaaacaccaaaagcaatggcatcaaaaaccaaaattgacaaatgggatctaattaaactaaagagcttctgcactgcaaaagaaactaccatcagagtgaacaggcaacctacaaaatgggagaaaatatttacaatctacccatctaacaaagggctaatatccagaatctacaaggaactcaaacaaatttacaagaaaaaatcaaacaaccccatcaaaaagtgggcaaaagatatgaacagacacttctccaaagaagacatttatgcagccaacagacacatgaaaaaatgctcatcatcactggccatcagagaaatgcaaatcaaaaccacagtgagatcccatctcacaccagtaagaatggcgatcattaaaaagtcaggaaacaacaagtgctggagaggatgtggagaaataggaacacttttacactgttggtgggactgtaaactagttcaaccattgtggaagacagtgtggcaattcctcaaggacctagaactagaaataccatttgacccagtggtcccattacttggtatatacccaaaggattataaatcgtgctgctataaagacacatgcacatgtatgtttattgtggcagtattcacaatagcaaagacttggaaccaacccaaatgtccatcaatgatagataggattgagaaaatgtggcacatatacatcatggaatactatgcagccataaagaaggatgagttcatgtcctttgtagggacatggatgaagctggaaaccatcattctgagcaaactatcacaaggacagaaaaccaaacaccgcatgttctcactcataggtgggaattgaacaatgagaacacctggacacaggggggaacatcacacactggggcctgtcgtggggtgggggcagtggggagggatagcactaggagatatacctaatgtaaataatgagttaacaggtgcagcataccaacatggcacatgtatacatatgtaacaaacctgcacgttgtacacatgtaccctagaacttaaagtataataataaaaaaaaatttattggtcatcttggctaaagcgtcgtgcctggataagtggtcaagcattattctggatgatttgtgaggatgtttgttggatgagattaacacataaatagccagactttgaataaagtagattaatgtctataatgtgggtgggcttcattcaattcactgaaggtgtaaattaaacaaaacactgacctcccttgagcaagatggaactctatagcagacagccctgggatttgaactgcagtatcagtcaactgacccactaacagctggttggtttgtgtacagcatttgcaagatgaatggacaacataatgtttggaaatccacctctttgatcaaagaaggtaaaaacagaaaagctgttgtggacttaattgcatggtgttttcttagcagtggtggaagaattgaacaataataaagctcctacgttttagtttttactgacttacagggagtgactaatgtcctggccgtatgattaatcaggagagcaatgaaaaacttgcctatgaaaagaatgcccatgtgagccaagtcccaaggaaatcactatggtaatttgaggggttcattaatgtaagatctgttgatacctgatatagattggatgttgttcttgtgcagatctcatgtcgagatgtgatccccagcattataggtgggcctggagggagggaggtggttggatcacgaggtcggtttctcatgaatcgtttagcaccgtcccctcagtgctgttcagtgtccctcagaataactcccttccaggtttggaaggtgattgaaatcaacaagaatttatctccaagtgtttgccaggtgcacttgtaattccagctatgagagcggctgaggcagaaggatatcttgagtccaggagttagagtttagcctgagcaacatttgaggccagccagggaaacatatcaagaccacatctcaaaaataacaacaaaaaaaaatccaggtttgcttgtggtgatcacctgagtccatgaaataagtagacattggggctgtagcaatgcagagataggtggaatcaagacatagtcctcttgcattccacacatcacaggcacaaaatacatataagaagtcctttctttaacaaaaaaaagagagatagcatatggctatgtggcagattcttttatgggagggccttgaaaatacatagctggcgagttagactgataccagtagccccaggaagcagcaaatgggtcttggcaggaatagatcctcaccctggagtgggctttgttcagctggtggtaggtgtgttaccaaactgaactggggtccactcacctggggcagtaaaagcaaacatccacactgagattgtagtgggacaaaggagggcatttacatgtagggcgccaaacaaggagaatcaggcagctcacgcttaagacccaacctttttgatggctcacaagcaagaatttttaaaggcaggggcaaatttcgggaaagcagagttacaggcaacatcataaatcaatgcatagcagttacactgctttggccttaaaaggtagaatatcctgatgagggagcttacaggtcttaggtagatttaaagattctctgatttgtgatagataaggaagcaaagcttctttacacagcttccttacacagttgggggcagtagagaggaatgttcaggcctggcctgtgggcttgactctctccaggtccctcaggaagaaatttagaacaaagaacggcggtcagagttcagttctcagtttcccctttataaggtctccctgtcagtggatctattaggagggaatccatgtttctgaaaaacaactcagggacatatgttaagatgttatttttagtttctatagagaatgaaacatcttgtgactctaacttccttggctattgtttcaagctatcattccttcttgcttataaggtcactcacttactttttagggctggctaggtgcctggaatttctcttgaagggactgaaggtttttctttatttctagattgggaggccccagcaggcttctaaaagaggtccctgctttatctcagatgcaaatgctcgagtgttacaaaagaacttgaatgggaggtactgcaaccatgtggaccaccgagtcatatttctttacaccagaaaatgcacctgctcaaaatgtccaacaatggtcacagagagatatcctcctcagaggaagagttccatagagaattaaaatagtcagttggatgtgtaaaggaaagagtggggaaacaagcacaaagggtgggcttatacaccttcatgagtgtgctcacacttgacatgagagtatcctctcttttcctggtggatcaggggaaggtgctggtgtgatctacacatattccttcccaaggtgggaggacactggaatgatgactgtaattcacctcaacttgcttttctcatacctgatgcagtggtcccaggactagggatgcaaatagagttcagaaacaggaattattcctgagcaagaaactgtaaatatattttatgtccattatgtaataattcctaagagcctgtagaagtaggttgtgccttcactgcatctggcaaagttggggctaacactgaatgcagctgtattgcctggggtcagatagccaaccagttctctacctgcataaccctaccctctatgaactggaatggatgacgggagacacttgctagaacagtattggtccctgcagtctcagccagcacagcagcagaacctagtgttccttccaaaattataaatgtttagtataaatgaagggaaggagaaatagtagctgagggtaaatgaatgaataaatgggttatgtaatgaggaaaatccaatgttacatgaactacttgaaaaaggtagaagcaagagatgatattgtctcttagctcaattttaccagatgcctgaaagcgttcagtcatatgttgccgaaactattcctgtttatggattgcactgggataattgttaatgaccaaagaggattctggtaatgtgccaggatcttttcactgttatgattcttctggtgtaggagatctgtgattggccaggcacagtggctcacacttataattccatcagtttgggaggcaatggtaggaacattgtttaagtccaggagtttgagaccagactgggcagaatagtgagacccattcctacaaaatatttaaaaattagttgggcatgttggtgtgcacttgtaatgctatctactcaggaggctgaggcagaaggatcacttgagtccaggaattcaaggttagagtgagctatgattgtgccactgcattctaccctgggcaacagagcaagagattatctctaaaataaaataataaatattataaaaagagataatgtggtcaaaaccagggtgtgatctgtggtccaataaaaatatttggtcttttccctgtttcctgacaaccaggttctaaaacatttgcaatctcctcagtgataaacatgacttcaacatggcaatgagatgactatggggtgaggggctcctagatagcttcaggatggggactggttgccagaaacacgaagctgtgattagaggattggaactgttagccccatccctaaagtctgggaaggaaagagaggctcgaggttgagttcagtcacacaatggccggtgatttaattaatcatgcttacacaatgaaatttccatagaaacctctggagattgggtttcggagagcacatctgtgtgtccacatgctgggaggatggtgagccccatctccgtggggacagaggctcttgtgctcagagcccttccaggcctcaccctgtgcacctcttcatctggctgctcatttgtatcctttataactgctatggtttgaatgtttcccccaaaaagcacctgttggatatttcatcccgaatgcaacatttttaagaaataggacttttgagaggtgattggaccatcagagctctgccttcattaatggattaaggctcatcataaaaggacctgaggctgtgagtttgacttcctttccccccacctctcatcctctcttgtccttttgttttctaccagatagagtcccttgatctgggaattctcatcgtcgacaccatgaacgaaacaaatttctgtttgttaaaagttatccagtctcaggaattctgctctagtggcataatttaaaccaggggtccttaacccccgggctgcggactggtacaggttcctggcctggtaggaaccagactgcacagcaggaggtgatcagtgggtgagagagcatgagcatgacaccagagttccgcctcctgtcagatcagtggcggaattagattctcatagaagcatgaaccctattgtgaactctgcatgcaagagatctaggttgcatgctccttatgaagcgctaatgcctgatcatctgaggtacaacagtttcatccgaaaccatttccctctgccctccaccacctccactagtccatggaaaaactgtcttccatgaaaccagtcccaggtgccaaaaaggtggggatttaagctataacaataaaaaactgcaatactgagtgtgaaaagaaaataaaatttcaggactccaaattcactataccaaaaggaaaaattaagtttggagactgatggaaaaactgcctttctttcgttcctaaacaaataactgcaaagatagaagaccacatatctccccaggtggcctccctcacaaactgctcacaagataattccttgtgggccccaacgtgtttaccctaaaacagttttgttgaattttcccctgacaatgtaaattaacagcttatcttcacaggtacaggacaaagacaagactagaaatcatccctccacccacccagagtcaaacgcatatttgacttttccacccaatgtttactttatcttatttaaaatgcagatttactgagcatgagatgaatgcatagttgactatttttttcctctcctggctgctctttcccctgtacacattgaagtcctcaaaagcctgttaggaaaaagcatgggccacagatgctacaatgatttgtgtctctgtttccaaggtgcatcttcagcttggtgaaataaacttctaaactgactgagacctgtctcagacgttttttggtttacatggctatagcaacttcctgagttctttgtgttagtttaagaattctcaatccttgggaggtgagaaacccctgactttgcagccatgttagacagaagtgcaggtaacctgggacgtgatacttgtgacttgcttctgaagtgaggacagacttgtaggactgagctggtaaacctgtggagtctgaggcgaactccaggtagttagtgtcagaattgagtcaagctctaggactcccagctgctgttggagaatcagaaagttatttgggtggaagaaaaccccatcaccatcccacagagagaaacttatagtaagagtaagcaagtaaacctctaccttcttcggtcccagaggaaaagataaacaaatgtaagcatttgtttcatgtccctaaacacaggttgctaccagctgttcattgtctagacgtggagtggtcctacctttaatctagaagttaggattttttaggcctttgagggtgtcacataaaaactaataaatgttagagattctctccccagaaatatttccacacacaagaaaatataaatattaatagaaaacatcgtgtggacccagaacctctgagatcttacaaacctgggagttttaatcctagtaagagtcatgctgagggaagatgtttgaataatcatttcatcattacagaatgccactccaataatctagagtataaactgggatagacaaaaacttgatgtaaacctatcctcaagggaatgggtggaaatatgttatttattagtcactggttcattcagccactcttcgtgcctactgggtaccagataaagttctcgtcctggatcactgctccaagaattaaaatttgtcacttttccccacccctcacactccagcacttgaacccgcttactacatcagaattccacactgtcaatgaaaagagtcaaactcagtaacatatttaaagagatttattctgagccaacaatgagtgaccacagcccatgacacagccctcaggagaccctgagaacatgtgctcaaggtggttgaggcacaggttggttttacacatttaaggaatatatgaaacatcaatcaaatacatttaagctatacattggttcggtccagaaagttggaacaatttgaagcaagcaagggttgcggggtagtgcttctgggttataagtagatttttaatttttctgattggcaattggttgagttattgtcaatagaaaggaatgtctgggttatgataaaaggttgtggagtccaaaattctcatgcagatgatgcctccaggtgccaggcttcagagagtatagattgtaaatgtttctgatcagactgaaggtctgtgttgatggtaaatgctggtcaacttttcctgaattccaagagggaagagggcataataagacatgttcaatacctgcttcccttggtggcctgagccagtctttcaggttaacttttgagcaccctggctgagggtgtccattaaaatgattgggaaggggtggctttgatgtttatttttggtttacaacatgtaaaatgttgagaggagacagacaccacctccctccctggaagaggacaacaacactccagtcacccctgcagttgctcatggacatgagttttaagctccaccagtctgatgaccacctgctgaagaggtgtcattgtctcaggtaaatactaagtgttcgtcatctcacgccaagaagattaaggacactgacacacgaggagtgagttaggaccaaagggtttaataggcaaaagaaagacaaagggaaacagctccttcttgtgagagagaggggcacccaaaagggaattccggcctggaatgggagtgcatcggattttacaggcaggcttgaggagatggtgtctgatttatgtagggcccacaggttggttgtaccaggtgtgatatttacatagtgcgtgtggaaggctgttcaccccaccctcatcctattatgcaaatgggctttccacttggctggtgacatgttgtctgctccttactgtaaacgtgcctggcaaagagaagggaagatggagccgccattgtgaacatacccagtcccaggcgtcctattcctattggacagctgctggcattcacccgtgcaaacttccagcttacttgtctatgtctgaagcttgatattacaggctgctccttgttagaaaagaaaataatttggagcctgctttccattaaaagccttgcgtaccctcactacctgtctaaataatttcttcttaactcctatatcactgccagactcagccagaatgaggtgacagagaggctaggactgtgcagaaagcattttagtaaagatggctgagtgacagtagtgatgtccaatttccatgtgcagcagtgacatctgtcctagcctcagggtccagtgtccaggaccagggtgtcagaggtgtgagcagtggcgtctgtgctcagcagcaggggcagttgttcctaggagggacctgatccagggtgggctgtgaattctgttcccggatgtgtagtttccagcctgcttctgtagccttccccacaataaaactagcccccaataccagatatacgactttctgtgtacattacagaaatgtggtttccatagttttctccaagaagtgagtgagaaatgagtctgcgggcgagtgtcagagagcggcattcagaggtgttctttgtgcgagagccacatcctgaattgtctacctggcctctaccccatggtggagagaacaacagagaatatcacctctcataactgatgatatacagcctcccttttctttctgtgagaaaaatcctcttttaaacagggtttgaaaacccaccccacccacccaccctgggcactctctgatcactgatctcagtggctcccaatctgtctgagcaataggattgctggcggggacttagaaaatacacaggccactccccagaacccttgtctcagagtattatgcacaagaccaaggaatcatttatatgacaagccctagaggcgaggctgatgctcagacatgtgggatcctggtgctcttgctactccaagtgtgatctggagaccagcaacatgagctccagccttgtcataaatccagaatctcttgctcaactccagacttcctggatctcagcaccacatccaggtgatcctggtgcacatgggggttccttgtctgagtgtcctctagacgtgggaccagaactgtgcagtctgctctgggtgtggtctgatcacaccccttagaactggtccagggttcagtccttgtgctcattcttttccatagtcagtcactcccttggtgcttcatccatgcctgaggttttaagtctcatatatatggtgtgacctcctaaatctatttctccagcccagtcctttcccctaaactctggagttgtctgtccaaattccaccccagctcccccacctgccttcctagtagacatctcctccactgagtgcctgtgatgccccctcctcaggacgctcctgccagagtctccccatctccactgacagcagctccatccttctactcactcattttacaactatgggtgtccttgattcgtctttctcacaccacagatacaatccattggcaaatgctgtgagtccatcttcaaatgcatccagaatcccctcacgccccactatttcccctgctcacgccccagtcaaggaaaccgacatctccagcctggaatactgcactcgattcctactgttttcccttctgcctccctcgtccctcgcctctcaattctgttctcagcacagccgtcagagagatccttttaaaacagaagtcatatcatggctctcttctgctcaaaactgtcctctaactccccatcccactcagagcaaaggccagatccaaccccactcccctcaagcccacctgttctggccgcacctctgacctcacctcagtttctctccgtccagccctcctggcctccttgttcttctgggaacacaaacaccttcctgccatagtgcatttggactggagcttcctctgcctggaaagaacttccccagacatcctcatgtctctcaaatctttcctcaaaagtcacctttgcaacaaggcacacactgactacccagcacaacagccaccttccctgtccccactgcccacatcctggatcacctgcctcacagcacttaccaccttctagcactttccttccttactctggttataatgtatctatcgtctgcctcttcccactggaacatatgctacaaaaggccagagatttttcttttacttcagtggtgttccccagatgcagaaccattctgtcctatgtctggccaatgacaaaggtcagttgaatgaatgatcactgtagagcacctccctattttgaaggcagtatctttattaacatagcctcaggccaagtgctgttttgtggcagctacagcacaaggacccctcacactgagatagaggccgcctatgtttttctcagcagtgctgcttgtgtgccctccctccccatccctctttcgacagcaaccccctccccgcaccccctgccccagcacactgcagcacacaatcaggttctctcttcaggaaagaacagtccttgatgacgggtccaatttcacagacaaatgtaagtctaaattagactctgctttacagattcatgagttgggattggattcagcaccaagatcactagaaccagggcagggagagagggcagaagagcagagcagaaaaggagctctagaagcagagcaggaggtgaatggctctgaaaatttgtctcagaatgcacagagacccccgtgtgcaggggccgccctgggcgatgtgtgagcctctgtggtcacagctcccactggacaagtttccactgaagggacaaggacaatggagcagtgaaggtgacccagctgaggactaaccacataaagcccatgatggactcaacaccaaatgggcacaggccccatccacactcggccccccacagccttctccacaccccacctgcaacagactcagcacagcgaacatgcagattctggaaggttctcaggtctttatttgctctctcaaattccaggaattgacttatttaattaatccatcaacctctcatagcaaatatttgagaaaacaaatttatattcagattcttattttcagtagggaagtaagaagttgcagctcagtgcacgtaaagttgagacagagatggagacatccagccccacctctctggaacaagaaagatgactggggaggaaacacaggtcagcatgggaacaggggtcacagtggacacaagggtgggctgtctctccacctcctcacattatgctaacagggacgcagacacattcaggtgcctttgcagaaagagatgccagaggctcttgaagtcacaaaggggaggcgtgaagaaatcctgcatctcagtccctcacaagacagctgtctcaggctacagaaaacaacagtcatgaacaaattctggttagtcatggtaagcgatgacactctaaacagcccaccacacacgcgaaacatcccaatcaaagaatccccattacccaggcctttcccctctgccccacccacccccagacccgccaccccacccactctagaccccaagaatctcaccttttcaagctgtgagagacacatcagagccctgggcactgtcgctgcctggagtagaacaaaaacaggacctggtcagagcccgcaggagacgtgggacaggaggaattatggggtgggtgagctcctccacactcccacccccaccacttacacgcagcctgagagtagctccctccttttccacctgtgggaagaaaatgtcctgtgagggcactgggaggaagcagggccatgagatcttagaggaacctcctagtcttggacccaaaaggaatttccagaagtatgactacagacccagggcaggatcaggaaacacgaggaaagcaagtgtgggtcctggaccaactgccctcctaaggtctgtccttagcagggaccttcccctgactcatgaatgctggaatcaggaccccaacaccacaaccatcaaggtgatacatccatccttcattgtcacatgtgctgcacaaaagagtaagtgctggcacacagggtcccaggctgcgttagcccctgtgtgcatgctgcttcccagtaatgaggcagggaacacttctacctggggcttgaaacccccagtgggacaagaaaacccagaccccacccctcaccccttccctacctgaactcttcctcctacacatcacagcagcgaccacagctccgatgaccacaactgctaggacagccaggccagcaacaatgcccacgatggggacggtggactgggaagacggctctgggaaaggaggggaagatgaggggccctgaccctgctgaagggctcctgctttccctgagaagagatatgacccctcatccccctccttaccccatctcagggtgaggggcttcggcagcccctcatgctgtacatggcatgtgtatctctgctcttctccagaaggcaccaccacagctgcccacttctggaaggttctatctcctgctggtctggtctccacaagctcagtgtcctgagtttggtcctcgccatcccgctgccaggtcagtgtgatctccgcagggtagaaacccagggcccagcacctcagggtggcctcatggtcagagatggggtggtgggtcacgtgtgtctttggggggtctgatgggaagagtcagaaaattcaggcgctttgcatctttcatgggacaccctaggaccacccatgtgaccagcctgagaatggacaggacacctggggtggggaaggggcacagaacccagacaccagcctggacgcaggcacctgggataatctcctattcattggaaagttcgagtctctgagcggggaacagggacttctgctcctgatctgagtggaggtaaagtgactcagaagtgctggaatcagagccccaaacacactgagtgtgaggcagagaacaaggcctgagaggaaaagtcacggttcccaaggctgctgcaggggtcaaaggggacccctgatcagtattctagggactgtcttcccctccatttcctcagagacgtcattccttaattgtctagagagaagagggggccctcagaggaaactcaggaaaactcatgccattctccattcaacggagggcgacattctagcgctgatcccattttcctcctcttctcgtgggaggccatccccggcgacctataggagatggggaaggctccccactgcccctggtaccagcgcgctccagcttgtccttcccgttctccaggtatctgcggagccactccacgcactcgccctccaggtaggctctccgctgctccgcctcacgggccgcctcccacttgcgctgggtgatctgagccgccgtgtccgcggcggtccaggagcgcaggtcctcgttcagggcgatgtaatccttgccgtcgtaggcgtactggtcatgcccgcggaggaggcgcccgtccggccccacgtcgcagccgtacatgctctggagggtgtgagaccctggccccggccccgcggtcagcccagtcccccgagccccgccccgccccgaccaacccgcggggattttggcctcaactgaaaatgaaaccgggtaaacgcgcctggggctctcgccggtcgagggtctgggcgggtcccgcggcctcagggaggcggatctcggacccggagactcggggcgacccgggccgtacgtgggggatggggagtcgtgacctgcgccccgggccggggtcactcaccggcctcgctctggttgtagtagccgcgcaggttccgcaggctctctcggtcagtctgtgcctgggccttgtagatctgtgtgttccggtcccaatactccggcccctcctgctctatccacggcgcccgcggctcctctctcggactcgcggcgtcgctgtcgaacctcacgaactgggtgtcgtccacgtagcccactgagatgaagcggggctccccgcggccgggccgggacacggaggtgtagaaatacctcatggagtgggagcctgggggtgaggaggggctgagacccgcccgaccctcctcccggcgcggctcctcaggtcctgcgcccccgcctgcggtcccctcgctcctcccggcagaggccatttccctcccgacccgcactcaccggcccaggtctcggtcagggccagggccgccgagagcagcaggaggacggttcggggcgccatgaccagcatctcggcgtctgaggagactctgagtccgggtgggtgcgtggggactttagaactgggaccgcggcgacgctgattggcttctctagatatccaatacccaatgggagtgggaagtggggacgcgtcacgagtatcctggaagaaggacccgacacaagttgggagaagaagtgaaactcaggggagtggggaatccccaacgctgcgcctccccattgcagacgcggccctcggagcctgagaccctgagagccccgtccgggacctgggacttcgtcctgatccctcttctcctacaccaagcctctttgtcacactgtctgcctgagtcctggacaaggatctgtctgtggaaaccagggagagacccccaggctgcgcccagccccttccccttcacttctcgtcctggaatccctgtccctgaactggactccctgcctcccactccttacctctcctcttggactcttgtgtagggaaactgagcacggggaacttgatgccagagagtgagctcgccctgggaatggaggtgtagagacaggggttttctctttaaacctggtgaagttttctctgaaggcaccgcatagggattctcatagagaccagtttcctttttgtttgttaatacagtaggtagcacaatattggtaatccctgaatgattagaattccaatttgtaaaagacctgtgtcaaaacagcattacaattaaactctcaaagctcctaagttttactttcccagactgtggatctgtaactctgggttgttgcatttaaaattatcttcattccccaccctgagtttccctgtgtgagtccagaacatctcctgaatataaagaagcagggtttgttactgtctattgcaaccgggagcctgtagtcatcacctcaaagttgcgagtgctccatgcagtcccaatgctcttcaccgacgctgaagcactgcctgttttcctgaactctgcacatccaagcagtgtgcgtattttatctgaacacttggtatttttgtaactctttttttttttaatcataaggagccaattagtttttaggaagtccaacaaaatgtattaaataccgaatgcaaagaaccctctgccaggctcttccactgctttagaattctttctcctgctccttttcctcacctcctgcctctccagcccttctgtctgcccctctcatccctcacacccccgctccccttagtccccgccaccctgtcactcctgaattgtggcactaacactgtccctcacctcctgcccatatctgttctccccacagtgctcagcagtcctgctaatgtgactcaggtcatgtcatttcttcacttgcaatggttgggttttggtctaccattttgctatacgttttcaatttgtctcatatctttttgtttctgttcctcctttactactttcttatgtgtcaaataaacattttttagtttatggttttaattctcctagtggcttttggctatatttctttacacaatagcaaagaatggaaacccgattccttgacttttcacagtgaagttcaggttatattaagctgcatccagcaaaataaaggacacttctaacagtgtagtttcttgtaacctaccattgtgctattattgttgtatatattacatcaacctatattatagactcagtgatacagtgcaatactttttgttttaaacaagtagccatatgtcttcaggaaattaagaaaatgagtgtgaatgtgacatgtgtatgtgcatcatttctgttgttaattgttcctttctgtatatctgggtcaccatctagtatcattttccttcaccctgaagcacttcctttaaaattaaatgtagtacaggacccctaggaaattaattttatggctttgattatctaaaaatgtctttatttttgcctcccctcccccccccctttttttttttttttgcttattagggcatttatgtgtaataaaattcaccagttttagctgcgcttttttggcgaatattggtaattatttatagtcatgtaactaccacactgcccagtagagaaacccagaatgcaaagaatcccctgctaggctcctccactgctttagagtcctttctcctgctccttgtcctcacctcctgcttccccagcccttctctctgtcctcttccctcacaccctcctctccccttagttcccaccacccagttacctctgagttgtggcgctgtagagaaccgtttcttttccctaaaaactttctttctgcccctttctatttaatccttgcctcccaccctcaccccttcccttcactcaaccaccactctgttttctgtcactgcaatactgaaatttctagaatgtaatggacgtgcagtcgtatgttatgtagtccttcgtttggtctctcctttagcataacgatgtgtgagatgatgccattcattcatttttgttgctgagcagctgctgagtattgctggaatcccagcttattcattggtttctctgcctccagttgatagacatgtggattcctccagttagggtttgttattaatgaagccactataaataactgcttacaagtgtggccttacatttttatttcttttggataaatacatatttgtggaattgctgggccatgtggtaatagatgggtaactgtataagaaactgccataccactttacaaattggctgccacattttttgcattcctaccagcaatatcagacattcctattttttccatattcttgacagtatttagacttatccaatgtctttttaactttatctattctaggtgatgtgtgatggtttctcattgtggttttaacttgcacttctttgatgactagtattgtttgctgtcttttcatgttcatctaagtgacttactacatatattttatgaactattttgcaaattcagtgattaattccagagactttttcagaattccctagtgttttctacatatgcaatgaagttggtgacaaagacttttgtttcttcctttcctatctattgatcttttttcttttaaaattatttttatttggtagagatgaggtctcactatcaggctggtctcaaactcctgaactcaagtgatccttccacctcaacctcccaaaatgcagggattacaggcatgagccaccatgcctggtccttctattggtttcttatttcattttcttgccatgttgcactgatttggatgcctcttaggtgtttaaacaagaatgatgagagctcacatgtatgtttacaaggaacttaaacaaatttacaagaaaaaaaacagccctatcaaaaattggcaaagggtatgaacagacacttctcagaagaaaaaacatatgaaaaaaaagctcaatatcaatgatcattagagaaaagcaaatcaaaaccacaatgatgtactatctcctgcgagccagaatggcgattattaaaaagtgaggaaacaatagatgctggtgaggctgtggagaaataggaatgctttttcactgttggtgggaatgtaaaatagttcaaccattatggaggatggtgtgaccattcctcagagatgtagaaccagaaatactatttgacccagcaatccctttactgggtatatacccaaaggaatatcaatcattctactataaagacacatgcacaggtatgtttattgcagcactattttcaatagcaaagacatggaaccaacccacatgcccatcaatgatagtctgggtaaagaaaatgtggtagatatacaccatggaatactacacggccataaaaaggaatgagttcatgtcctttgcagggacatggatgaagctggaagtcatcgtcagcaaactaacatgggaacagaaaacctaacaccacgtgtcctcactcttaagtgggaggtgaacaatgagaacacatggacacagggaggggaacaacacacaccagggccttttggggagtcgggggtaagaggagggaacttagaggatgggtgaataggtgcagcaaaccactatggcagactatacgtatgtaacaaacctgcacgttctgcacatgtatctggaacttaaagcaaaataaaataaattaaataaaaagagaaagtgagtgacttacatgtacacatatgttcattgaagcactattcaccatagcaaagacttggaatcaacctaaatgcccatcaatggtagactggataaagaaaatgtggcacatatacaccatagaatactatacagccataaaaaagaatgagattacgtcctttgcaggaacatggatggagctggaggccattattcttagcaaactaatgcaggaacagaaaactatataccacatgttctcacttataagtgggagctaaatgatgagaacacatggacatgcagaggggaacaacacacactggggtccacttgagggtggagggtgggaggagggagaggatcaggaaaaatagctaatgggaactaagacttaatacttgggtgggtactaatgggcatagaaataatttgtgaaacaaaaccccatgacacaagtttacctatataacaaacctgcacatgtaccccttaactaaaaataaaagttaaattaaaaaaaaaaacaaagaaagtgcatgtctggaaagagcgtatggttgggttccgtgtttttttaaaccaagtcacacaatctctgcccttcattggagtgttgattcatataggtttttgtcattattgatatgataagtttcacgtctaccatgttattttcccggtttttgtttctctgttcctcttgtcctgatcaatgactttttattagaaaccatagaaacaaaagaaagtagaataacatctttaaagtgctggaagacaaaaagatcaactaagaattctatatccagcatagatgtccttcaaggataggcaaatgagatatttcaggtaaaagaaaattaaaagaatttgtcaccagcagatctgtacaattacaattggtaaagaaaattcttcagactagaggcaaatgataccaggtggaaaatgagattatcaaaaaagatgaagatgatcaaaaatggtaaatattgagctaagtgcaaaaggctatcttgctctcctcatttattcttactttatatacatagaactgtttaaagataagaaaaagttttttatcgtgggacttacaacctatatagatatattacatataatatctataccataaaagatggacattttatagaggataaatggttgcaatatttctatatttatgggcactagtacattattaactgaaagtagtctgtgaaatgttaagaatgagttaagttctgaaggaaattgtgacactaaaaaccattcaaaagatcgacaagtctcggagatggttttttgaaaacaaatcctagccagtcttgagtatcatcatcctacgatttcagaactatcgtgaatataaaagtaatcaaagaacagtcctgcccagaaagaggagttatccctaaatatggtgtccctgggacagctggccctccctgctggacctcttccacatgtatgctttctgcagtgactttgttgtcttgctcttccactctacccagtgtcctgacccaagagacaaggggcgtctgctgctgtgtccacacttggagaaggaaatcttgaaggtgtcagtacattacaagctgggcatgacagctcacccctgtaatcccagcaattcaggacgctaaggcaagaggattgcttgagatcaggagttggagaccagcttgaacaacattgtgagaacctcgtctctaaaagatataaaaataagtaaacttagctgggcacggtggtgggcacttgcattcccaggtattggggaggctgagatgggaagatcccttgggcttatggattcaagtctgtagtgagctgtgatcgcatcactggactccagcccagaccacagagtgggatcttgactcaaacaacaacaacaacaacaaacattgtaaacctttgctcaccatgggttattttatttattatttattcagtgtgtattttgattttattttactggcagcacaataaaccaggacctgctgaaactagaaatcacatccactttccagtgttaaaaagcccagtccaggcaggtgagaaggagacagtcctcattagcactgaggattcagggagaatgagatgggctgggcaggaaggtttttttgtttgtttgtttgtttgtttgtttgttttctatgaacaagtgtgactttttattatgatagagttgtttttattaaaggaatacatgaaaatggttaagtaaaatcaaatggctccaaaagtcttacaatgaaaacaacagtcctgccagttgttctctcgagaggcaaacacttttcattctcttagtttttcctcctggtagttaccttcatgggtttttccaaattattatttttttagtttttcaagtgggtgcatatattaatacatgtaattttaaaaagcctcttcagtttataatgcatcctaacagtcccctgccccatccctcctaattctccagagcaatgacttttaactcttttagcaatgtcttctatttttttctcacataactacttagtcatttcttgattattttatacattctatagtaatttcttgatatgacagatgaggatttagctcttacaccatcactaccttcacttttccccccatattgtcccaaagtagttaccagatttaggggctaagtagtcaccacatcattatgagtatgtacatattgctcattgttgagaaaaacagagtattatgctcttgcttcctgccttgtgcttccttctgccctagaattaatgattgcctaaccacccttcccccttgttttttttttttaacttttgctttatcttcaatgaactactttccaaatgccccaaatctggccataacctattattatttttaagagaagggaatcttactatggtggccaggctggtctggaaatcttgggctcaagccaacctctttgcttagcctcctgagtagctggaactacaggcatgggccattccacccagctaacctattaatatttttactgtttctttttaaagccagctccatagctggaatatttcctgtgttggatcctatttgctggatccatgtcattctctggtttgtctactccttcattttgctggagtattttctccaatagtttcccaacaaaagatacatggaggtaacccctgagtctttgcttgcctaaaaatgtattattttaccttcacccttgattatttggctgaatatagatttattcgttgaaaataactttctttctggaattctgaaggcatggttccattgttttcagcttctttttcgagacaaggtctcttctgtcacccaggctggagtgcagtggcacaatcacaactcactgcagcctcgaactcgcaggctcaattgatccttccatctcagctccctgagtagatgggactacaggtgtgcgccacaatgcccagctaacttttgtattttttgtagagatggggcttcaccatgttgcccaagctgatctcaaggtatctgcctgtctctgcctcccaaaatgctgagccactgtattacaggcatgagccactgtgcctggccagtttttcttttattctctctctactttcttcatttctcaaaggcatctcaaactcagtgggcccaaacccagggcaaactccatcagaatatcctgctacttctgactttaaaatatatcttaaatcacagtttcttactacatgcaaccctttggttcaaactaccatcatccctcacttgaacttagaattggttttcctgcttctgtatttttttaaaacataaaatatttcaaataaaccatgcgtggctttatactttttactacataaaaagaataaagatctggggtggctcaagcctataatcccagcactttgggaggccgaggcaggcggatcactttaggtcaggagtttgagaccagcctgaccaacattgtgaaaccccgtcttcaccaaaaacacaaaattagccaggcgtcgtggcacgtgcctgtagtcccagctacatgggagcctgaggcaggagaatcatttgaacctgggaagtcagaggttgcagtgagctgaagttgtgccattgcactccgtcagggtaacaagagcgaaactctgtcaaaaaaaaaaaaaagatatgaagagcttatatacttaaacatgaaattgctttaagtgtttgccattcactgttcacatgcatgccagcagcttcttactgcaaacacctgggacttgctatagagcagctggagtacattctgcccacacacaggacagggagctgacaaccaaggagtgggggatcaatatgccagctttctcccctccgtttccctgtatctcagcagtatggagtttgttaccagtgagaacctgctcactggctttaaactggttttcttaccttctcagttccatttctccgtacctcaattgatgatttctggtaagacctagaaaataaactgctttcactgaaattgcagtcttggaacctgctttgggttccccaaaagacagaaatatattcattttcccatcactggacttccaggttgttttcaatttttcactgttacaaacaaggctgcaacatttgcgtgcaaacctctgggtatacacgtaaggagctttcggtatttcccactagtgaaacttctcagttggagggtatgtgcatcttcatctttaagaaatactaccaacatttgaaaagcccgacaatgtcaaggactggcaagagtcccatatgcgatgggtgtggaatggcagctcactgtagcaggtgctggggactcagtcagggtcttggagaggcacttaattatagcaagaatatttcataagtggtatctgatatagtcaagattagtggggagtaaaaacatgttgcttagaaataattatccaaagatctaaagtcaacaaaagtctttttttctaatgtaaaaatataaactttttttcagagggagggggaacaacttaaaataaaccagaaaacaccttcatattaatcattcttctcatatacttgaaatttgtacttaatacatccgagagaacgcctggatattctggcagaattttatatttctccaaatcaatttctggaaaaaacgtgtcactttcaaagtcctgcatgatctttgtcacaaatagtttaagatggcctgggcgactcatggcttccttataaacagaactgccaccaactatccaaatcatgtctactctatttgctaattctggttgttaagtaagttttaagatctcaaccagacttctggcaagaaaatgagctcgttgtggaggttccttgagttctctgctgagaactaaattaattctatcctttgaaggtcgattcttcccaggaatggagaaccaggtcttcctacacaaaatcaccagattctgtttaccttctactgaagagattgtgtcattctctggaaatacctaaattcattcctgagcggcggtcagggcaggtccccgttcttgccgatgcccatgttctgagacacagcgacgatgcagtttagcaaacgaaccatgacagcagcggtgagctcctccaagcccgctcgctacaccaggacgcgcggccaagattggccggaaggtttttacttggaaactggaggatgagccatgacatccctctctccacctcaaagctcgtcctgggcatccacctccagggagcagaagcagcgcagcagcgccacctggtggtcgatgcgcttcctttgcagatcacgcacagccctgagatccacctctccttcctacgcaccacgcatttcttcactgg

SEQ ID NO: 352 - DNA, 21348 bp, Homo sapiens
taatttttgtgtttttaatagagatggggttccaccacattggccaggctggtcttgaactccttatctcaggtgatccacctgcttcggcttcccaaagtgctgggattacaggcgttagccactgcacccggcctctacccttctattttaataccagttaggctgaaagcaggctgctatgttgggattaactttccatcagaattctgaaggcattcctccatggttttctagctttttaagaaatctgggcttgggccagtcatggtggctcatgcctgtcatcccagcactttgggaggctgaggtgggcagatcacctgaggtcaggagttcatgaccagcctggtcaacgtggtgaaaccccgtctctactaaaaatacaaaaattagccagcaatggtggcacatacctgtagtcccagctacttgggaagctgaggtaggagaatcgcttgaacccaggaggcagaggttgcagtagctgagatcacgccattgcactccagcctgggtgacaagagcaaaaatccatctcaaaaaaaaaaaaaaagaaaagaaagctgggcttgatgcagtggctcatgcctataatcccagcactttgggaggctaaggtgggaggataacttgaacccaggagttcaagaccagcctgtgcaatatggcaagatctcacctctagaaaaaaatttaaaaattagctgggcgtggtggtgtgcccctgtggtcccaactactggggaggctgaggtgggagaatcacttgagcctgggaggttgaggttacagtgagccttgtttatgccactgtattggacaacagagcaagaccctgtctctgaaaaaaaaaaaaaaaaaaaaaaaaaaggaatctgaagtcattttgaagcctgcctctttgagatctctctctctctagaagctttcatattttttgtcctcagcattcttaagtttcacagtgttatgtttcaatgtatatatttttcattcattgcattgggcacttagtagaccatttcaatctaaaacctcatttttatataatttttctcagaatgtttctgctcccaataagtcatgccacatttgcatgtgcttgacttttttttttttttttggagatggagtctcgctctgtcacccaggctggagtgcagtggcatgatctcatctcactgcaacctctgcctcccaggttcaagtgattctcctgcctcagcctcccgagtagctgggactgcaggcgcgtaccaccacgcctggctaattttttgtatttttatagagttggggtttcaccgtgttagccaggatggtctcgatctcctgacctcgtgagccacccaccttggcctcccaaagtgctgggattacaggcatgagccaacacccctggccctgcttgactcttattagtccctttcccttacttccctgcttctttctgtggggttttatttttcccctttgtcagctcttgccaggttaccaagcataccctgtccctggctttcttggttgctcccaaatctgtgatggcttgctctgttgcccaggctggaatgaaatggcacgatctcagctcactgcaacctctgcctcccggattcaagtgattctcctgcctcagcctcctgagtagctgggattacagtcaccatttcagctaatttttgtgtttttagtagagacggggtttcaccatgttggccaggctggtttcaaactcctttgtcatctgctcagagggaagaaggtctcaacactgaaaggaagctctgagtatgtgggtgaggcttgctgactttgagcttcaccctacggtgatctggataggccatgtacggagaaacatctgattcaggattttaagttatttctttttggattggtcatgttccccagagcagtcttctgatctcttttttggaagatggaagttctgggagctgagtggggttgagggggttggggttggggttggctctcagtatttagcattcatgaaagttatagtcatttcatgcccctgttactggtaaactatctaggtcctcacctgtgctgggccagcccccatcacatcctctagtctactctcttcagataatagacttccaatggcaggtatggtaactcacacctgtaatcccagcacattgtgaggctgaggtggatggatcacttgaggctagcagttcgagaccagcctggccgacatggtgaaacccctctctactaaaaaaaaaaaaaaaaatacaaaaattacctgggcgtggtggtgggcacttgtaatcccagttgaggattacttgggagggtgaggcacgagaatcatttgaacccaggaggcagaggttgcagtgagccgagactgcgccactgcacctgcactccagcctggacaacagagtgagagaccctgtctcaaaaaaaacataaataaaatagataaataagataataaacctccagatgtctgttggagcagggcaggaaccattacccagaggcagtgaggggctctgagaaggtgcttttcacatgttcctcttatttaaccagtctaccacagctggagaagcactgggtgctgccagctcctgagcctcagatcatttcattgttttcccttttgcaggtttcaagctcagctgtgtcatacctgcttagtcaattactactgacttccagtttccaaaatgatgctctggtttccgttcctattttctccatcttttttttttttaaagcctagtcagctgggcatggtggctcacgcctgtaatcctagcattttgggaggctgaggcgggaaggatcctttgagcccaggagtttgagaccagcctgggcaacatggtgaaattccgtctctacaaaacatacaaaaattagccaggcgtggtggcatatgtttgtagaccaagctactcaggaagctgaggtgggagtattgcttgagcccaggcagttgaagctgtagtgagctgagattgtaccgctgcactctagcctgggggaccgagtaagacccggtctcaaagaggagaggagagaagaaagaagagaagagaaggaaagaaaggaagaaagaaagactaatcaagtgcaatagtgagaagtaggtaaagagtagaacaaggagttcaatctgtaactgactgaacaatcaattgagataactcactacctttggacaagcctctatctttaccttaaaaaaaatcattttagatcgcgccactgcactccagcctgggcgacagagcgagactccatctcaaaaaaaaaaaaaatcattttggctttagtgaggttttaggagagagtaaaattagctacatttgtttaatccatcatctctgaaaaagagcccaactcatcttttgcttttttttttgagacagagtctcactctgtcatccaggctggagtgcagtggcgcgatctcggctcactgcaagctccgcctcccgggtttatgccattcttctgcctcagcctcccgagtagctgggactacaggtgcctgccaccacgcccagctaattttttgtatttttagtagagacggggtttcaccatgttagccaggatggtctcgatctcctgacctcgtgatctgcccacctcggcctcccaaagtgttgggattacaggtgtgaaccaccgcacccggccttgcttcctctctttgcccgttctccacaaggcaaccagactgatccctatacaaatataaataagaccatggcacctttctgcttgaagttctccaatagctttccactgtgctttcagttctcttctgtgtctccatcgtgaccacacaaaccctttgtgatctggccctgcctgcctttcctcctcactcacagcacaccagcgcccccagatcagaaacctcctttctgactccacctcacagcctttgcacttactggtcccctgcctagccacaagccacgtatgactgactgactgactgactgtctgtcgtccgtccgtccgtccgtccgtccgtccgtccgtccgtccatccgtccatccatccatccatatatctatcttagaaggagtctcgctctgtcgcccaggctggagtgcggtggcgcaatctcggctcactgtgccttctggattcaagcgattctcacgcctcagcctcccaagtagctggaactgcaggctcaaaccaccacacccggctaatattttttgtatttttggtagagacagggtttcactgttggccagactggtctcaaactcccggcctcaagtgatcttcctgtctcagcctctcaaagtgttgggattacaggcatgaaccaccgcgcccagccactttttaagtatgactacttaaaaagcacaggctagaatattcttggctcagaactgtacattgttccttcttatctccaagtctgatctcaaacaccacttcctcatagaaactttctctaccacccgctaacctaatatactaactcccctcccacagtttttcacatcaccctgtttatttccttcacagcacctaaacaagaattatagcctgggaaggtcatttacttgcttactagctgtttcctgtgtcataatgtaagctgcataagggcaggaatcttttctgcctcacctccatatttatagcctcacctccaaaatggtgtctagcacatagaaggcacttaacagatatttgttgaataaatccttctttcctgaacacctagcacactgcctggtgcataacgagaaactgataaaagttgaaaagagtccaaccagtccaatcccttaatctgcagacaagtaaggtcatgtttagaaggttaagaaccttatccatagcttcactgcaagctagcagtttccatcatggtaacccttttcaaactcaaactccaatgtgcatacaaatcacctaggaattcaccttgagattttgttaaaatgcaggttctgattcagctggtcagggccagggcctgcaattttgtatttctaacaagcttcgcagtgatgctgcagctgctgctgggtagaacacagtttgagttgcaaagctgtatgccatgttcaacctgtcaagtcacccaggaatttaacataataacaaaagatgtttttaccttcattatgctttcagcctgtaccaactcttggcaaaaacaaaatgcataatattgctatcctttgggtaaaggtctcaaagtacagttgattttcattgttcttggtagttctgttctataaagtagccatgaatgctgaattagttaatacctaatttgttcctagaagaaatacaggctaggttcccgtgagcctctggtcaaaacattttcatcaactgatcaacatagagccttgctttatatgtgtttctgtttaaagacaccttatgtaaaatatattgttgattcattaacactgaactcacagctaacagcagtataacttatgcatgaacgaagcttacctaacacatgtatttctcccataaggcacatcatagcccgcttgcactaaaggacactagacagcactacagcactgatgcttgggggccattttaaagagtgaattcaccaataaaaagcacaaaaatgcaaaaaacacggcagtaaatatactgtgaaaataacacggcttacggtatgagagctgaaacaaggcagcagagcatctccttgatcaacctcacctgggtactgtgcgtgtctgcaaaagatcctgaaagtgctgcgactttattggtaaccttttgaggttaccaatacattttagtgaataggcaaattctcagatacgaataatgaagaatgaagatcaactatacttcctggcaatatcaagggctgcccatatctcactttgcaggattcaatgtccaagtccatgttttccttcttcatacccttttttaattaaccagggctgccgctagcccatagcatgcctctgtgcaaatcagaaattcctctgtgtagatgcagacccatgtcagaatgcactgcttgattagaggggcatgggccggatctgagctcggatccactttctcagtcagatgcctttgcacgggcacagcctgctccaaacatatgatcagccttattgatcatatcccttcttggccttctcttttttttttttctttttttgagatggagtctcactctgtcacccaggctggagtgcaatggcgtggtctcagctcactgcaacctctgtctcccgggttcaagcaattctccggcctcagcctcccaagtagctgggactacaggtgcgtgccaccatacctggctaatttttgtatttttagtagaaacagggtttcactatgttggccaggctagtctcgaactcttgaccttgtgatccacctgccttggcctaccaaagtgctgggattacaggcatgagccaccgcgcgtggccttttttttctcttttttggacaggatttcactgtcacccaggctggagtgcagtagtgtgatctcgactcactgcaacctgcgcatcctggctcaagcaatcctcctgcctcataccccaagtagctgtgactacaggcccgagctgccatgcctggctaatgtttgtatttttcgcatagacacggtttcaccatgttgcccaggctggccttgaactcctgaggtcaagcaatcagcccgccttggcctcccaaagtgctgggattacaggcatgagtcaccacacccggctggccttttctttaaagcttttcagctgtaacgtctgagtcttttaaatctctcctcatatgggggagttggtccagagatggagagccagaataagaccaaagttaaagtatgagaaatagtgtagtggtgtcctgagatggacagcctgagaggaatggggaaggggcagagagtggcctggcagtggctctgacctgaagctgataggccaggtcagcctgtgctcggcgggtgttgacctcgatgtcataggcggccttcttcagttcgtaatctctctgtgccttggccatctcgatctcactcaggtactgagcagacaccttttcctgcttggctttagcttcctgtccaagcagagatcaggtaggaaatgtcagggcagggggagaaaggccacggtgacagcctgcttcccaccaaggttctctttctgcctcatgtattttccctgctcacccagcacccctgcttcttctcagttgtgccacttctatcccctttcccactaagcaacccccatctctctcacccggatcccagcatctctcttggcctctgcttctccaatccgtgcatctttttggacttgagctgttcgagccttccccaaagagtgcaaatagtcctgtgggagagatgtagaaattagtcctttggagggcttaagagatgggagcaaggaagtggggaaggatcaattgcctagttttacctggtcatcgtgaatgtccttcagagtgtagctaaccacactgatgcccatgttgaccaggtctgaggaggccactttgaaaacctgttctgagaatttctgcctgtccttatagatctcctgtgataacaggatggtggggagaagggatgtaagttttttttttttttttttttttgctcactgcaacctctgcctcctgggttcaagtgattctcctgcctcagcctcccaagtagctgggattaccgacacccatcaccatacccagctaatttttgtatttgtagtagagaaggggtttcaccaggttggctaggctggtctcgaactcctgacctcaagtgatctgcccaccttggcatcccaaagtgctgggattacaggcatgaaccaccctgcccggccgggatgtatgctcttggatccactgtctctcacagactagtgtgggccttgggcccccctcattttgacatccttccagatggttccctgcccctaggccaacctccacagtcatgtgggccatgatggccctctggtggccctctaacgtctccagggcaatgtgggcaatctcagcctccgtcttccccaggaacatctgacaggcggccgccaacatctccttgttctgcccctggatttttacctgtagccagagtaggggtaggaaaggtgtggtgggggtctcatgaagtcagagaaaaagcagagagagaagggagagccctctaagaaatgcttcttccatttcagggaaagaaaggaggaggaggcaagtgccttggggtgcctggaaaagatgagactagcagaggaacttctctgcaggcaagggttgagaagactgtggccagaagatgtcttaatgtctgggagagagggtgatggggaagtggactgtggggaaaaggctctgaaagcttcacctgggcaatgccagtgactgagatggggaccccatggcgagtgtaaaccttttcactcttgacattgagggtcagtgtgttgagagagatcctaggggaaaaagaagggacagacagtaagaagaggaggaaaaagagaaaacggaggtcccccttccctggttcccttcttgcctacctctggatctgttggatgcagggcaggacaaagacacgccctccagccaccatgactggggggcttcggcagaaccctgcaaggtgtggggcagtgaggaacggtggcagagcttgaatgtggaagactgaggaactggcgggggtgaggggacagcaacccacaggagagaatctgggagctggaggggaagcagtctgggccttggaatggtgggaatcaaactgggcagttcgtggccatcaaggggcagaagtctggtgctgggaagttggtagggagagggagaaggggcagaggccagactcacaggggttctggggtcactggctgggaagggaacaacagtacttaccggagaccaccatggcctcatttgggccacaagtgaaaaacatggttcaggctggagctggaggagagggagggaaagcctttgcggatggggaaggcgcgctgtggcgtccacaggggcccatcctttccctttcccgtcaggccctcccagtctgcatccgccacggcccgtcccttctacacccatgggtccgctaaggcttttccctacaaaatccttaagatccccagctacctcttctccgcctgcgtatggtccctcccttcccctcgccgctccctttgataaaggtcccccgcgcccagaggcctgcagacctttcccctctctccctgcttctcggcagccccaggctccatctcccctcccccactcaccttccgggacgcgggcggcagcccggctggggtctcgggaagggcggggtcgcgcagggacctgggagccgggcaggggccgctcgcagaccagctttcctgggagctggccccgctcccgcgttccccaccctgccgcaccccgttgctgcggcagacgcgaccccgccccccgcaacggactaagcacccccacttcgccccgcctcggcccagtgcgctcggcccgcccctttcccggcaggccccgctagagtccgcagcccgcccgcccgctggctctcgggcccagccgggctgcctggttagcccggggagggccacatccctgccgccccagtcaccgcccttcttgagccgggaatcccgcccacgccgcgccacgctccgcccccgggtgagggacttgacctccgcctggcaccctggcgtaagggtgattgccacatctcggattcgccgcggggcaactacctgggaaaaccgcagactgggcaatgaaagactacatccggcaaccggatgctgggttctgtgactccaggaaaaggggctcctgggcccagggaggtgcgcgggctggggactcggccacggcgcctcccgccggtccttgccatctgaaggccgggaggagtggggagtcggcgcttgcaaagatacactcaagactgcagacagtaaatcaattttatttgtgttcacagaacatactaggcgatctcgacagtcgctccgtgacagcccaccaacccccaaccctctacctcgcagccaccctaaaggcgacttcaagaagatggaaggatctcacggatctcattcctaatggtccgccgaagtctcacacagtagacagacggagttgagatgctggaggatgcagtcacctcctaaacttacgacccaccaccagacttcatcccagccgggacgtcctcccccacccgagtcctccccatttcttctcctactttgccgcagttccaggtgtcctgcttccaccagtcccacaaagctcaataaataccaagagacctgcatttacagcagggggaacatctcacacccttgcataagttaaaataaatattacgtacacatctccatcacctaggaggacgtacataaatacatataaatattaattaggagcaataagaaataaattaacgacgctctccttcccaccgggcctagccccagctgggctgtgcctcggtctctatgcgcctcggtctctgtgcgcctcggtcccgcctcaagcaccgggtggcgtctccgctgtagtgttctgagttcaagttgcctcggaagtcccagttggggatacgctctcgcgcaccaggtacgcctggtgtttctttgtggtttttcggattctttttggggagtgcggggagtcacagttagaaggcggccgggtgttgctggaggaaagtgctgaggtccagagcgtagtccgagggctccgaagtcagattaaagggctcgaggacggcggacacaggggtgggcgccagggatgcggcgttaggggcgtcctctggaggcaggggcgccggcacaccctcttcagccatcaggatctggcagaagacgatggtgagcagcagaaagagaagccttttggctgggttcggttcctcgactggcagctggcgccggacctaaggggagacaaaacaggagacaggtcaggtcgaggcctctggagtcgggtcgttccccagtgactccagggcagcgcaccccgcgaatgcccacttcggcgatactcaccactcgagggtagagaaccctgcggctgcgctttcggtgcccgcgagaggcgctggggcgcccggcaggggccgctgcgggctccgggagagggtcgaaggtgaagatctcaggaccggagccccgccggggtcccgggatggtggagggggccggggtcggggcctgcaggatggtcatggtcgggtggcagctgcgagagtgacacatggtgagccgagcggagtgtaaggccaagtgagggtcggctgccggcagaggtaatttatgtgctcctgaaaattgggcgggtccttctaactcctcctcccgcagctggggagcggttggcagcagcgggctggaaattccgacgattaaacaaagggagtgggtggagacttgacatgcacaatcctaggcgcccaactgcacgttgtgagtgtgtgagtcgtgagtgggggtgggtgagatcccgggctgcaggcacatgtcgaggcatgtggcacctggagaggggctcactttagccacaggatccctcacaggcctttttttttttttttttttggagatggagcagtctcgttcggtcgccaggctggaatgcagaggcgcgatctcggctcactgcaacccctgactccctggttcaagcgattttcctgcctcagcttcctgagtagctgggaatacaggcacgcgccaccacgcccagctaatttttgtatttttagtagagacggggtttcaccctgttggccagggtggtctcgatttcctgacctcgtgatctgcctcgctccctccgtccttcttctagtagtctcaagttgctattgttgccatctttacgtccacgagttcccaatgtttggttcccacttataagtgagaatgtatggtatttggtttgcccgcctcggcctcccaaagtgctgggattacaggcgtgagccaccgtgccctgccaagagggctttttattggagatcaggccatcctgctgcaatactgacccagttatatgcacgcattcatgcacttgtaggtatccttagaatataaactccccaagaaggaaattgttacagaaatagtcaagattaagggagaaatgaacacactagcacacacagacacaaacctgcctgcctgagcacacatgaagacacacaccgcgtagccatacaaaagaacaaaattatgtgctttgcagcaacatggatgcggctggtggccattatcctaagcggattaactcaggaacagaaaaccaaataccacacattctcacttataagtgggaaccaaacattgggaactcatggacataaagatggcaacaatagcaacttgagaccagtagaagaaggacggagggagtaaggcaaaggttgaaacactaactattgggtactatgctcagtacctgggtgacaggatcattcataccccaaacctcagcatcatgcagtatacctaggtaacaaacctgcacatataccccagaatttaaaataaaagttggggagggagggaaggatagaaagattaaaaaagtaatacacaatggtggggcatggtggctcttgcctgtaatcctagcattttggggggctaaggtgggaggatcacttgagctcaggagcctgggcaacatagtgagaccttgtcactataaaataacaacaacaacaacaacaatacacaattaaatattattcagccataaaaagaatgcaatcctggaaaaaaaggaaaacataccacgtacacctaccaacacacatgtacacagtaaaggtgcaaagactgtatagggacagttcagcaaaactactctcttaggagcgtgcagaaatattcacataaaggctggtgcagagggccacaaatacaaaggcaataggttagcagccacccagatttgccccttgctgtaagtcaaacaaccaaatttatgggacaaacattctaaattgtgagacattatacaaatgttacagtaatggtaattactcaacttaaagcagattcacatttccataacttccttacagacagctgctcatggacacagaatttaactttttttttttgttttgagacaggatctggctttgtcgcccaggttgaagtgcagtggcatgatctcggctgactgcaacctctgcctcttggctcaagccatactcctacctcagcctcctgagtagctgggaccacaggtgagcaccaccatgcctggctaatatatatatatatatatatatatatatatatatatatatatatatatatataaaattttttgtagagccagggttttgccatgttgcccaggctggtcttgaactcctgagctcaaccaatctgcctgcctcggcctcccaaagtgctggcagccaccgtgcagaatttaacatcttttgagcattcacctgtttcaggcgccctctgttgagggtactactgttgagagtcctgaggctagtttcagtataagtgctgtgccatgcagctgcctgaggaaagccagataaagctgatactccagccatgagggccttaccctccggcatgaggagggaaccatggccaggagagctctctatctgtctgtctctgttgctctctctctctctctttttttgttatattgagtttctgcctgaaggaaaggcaagctttcttgaagatcctaagaaaggccaggcacggtggttcacacctgtaatcccaacactttggcaggccgaggcgggtggatcatttgaggtcaggagttcgagaccagcctggtcaacatggtgaaaccctgtttctactaaaaatacaaaaattagccaagcatggtggcgcatgtctgtaatcccagctactcgggaggctgaggcaggagaatcgcttgaactcaggaggcagaggttgcagcaagctgagagcgtgccactgcactccagcctgggtgacagagtgagaccctgtctcaaaaaaacaagaacaaaacaaaaaacaaaaacaaaaacaaaaaaacctaagaaaactgaagactaagtgttaagggggggacccaaaagagctagtgttcacatctgtccaatcaatcaggggaggcttcatggaagagtggcactgaaggtgaccttgaacagtgggtgggatatgacaaattcagatgtggaggatgactgtaagaatggaattagcaaagaccttgagctggaaaagtacaggatgtgtttggggaatcacaagaaaaacaatctcagagtaagtttcctgtaacggagtagtgggaagtaataatggctggaaaggagtggaattgggcagagtggggagagcagagctgccaggtcaggagcctgggtttcactctagactgtagagcttgtgggttgctggatgagataaagggaggaaaattcaagcaggaaactgattgggatgaggagtgatgctctggacgggtagagactaaggcagtagacaggaggctattggaggggctcaggtagatgataacaagagcctgagaaggtggccctaagagacattcctagcataagataatcagaattgggcaatgagatggatatcattaggggaagggagcatgggagagggagagttgccgacagcaagaggatgaaaagatctgagatgactccagagatttgaaatacatctggctcagatctttctaccatcattttaagcctggtgcacaaagtgaatacatatatgatctcttccactggaggctgtgtcatacacatctttgtgtcctccagagaacccagcatggtaccttgtaggcagcagttgctcaataatcttgttaaatgccaggtgaaatgtacaactgtaagtgtgcatgtagtattcccaccttggctgggtcacaccaagcttctgagatgtggctacactcctccaaaccactcatacaaatgtacaacatctttagaaaagctgggacaattcttacacagacaccaaacaggaaacacttttctcccctcccacttaggaaacacttaaaaggatttttcaatcaagaacatgtaggaacacaaataagaggacaggccacaaccggctagaaatacactactgctctgtgtacaattcctgggcctacaagtcactttattttatactcactactcttatctaaatacacaagatcccttccacattacacacttcttcctggctggcataaaacacacctcctctgtaaacaaaggcgcattgctttcccacgcctgtcttcacacctgccatcattcttacatttacacccaagcacagggagcccaccacccccaacatccttattccaaggcaactcgcacgctacacaatgaccaacataaacccatgactacttacacatgtggacagaccctcacactcacataaacataaattgggagtagggggagatagtgatgatggaagaaaactagtgggtgggagagagagagaagcaccaaaggttaggaatgcattacttgtttatgatggaaaatttctctagggcattaggcagaggaggggaaatgaaggggatgccaggatcttgttttgccactacctcccacatctggaatctgggcctccagctgggtctagttatcctcgctgtcctcccggcacagagagacctttctttgtggcaagaccagaatgggacaaagagaagacctgagaacccggactgctcaccattcccaaccaatcccatccccattcctgctaccctcagagccctagggctctgctcctgctccttcctgccacacaggaagctagggaaatgttgggggtgaatcattaagccaataagggggtgggggagtgcaggctggggaatgagttaaggccagaaagtgccaggggctgagacgagcaactggactggctcccactgccctgatactggagaaacaggcccttagcctcctccatttccagctctcctcctcatttccttcccatcttcccccagatcaccatgttccttcatttccctcgtttgacctttgccttgatccatcaccactgctagcctccttctcagccccttgtttttcttcatgacacatatcacgttggggaatcattttatgtatttgctttttgctgttgtttgtcccgcctactggaatataatctccacgagtgtacagggccacatctgacctttttctcattagatctctgtagtatctccagtacttggctgtcacctagtaggaacttaataaatattcttaaatctgtctcctccgaggagctaaacctcatctgcagagaggtctgtttatctagccatgttcctttagaggcccccatgtttgctcttcaaagaggaggttgggggcactcaggtgtggctcaggtgatccgccgctgaatcaggaacaattgtgcagtgacgacagcgacagcaaagccctggcccgcgccctttacaatccctgacataggagtgagtcaggcctgctgcctcacctgggtactgctgcactgctgaccacaggcccagaacgggggacggcaagaatgggcactggcggaggcagaatgggcaggggaaagggaggcagagatttggaaatgggagcatctgagaaaggaaagcagggtgaagggactgcaccagggtcctgggggtagggaatgacaaagtgaaagctttttagctgcacctggtattcagtagatcctcaataactacttggtgacttgagatgggtttgagatagaaaggaaacacggaatagcaaaaagaacatattgtaatctagtggtgttagacgaaattgggtttaagtgccagctctgctacttattaactaggcaatattgggccagttacttaatgttgctgaaaatctgtttcctcaattgataaatgggcaaattgacctctaggtaactgcaaaggttaagaatataaatttactccttctgggcacatagtaggtgcttcttgcatggagcaggggcattattataattatgagaagagggactgctttggaacagggatgggcagcagtgagccaacccaggagtagggaactggaatgagaaaataacctctaactgctaacatcaccaggagatacaagttctttctctttttactctgccctccctccctctccatatcaggcaggttttgtggctctttattttccagagaagcaaagacttctgcattcctagttcctgttcaactaatgtgagtgattttatttttttatgtatgtatttatttattttttgagacaagatctcactctctcacccaggctggagtgcagtggcataaacatggctcactgcaacctcaacctcctgggctcaagtgatcctcccacctcagcctcttgagtagctgggactccaggaacgtgccaccatgcccagctaatttttatttattttggtagagacagggtcttgccatgttgcccaggcaggtctcaaaattctgggctcaagcgatcctcccgcctcaacctcccaaagtgttgggattacaggcgtgagccacaaagtctggcctttatttatttaaaaaatttagtttggctgggcgtggtggctcacgcccataatcccagcactttgggaggttgaggtgggtggatcacgaggtcaggagttcgagaccagcctggccaacatggcaaaaccccgtctctaccaaaaatacaaaaattagctgggcgtggtggcgtgtgcctgtaatcccagctactcgggaggctgaagcaggagaattgcctgaaccagggaggcagaggttgcagtgagctgagattgcaccactgcactccagcctgggcgacgagagtgaaactccgtcttaaaaaaaaagaaagtcttactctgtcgtccaggctggagtgcagtggcacaatctcggctcactgcaacctctgcctcccgggttcaggcgattctcctgcttcagcctcccgagtagcgcatgccaccatgcccggctaatttttgtatttttggtagagataaggtttcaccatgttggccaggctggtctggaaaactcctgacctcacgtgatccgccccctcggcctcccaaagtgctgggattacgggcgtgagccaccacacccagcaaaaaaaaaaatttgtttttactcaccactatactgacaaggaacaggtgattttaaacatcccctcccacctacattttagctggaacaattctccagaggcatgggggtagagtggggtggtgagttctaggcagcaagttaacaaatgacccctaaagatattcatctaggctctaggaggcccaaaatcaggccctggcagttcccctgacgcaaaaccatggcaagagttccgggagcaccaaggcaaggtcacaaaagtggcacgatgaccctaccctgggatgcagctcagcctgacccagcccaactcaacccagctaccctggaggctgctatgagctgagccgggagctgggaaagggcccagcattcctgtccttctgccaaagccggcttcttaggaccccagtgttgtggctcctcctttggtcttggtttctttcccaccagattataactccaccagagtaggactttatctatcttgtgtactgctctattttcagtgcctagaactgtgcctgtcaatcaatacaggctgctgaaaaggctagaaatacaggatcgttgatgtcattactgttacagtgctgttcccgtgggaagcagcctgcatctctctgtagacagctccaatgtcagccattggagaatttgatggagattgaagtcaaaacataatcataggggaaaaatgcacaacaaataaaatatttccccttttgtccagacttttcagacaccccgtatttactggatgagttgatctacaaagtgaaaggcataaattaaaggctctctaatgtttctcctcctctgaaaccccatgattcagcagcgtctcccatgtgtgctcaaaagttggacgtgcctccagcctaccctccaaagcagttgccataggctcttttcttccaaggttgggagggacagttcattccccaagaggcctctccaggggcggaggcgggtgctggggctggcctgtctgcagctccctggccctacccagtggggatcgcgtgtcagtactggggtttggtgggctgccaaggggtgagccctgaggcggttttctgggaaggatagatgccatgtgtgactcagaaccaagttagggaaaaaacaagctcactcaatctctagcaccctctgcctggcctggctttgcccatgagctcataaaagaggaagctgggccggccagacagtagctctgctttccctcatgttttctctccacgtctcacggattccctagagtgtctgggcctcaggccaccgtcatcctagctcctgggccctggctcttttatgacactttcccttcccagacacttggtcatttctttccccaggttgggaatcccacctaccatagaaggggaattgcacacaaggggaggttgcaaatctctgtgttccttggccctgctgaggcctccactgtcagccatgaccatttgggtttgtgcgtgtgactgctgtgtctctgacacagaccaagtggtgctgaccctgggagcctgaattaatagatttcttgagagctgagattctctggttcaggaaagaaaaagggggtaccaaatgactgggcagccgagccaccctcagggctgcaatattccagttgggaccaacttacctagtacttttggcattcagaacagttcactaccaaaaaggcacattttattttagtgaaaatgggacaatcatgggccataaagaaccttcctaactattgttcctccggttcacctcctataccccccagggctttcttgttcaaagacagacttgaccatgtccatgcctgcttcagtaagttcagtggctccaaactctctgagttcccaacccaaatccaggcaccttgcaggctttctctttcaacacccccattgcttcttgatgttgtgcatctctaattttgtcctttttctcacacatgccaaactcttacccattggaccctataaccgttctatttcttttcctttttcctccctattctcctgggaaaaaaccactcctgaacctgccatccagaattagttcatctacattgtatacaaatctctcaaagcatcacacacacgatattatagtcatttgtctatctttttgattgccaggagaggcacgtgccattgagatgcagccgtcttaatactggtaacctcttgacaaggcctaaaattattattaaattgtcaccattaaaaaaaaaatcagtggccaggcacggtgtctcattcctgtaatcccagcactttgggaggccgaggtgggcaaatcacctgaggtcaggagttcgagaccagcctggccaacatggtgaaaccccgtctctactaaaaatacaaaaattagcctggcgtggtggcaggcgcctgtaatcccagctacttggaaggctaaggcaggagaatcgcttgaacccgggaggcagaggttgcagtgagccgagatcacgctatcgcactccagcctgggggacaagagcaagacttctcaaaaaaaaaaaaaatcagtaagaaatgtataaaccagatattctcaacctatccctgtgggttgaactcatcctatctctgaccctgagcctttcacataaaatttggtagtatttggtgatactgcattttgttttaaaaagtcaggtagattgaagtataatttaaatacagtaaaattcatccttcttaggagtagtttttgatgagttttgataaatgcatatagtttgtgtaaaggcctccaccatgatgatatagagttttccatcacccccaaaagttccctgcatccctttgtagtcagtcctgtccccatcccctatagcaaccactgatcagacttctaaccttacagttttgcctgttctagaatgtcatatagatgaaactacaggctgggcaaggtggctcatgcctgtaatcccagcactttgggaggccgaggcgggaggatcatctgaggtcaggagttcaagaccagcctgaccaacatggtgaaaccccgtctctactaaaaattagccaggtgtggtggcaggtggctataatcccagctac

SEQ ID NO: 353 - DNA, 371749 bp, Homo sapiens
gataataaatttgtattgtttttaaccactaagtttgtggcaatatttgtgtagcaatagataacacacctaaaatgtagcgcatttactcattgtttcattctttagcacttacagtcaccatgatagtttctgaggacaaagattagatcgctatgttggccggtgctgcaagtccccaaaatgggaccatgggagggagtggaattgtagggagtggaagtaggagggtaggacatgagttcttgggcgatggcattagttaccaataaaaaaggcagtatgattctttctcctaatgagaggaactgagaccaggcagctgagagaaccttgtcagtctctagatacgagaggaatagtttctttgaaaggaaaagttcaaaattgaattctgagaaccatgatcaggatggaaggcagaagtcagaagggagggtgcagtttcagaccgtggatctgggaagagatttcctcactgcaccgtgatctccttaacttaaggacagaaagttccaaagagccctaatataccttcaaggcctcatctgcctggatcagtctccttcttgctttctgcattccaagcacactgccttcttactacatctggaatgctccctgtttacccagggcataaatcccactgagttgcttgccagaggcaatggagaccataagaacaagaatgtaaaaatgcaactttgctttgaacagaacttctaaactgagcctgtctcatgcctctttgcacatcctcttcccaatgtctggcaggcctgtcttctctacttccttcttcatttttggctttgtgaagtcatccttaaatattccattcatacctcatgctctgcatgaagcgttttctatacctctaatatgagccagtgccatgctttgtgtttccacagaacccttgattatctcattcatcacgcttctcacagaactgaaatgatcttaaggccaataccacattaaattgtaaaatactgcatctccgatgcttggtatatggtagatatccaattaatatttcttaaatacatgtttcttgaagtgaactgaatagaagaaaaaaaacaagaattctaatcaatacccaaatgtttaaggaaacagagttggcaaactggcctatgaagggattatacccaccaatggtccaattgataatagagaaatatttaggacatgttcttgtttgctgcatttgaaatgtgtaccactagtagataactcttgccaacactttatgctattaaactgctgccacatatatatttgtaactccaatgactcccaggggaactttgtggttcccttactttattccctgtgcaacaactacacttgggttagacgtagtcattactcaatactaacaaggagatctacaggatcaatcatagtattcttgtggtgagcaaagaaatatattcaacacatttcctcatgctgggcattcatgaagactacatttcccagcctcccttgcagattgccccataccatgtgactgagtttaagcaatgagtctgtgagtgggaatgatgagtcactttgagtccaaggcaggaagatgtgggtatggcttttctagagcctctcctcctggcaatctggctagaagtgaaggactccagctcttcagtagcccaaatccttgcatcactctttgaaactcagacaatctacactggactgtgatttgagcaagaaataaatctttgttgcattaggccgttgatatttagagcttttccgttagcaacagtcagtgttgtttatgataaataatacaatctcataaaagttgttctgaagcaaataacattcctccacataatcactgaaatgtctatttattaataagtggtgcagtatttatttaagatagaacataaaaaatcaggtaagaattatttgcataatatatatggaaatcaacctattaaagttgttcaaatattggacagagccagaatataaattacacatacagtttaaaaattacaggaaatcatattataaagagcactaaaggccacttgtggaatagttgtgttcccctgtaagccagaatgtgaagaaagcctactcgtagcacagagacaaacccagggagcaaggcaccagaattctatgccataaaaaggggttaaaaaatacaatccaaaatcaaatataatggattcatgtcactgggaacctccatttgttcttcaaagactggtgttttccatcactgctacattagaaaaagaaggaaaaaaaatagccatatcctatctgaagcaaggcagagatcatttttctctttaaaacaaggaaggactgacaaatctgatgaagtccacctatctttctaagttgatttttcaggatggcacagagccgacttcacctctccaacagcaaatctctgatccttggcaaaatggctgccccaaatcttgcaacttggccaccacctggactcttaaccctcaggggaactatgggggtgggaactgccccctccttggaaaagtattcagaggggtatagaagggcccaattaccagatcaggttggcttccatgggaaaccttgatcttttaatactgagaaagagagacacaactgttctgagcttttggcctcccacagaatgtttttatagactcacctgtttctgcagaatttcagagctcagaaataaaggtacagtctagagacaaaagaccagagtcagcagagacgtggagatatttgaacttgtttggttaaaaacaatgacaggagctccttgggggcagagaacaaggggcacttgtggatgatctgcagccacaccaagccccgagagctaatggattccaatgtgaaccaggtgaataatttatgaggcattattttctgccactgacagctggattgtgaagccactcaaaggacctgctgaacagacaagaggaacagctgacccaggcatcactctactctccagggaactcatgggtctgtgatcattttactgtaaagctgagtgaacgtagaagcccgaagcattgtggaggagctagggcctgatttgagaggaagaagggggagagagaatgagctttccaggtacacgggctttggttgaatatgcagctctacttcttacaatgtgtgacctttgacaaggtcttgtcttcagtttcctcatctataagatggagacaataacatctccctcatggggttgcgatgaggattgcatgaactttagagagagctatcatgtcacaagcaactcataaggagtgcttaggataagtttctctccccttccctgacctcacttttgtgggcagaggaagagaagggaacattaacataaaatatggtctcattttttattactcttaggtatcaaattgcagtccattcgacaagtctaagaggaattacaaatacattcctgagcactgagctgggcttttgactacctcattgtaagccattctcaagttattcttatatacagccgatttttggcggtgtcaaagaaattcattatttcccttgaagcttattttaagcccataacagtgctatctggaggatgaaggcttaggtagaatgacaatctttaaaattactgggccaactattgttgttctagaacttgaccatccttctttctgaatatctcttaggagctttcacttcagcctgactcaggagaactgaaacatcctaccacagggattcacaaggactgctggggagccctgccaaattctggccgatttatcccgagaacaatgtaagtggaaactaacaatgaagatgttcatttgagccaacagaggcctgtttacttcctaaaataatctcttagttacataaccataagatgtcctaagttgagtcctgtctgcttctttgtagcttttggtgaaggccctagagtatctgcttatgtcctgacaacatggggattctctgggacaaggcaagaggacccaagctgtgttcaaatgagacccagagatcccagtgcaaagggacacctttggtaaaactggccactttgggtcatatagatcccaaaagaaatcatgcctgacttcctaaaatcaaaaccatagggatttatcaagaagaaaccctgtttaattggcctatagatgaggatgcaacctaaggcatgactgttgctgaatgagcccaagtgatgggccaaaaaggtgaaccagtccaaacatggcaggaccaagaaggaacaaggtaggagagggcagaggggtggagggcagagaggtggaggggaggagtgcctgcatggccatgggattgttcttcattccctttctcaactgcacccagcagcagtggtttttgctaggccttttgaagacagcaggaatctgggagaaggaacatcatcgtctttcacagcatggaaacatcaatcttattccagagaagggaagaagtccccaaaggtatgtccggtttaacagtttctcaagtgggccaggaagttctttttcatgttctgggctcaatcgtgatgctttgatttcacttggtattttacttttagttttgtctctaacatctggagcaaagatcagaagacctgagttccagatttattctgtgactcaatcactgcttcaatcactgagggacgtggtgtgatgttctttgctctgagcttctgcttcttgatctaaaaagacaggtggttgttctgggtgatcaaaatctcttcttgctctgtgtatcttagaatccatgaaattatgtctctttgcatctatgataacaaatcaaaatatgaatcacaattttcttacagggttgctgaggttaaagccgtgaaagcctgggaacaaatctccccagggaaggtttaagcaagcattaactctttcttctgcaagttcccccattcattgctagggtgttgtctgatagccaccatgcacagttgactttccttgggaaatcatgagtcttttatttttgcaatttggctttatctcctacacatcatccagatggtgcaacatctggtactatatgtccaatggaattgccacaactcagccactgagatccaacattcctgcctctcttcattccaagattccttctgttctttattgtggtagacaagagcaagcatttttatttgcagagatgtacttatttaaaaagcaattgtgaaagcatttgatttaataattaggattgtttctccacgattctttttctgaaaaaaaatttttttggtgtaaatttagagtttataagtaacaccaaagactgagacaatgaagtccatgcatactgtaaaaaaataacataaataacagtccctagtatgcatcagtcattgtactagaggctttgtgtgtacattgattgtctcacttgaaaatcaaaacacggcagaagagtcaaatgcttttgaatgtgctgaaactcaaattttcttccaggtcatctctgtatgattcctcttttacactgccattactggcttctaaaaccactaaagctatgcagatagcctggtcctaacatgttctaaactgggcattagtgaggggctgcctgctggcttgtttaggggccagttggctcagtttggaatggtttaatatcagcaacaatagcattgggttgatttgaatataaacaacttagactttaaaagttcatcctgaaaaacaagccttcaaggacaagtgaggacatgaagcaaattcctaaggatgcctggggttcaggaagcaaagaagaatctttggttattcatgaaaaccaaataccagctatgtggcatcttctgggaaagcacaggggtgggagaatcctggggtgtgtttggcagcactgtccaaagtacagttgacttcttaggctgctgaacaaatttcttctcttgccccaggagaatttgatctgcaggttcccataagtagagtaacatctttctcttgaaataggtgctgtgtcatagtctgtatcataagcttctcttggtcaacataatgaaatgaaagtaactcagctccttgactggtatcaatcttagcagggattaggagacaagaagaaagctggtttctccaacaatcttcctcagattccctagaatcccccctttttgcacagcttctctggagctatgaagttcaaagcattgaatccaaactcgaagtccccattcaacccactcagccttgactgggctgattggatcattgccattttgatgtagaacctttgctctcattttcatgttcaattttctatagtttccaagctaggaagcatttctgtctgtatagagttgtttgcagggatgaaatcaggtattttattttcctggtagacatagtttgaagggacctctgatgtttgagacctctagattcctagcattttgatggcagaaactgtggttttcttatctctgaacttccagtgcactgcaaagttctgggcatatattggtgcttaataaaccctgttaaatgaataaacaaatgattttttctttattacacccccatttcagtagcatggaattatgaggatgattttgccaaattatgagtaggtcctattagattaggtttttctacaggaaattattctttcaaactacagtgtctaggaagtaccttgcacaaaatagacacaggatgcataattgttgattaattagttcattttaacctatacaccttggggttatctagttatgttttcatgaaaactagggctttgtaatatcaatgtcatgtctaataagcctaaatttccagttctaaaaacaaagttattcaacaacactttctcaatttgatgtgtttttcttttcctgaaataatttttttcttaagcttttgatatttgcttttgtgctgacatttgatagtcaaaactcaaacgatctcaagtacttctttctcagctcaataggatcatgtttcgcttaacatttgtgaagttgatttatctaattcattttgatcttgctaaaatatgacctttaaaatttttcatgtcacattgtgacccagaaagaccaaatacatacatgagatcatagttttacctgataatatcactcctagtttgatgatggaattaatttgtcaatatttcatggagttctgctgaaacgattgcaatttcttgggcaagtttcagaacgactagtatatctgtggtcatgtcatcttgggtcatgttaaccagttccattggattatcatgctgttcccttgtctgacaaaaggatctttgtgaaagcacacactgtttcttcccataactcacattcaattccagaccctgaatttctgcttgctcactgtgagccatattgttgagattgtctgtgcataggcaacttgagcaggtttggtttgcctttctggaatatattttttggggaacaaaaggagaatatcaaagcagagttattccagaagatcatttttctcttttcctttttgttttcttaaatgggaaaaaaacagctcttaaggttcttattatttattcattcataaaacatgtattttgtctatgtctatactgataaagacaacttactagatgttagacaatcaatacttccctactactgatcaatacaaacccaatctctgctgtcctggtcttatgatccagcagggaagctagactgcctgcctatggtttaggaaataatacaagctccaatcctttctaggttattaaaagaatctaaggtagttcctccaattttggatcaatggtaaatactttaaggtagaactccattgagttgctggaaaatgcatcatctattggtaaaatacttaagatagtaagttcttcaagaatactaataagtaagttaaaaaattaattggcgcatatgtggagagtatgactcactctcctttattgttggtttccagtaactcatgtacataaagaagagcatagtaacatgttggatgttaggcaggtgatcatctcaagtgaaagattccaggaagatcaggattcaataatcaagccctcaggaaggggcatagggtttcttaggttgtaatccccactggcactttcagccatattgaaggagtggggaaaaggcccaaataacccatgccctttgtccttcagattgccagcatgtcaaatggaagcccgtggggcttcatgtctgatgcattgagcattctggtatatttcccatctcagacttcaaggtctacacccatccatttatggggctctccataaaaaacacccttctgctgctcacaatgtctgcccttggcctgggactttgggctttggttctaagttcctaaagtcaggggtcaagctctaatcattactgtattctgagctttttgtacagtaactgttgacatgtgagttgaaaggaacctatctctgaggaagtgattcctctctccaacatagtgccagactctcgtattaggaaatgatgaaaccatcaaccaaatgtctgccatagctactgtggctcttgacaagactgtgagggagaatagcagtgtcagctgcatacagacatttgtttaggtcatctggattatcttgattgtcaccatggcaactatccacaaccagtgcctaggtgtgtgagaagagtgatacaataatactgtggcatggtcatttagctaattcagtctaagcctaacagaaaccttttccatcaaagtttttcagagaataacaacatctcataagaggccagaggatggcttgtgcttaatatcacacctgtacagtagggcagtgcttcccaggctgtctgcttacattttagcttgtcttacggttacatatggttttagtattttcatttaaaaaatctgggttggttccataaatttggaaaagtaaaattggacggttctggaaattttgcctgtttacacatctgtaaatgtagcttgcttgcattatttttttctagatctgaaatgcattgcatcaagcaagcatgttttgcaataaaagtggaaatccccctcctgctggataaactgggtgctttccacgcgacacaaagtcatatatcttgacacaatctctaggatgcattatataaatggaagaatggtgtggtgaggggaaacaaggtcagggagagtgggcagacctgacttttgagtcctggttctctatgggacaactgagtgactctgggtatgtcactttacctgagcctaagattcttcatttataaaaggaagtccttggactagaaaatttctgtgtgccttcttgactttaatttctattttagatggatattttgtacttcagtatcatgggaagaaatgagagttggaaattcattttaaaggcactgaactcagctcctgcccagaggggcacttcacttctgataaattccattgtccttggctacataaattggaaactattttaactttgtgtatgtgtgtgtgtgtgtgtgtgtgtgtgtgtgtgtgtgtgttttctccctgccaattcataactcatcagaaatgctacacttgggattaccaccactttttacagataaggaaactgaggcatgatactaagtaacatcaggccaagtgaggtcttttggagagcttttaaaaggttttgccttaaatatttgtttaaattctttgttttagagacacaatgactatctcattcctttcctaatgttagctcagtaggcagccccactgatacacaatgtggttttgttgagaaaattatttccttgctttcaaaaacagttaattgctggagcgttttacacaagagggcagtgatcctagaaataacttaaactactttctctgcttaccaaaccaaaacccaaaccagccaaccaaacagacaaatagcatggctcatcagtaatttctccctgtactggtccaatcgtgattaaaagtaagaacagcagataaatgtgtatcctagaagagattagcggaaccatttatatagtgtaaagtcatgcaaaccatgctgaaaaggaagcactttgttgtggtgacatggggaggaagaggctgtgggaagcccctgcctgggtggggccaccacgcacacgcatgcatttgatgcagccattggtgtccccgctggtaagcgtcgggtgtaagagtaagtgaactatacaaagtctgtctacattacaaggaggggtcagccagtgacctcttttaaatgggcttattggaaggggtccatactgaatcagaaatcccatcccctgtggacgacagaggcatggagccgctgggcgtgaaggggtccgtgtctgtgtccgtctcaccctcggcgaggtaccgcttctccctcatccagctcgaccccccattggggccgaacacataatcatctctgtcctgggagatgctgaagccacttggagacctctccagctcctcgtggttgaccgacatcagggacagaggtgtgtcactgtctcgcgtgatgctacgtctctgccggggggagattcggtccgagtaggggccctgcaggtcagcctgggagtggcagctcactcgggagtcgagaagagtcaagataggcaggaccgtgggcctctccacatacgttgttgctgaggaaggaggagttgcctgaacctttccagaactgggtccccctcggggcaggttcacagggtcatgtgcaaaaaacccataggggctgactttgtcaatggtcacctggtggaagctgtagggtggttccggggggcctgtctcagaatagttgcagatgatggttttcaaatcggaatacctgttgtcctccttcttctctgcttcagctggcgaggaggtgcccttggttgggtaatactccgtgacctgcacctgcaaccgttccatgtgttgcatgtgcatatccacgaggaagtccagcttcttccccatgtcctgaacctggaaaatcaaaggagctgtgaattaccactttctctgagggtggggatcgttgctattggttgggaggaaatattctttttttttgttttttttttttttttgagacgaagtctcagtctgtcacccaggctggagtgcagtggcgcgatctgggctcattgcaacttccgcctcccgggttcaagcagttctatgcctcagcctcccaagtagctgggattacaggcacccgccaccatgccaggctaatgtttgtattattagtagagacggggtttcacaatcttggccaggctggtcttgaactgacctcgtgatccacctgccttggcctcccaaaatgctgggattacaggcatgaaccaccgcgcctgaccggaaggaaatattctaatactgtatttacttttcagaagggaagataattcttgcaactcttaataatagaaacagctaataatttattttgtgcctcctacttgcaagccttgcacaccaggtattaatgttaatctagagaaaacctaggcaaggtcttctaggaagcaaaggcggaaagcagagagatgctttgaagtgttacaggcctgctgtgtcccctagaggaggaagtggccttgctaatgttgcccgggtcaaggagcaagagttctcaatttaggaacatttccttagacagaagcatgtggactgttagtctatgtttcttctacatggtgatttaagccctaaaaatacaagggcagtggttagcaagaactgagcttctcagaactgaagaccctacctagcagcttgctcttgcctgcctaaattggcaccttacttgaacttttgtgaatgaatatacatgagtgtatgtgcacacgtgtgtgatgttcttgctttgacaattcacaactcaccaggaaacactgtcgtcaggtgtatcaccctattttacaggtgaggatatgagcaccatgatcagcagatgccaggatagcatctgagcctcaataataactgacaagggtcagttagaaaagttacaatctgactctgtcttatgcactttattgacttttgtgaattttatgacaatcccccaagatggatactattattatctctatttcacaggcaagagaacagacactgagaaatagagtggaaattataaattaaaatttaaaatgaaaacaaaattcttgatacaacaaaaaggaataattcagatttgcttctacctctcctgcacgggtcccatttagggttttgaataaaacaaaaggattactatgatccttgaaaaactggcagtaccatttatctaatgtagagttaggcagatgatgctagattatgagctgtttgctgtgaaagcaagagtgagctgcatggtgctgtgagtgagcgggtttctctttccaccttgaatggatctcacctgtgcctgccctccttccggcctcttcacgcaggcaacccactgcctggacattgagaaaaggaggacacacaacatgcagtggcaggtcactagcatttcctaagggttcaccatgaaatgcttgataattgtagctattatcaagtgtccactgtgcccgctaatattatgtatcaactcagtcctcacagcaacctaatagggtattataatccccatactacagatgaggaaaactgaggctcagaacaattaattaacttgcacgtgatcactcagtaaatgctgaatcagtgatttgatttccatatcttttttgaatggtaggtagtagtactcaagtatcttatctccctttgaaaaacaatggtggggactgggcgcagtggctcatgtctgtaatcccagcactttggtaggccgagttgggcagatcacctgaggtcaggagttcgagaccagcctggccaacatggtgaaaccccatctctactaaaaatacaaaaattagctgggcatgatggcaggcgcctgtaatctcagctcctcaggaggctgaggcaggagaatcacttgaacctgggaggcagaggttgcagtgagtcaagatcgcgccattgcactccagcctgggcaacagagtgaaccttcgtcttaaaaaaaaaaaagaaagaaagaaaaaaaagaaatggcatttgaaaataaatgtcacagatccagtttttggtgagaggaagaaaagacttacctgtctttcaacttttacaaacttccccatcatgctttggtcttcgatttctgatgtggatggtctggctacatatggttcattcctaagaagaagcgaacacttctataagatcattatatctatttttgctatgcaaggtaatttcggctaggcaggccatggccaacagagccatcgttctcaccctcacacttgtgtggcataaaagagcaccaatcaactctggaggcatatgtgagtcaggaaaagtcagagtttttctgcattcaacactggtatctcatgtttacctccactgtaggaaaatttgaagccaaatatcaagctgctattaaggaggctttgctttgtgttaaacattataaagcacctaacagtacctagagtatctagttcctttaaattaaattccttagcctttcattcttagatttgagatctgagacttttactctgagtgtgtgtgtgcaggtggagaaggggtcatctaatgtctgaaattacttacagtgggtataaatatttcatctggccaattttaataagaatgaagaatcccaaatcttgaacatgatgcaaaagatgacactggtgaggaatggaattgaaatgtgtgctgaatttgatttttggttatccactgttaatatctgcttaattctggttagtttcaacatttttattttttttgcagatagaactttcagggagtctagctatttgctagaaaccattcatgctaggcactttctcaatagttgatttctctctctcataggctgctgaatcctgcttagtaggatagtctttggctgcgaagccctaaattttaaaaagatgtcagaaactggtggtccatgtgctaaatccagctggctagtgttttctttggcctgcacggggttttaaaacatgtaagccatctcaaaaattgagaatttcatgtaaaagctggatattctgttttctggaaacagaggatctgcatccctaaaagaaggtagggcgctcatttctaaaagaaggtagagacttcattcctacctcttttagatggggcacgcattctccaggtgcccacggtcccatcactccctattctatccccaggactgaggttaaatattaaaatattaagttgctttctatcatcacgttaatgctctcgattcttttttttttttttttttttgagatggagtctcactcttttgccaggctggaatgcagtggcatgatctcggctcactgcaacctctgactccctggttcaagcgattctcctgcctcagcctcccaagtagctgggactacaggcaggcgccaccacgcccagctaatttttgtatttttagtagagatggggtttcactatgttggccaggctggtctcgagctcctgacctcatgatccacccgcctcagcctcctgaagggctgggattacaggcgtaagccaccatgcccggcctcttgattcttttataagtggaaggttcataatatttcttaagcctaactccctcactcattgtgttacctgccttgaagacatttgggaataaagagatgtaaatttaggcagtggactttctaaagaacatcttattcaaaattttgaagctttggaaggagaagagctgctctgttaagggacaaagctctctgtgttacaatgttgtcagggggctgatatctgagtgtcttctctggctttgtcctgggaggggtatcaatcaactcaaaggtaattatgcaggatggagaatgctctgggttctgctgatatgaagttttcttcctgtttcaataaagctcataagtctcctcttgttttgtaacagtgtgaaacaggtggggctattatcactttcaaaagttacaggaagaaatgtcatccacatggtctgggaagaggagtgagaacatttttgtacagaaacctttcaaatggccaccaactgaaacaagcttcaaactctttcttcattttacttaggagagtgacaacttcacccacataaaggaccccagcagaggtttgggggtggggatgctttacaaactttgcacccctggcccatcagtccatgtccactggccccacctgggagattgctgggatgggaaggtgaatgctgaccctttctgagacttcttgtgttttggcgtggagggaggtccaggggtgaaaatcatatctattctgaaagaaacaaacagagcagggattaaattacacagagctttgttttgacaggaaaacaaatcattctattctctctagaatgagataagggtttggaatatataagaggagaggagaggagaggagaagtgaggagaggagaggggaggagaggagaagtgaggagaggagaggggaggagaggagaggaaagagagagtgcatactagctacagagagaaagacagagccagagagaacctataacctcggtatattcttccgcttgttttgatctggtgatactgaaagcatctttctatcccaggagagagggaggcagacaaaccactgagagaggtgacggctgcatcttgttattttttttttttcataggaaatgtcataggtggactgcaaacctgtcttttcttccaattcttctatcccttccaaaaacatctagttagggagctttacagacaaatcctaggctacatattcagctgcacacatcactgctgctctgtgggcatctctggccagtagaaagatagatccaacaccagcttccattcctatttctatttctgcatgaggcaccagctcctttttaaataacttttattttaggtttgggggtacaggtgaaagtttgttacataggtaaacatgtgtcatgggggttatcttttctgctactctccctcctaccaccttaccccagaacctgttgtttccttctttgtgttcataagttcctaacatttagctaccacctgtaagtgagaacacgctgtatatggttttctgttcctgcattagtttgctaaggataatagcctccagctccaaccatgttcctgcaaaagatatgatcttgttcttttttatggctgcgtattactctgtgagtcattggttcctgctctatgcctggaccaataggaaagaaatgttgcctatcacgctgtaggttgggacggggtgggagggaaagcaggcttgaaggcttatcacaggtccaggaccattaagactatgcaccctgaaacagtcatggctccttccgtctcctccttggaaacccagctgctcctccactgacggcactttctttctctcttgccccgcaaggtcagcatggctggggatatgcaatcagaggtccagatgttcaccctccagccacaaatgctagaaacacatttgcttagtaagtagcaaaaactatgccactgtcatagtccactctatgcttattaaaattggctggtatttttggagtctggcatgccttagacatcatgcttcatcctcgtctctcggagagccatacttgcataaataacagcatgttaagctcaaaatttgttcacacatctattcattcggcaggcagtgagcactgactctgtgcctgccactatactaggaagtcaaagttgatattccagttagggataaagaaaggcctgctgggtgcagtggctgacgcctgtaataccagcagtttgggaggctgaatcacctgaggtcagaagttcgagatcagcctggccagcacggtgaaaccccatctctactaaaaataaaaaattagccgggtatggtggcacacgcctctagtcccagctacttgggaagttgaggcaggagaatcacttgaacccgggaggcagaggttgcagtgagccgagatcgcgccactgcactccagcctgggtgacagagtgagactccatctcaaaaaaaaaaaaaaaaaaaaaaaaaaaagaaaagagaaaggccatggagaattacacctccaagctgacagatagcatcattaacttccaacccagtcagtgtgatgttcctgttctctagcaggacactccagtgggacaacatcactcggacagggaagctgaggcccagagaggacgcgtgtccattggaaatctcacacatgtcagagagtgaactgcaataggattttggtttcctgactgttattccatggctattgacatcataactgcccgtttttacaaaatgctttttcaaagggcatttttacagcttattaaagatttgatacattttaaaagtagaaaaaaaaaatcacatatggagtcatcatctcagtacagccactgcagtctctcaggggaagtcttactccttttctccaggccctgatatgggaaagtgtgtgcatgtcctgtgtgtttctgaataagcatatgtgtgcaagtgtttagaatcatatcatacctatatattagttaacatcatcacaaggtctaggcagagtatatttattctgtgacacacatgacatataaacatacatatgcactatagatatatacatatgcatatatatgtgtacacacatgtccgcatgtattattggtaattatatcatgcatatatatccacaaatcatataatttaaaaaatctcattatatactttttctaaatattattttacggctgcataactttttttttttttttttttgagatgcagtctcactctgtcacccaggctgaagtgcagtggtgcaatcttggctcactgcaacctccgcccccccaggttcaagcgattcttccgtctcagcctcccaagtagctgagattacaggcgtgcaccaccatgcctggattttttttttttttgtatttttagtagagagggggtttcaccatgttggtcaggctggtctggaactcctgacctcaactgatccacctgccttggcctcccaaagtgctggggttataggcatgagccactgtgcccaaccaatgactgcataacattttaatgagagcaggtaccattctttccttacccattgttttataattaaggaaatatggtgtattagagagaatagagactttctaatcagttggagctggtttgattcccagctctgctccctgctagctgggtaggtcctctgtcctttcagcttcagtttcctcattggaaaaatggcactctaatgcaatatcttgtgatttcataagggagtataaacacgcaggtggagtactcaggagttcaataaaaatgatggcaattattagttaggcattgatgctatttccatatctttcactattataagtaatacctgatgaacatttttaaatatggtaaagaattgtattgagaattaattaggcagctggattcggtttaattcggatgatcctgttttgttggcaacatcgaaagcatcacagtcagaagccatttaaatgtgtgctttctcctctctgacaggcctgatcagggtgctgaccttggccatggcaatgtcatacagctatttcacagtctgtccgatctggtgctttgttggcctagacatccacaaggcttcgtggatatttgtcttcttaaaatctctccctgcattttgaattatttctgaatacctctcaccttaaactctaaggttcatagggctttgaggggagcgcagtccctccagatgtgactgtctcacctcgtctgaaggtactttatcctggaaagcatgtcgagatgcccggcagaatactgctcaatcacatccttcacatcgtaaggcctcaaagtctccttgaatttttttttatagagacggaattgtagaattctgcaaggcaaagtagaggcatttgtgcatcccatgtggagagtgcggggagctataacagaaggctagcaaactccagggcagggggagaaaagaaccaaagataaaagagcttgctggaagaacttccaacgtttggttctggttctaccccttggaacacacagagttagtacatctccatcaggattactcccttcaatcatttgaataataagtaaatcatagtattaataagagctaacatttattgagcattcactgtatgccagaccatgagcttaattaatgctttatgaacaatcctgataacagatccatttatagatgatgtgattgtgatttgaaccttcagcatcatcccagggccatatagctaataagggctgagctggtcctcaaacccagacagggtgctgacaaggctggtgctcttaatcactgtcacactgcttgctatttgaggacagctgatatatctcatcctcaagagcctctttaattattttacttgtgagctcctagaaaagaaaacctggtttctgttccctgagttttctcaggttccttataaagtggggcacccagaactggtagatgaaatcaaagcctcacctccatcctttattggttcctccctgagcctcatcataaagttaacttctgttgagcacagagtttgttcaaatccctaatcacaggtcagtgtcaggaggtcacagcccttcccaggcccttccatctggtgcttgcgcaagtcgttttaatggtgcattcaaagttcattttgtttgtcatagctcgtggcttcagcctctaaacattatttttggtatattgattatggtactatctaatttgcttgccatccttcccatctttgtgccactttataagccttctctttacatagttccatacaggtgagaatctataaactaaggctcacaggccaactctggctcactgcctgattttgatagtaaggtttgactggaactcagtcacactcattcctttaggcactgtctatggctgcttttgtgctacaatgatagagctgaacacttgcagcagagacctatggaccaggaagcctaaaacatttactatccgaccctttcaagaaaagtttgatgacctctgaattaagacatcaatgaaaatgctaaaagaagagaagaagacggcagagactagactatgcagcgtcccagcagagatcaccctccaggtcaacacaggtttattaactggttttctctgaataaaggctttcagccagtgaggaatccagatagctgtgttttcatacaaccacatttctgtcatatcctacataaaggtgtcaggaaaatccacgtccaaggctttgctgaggtctacacactgtaacactactgtgcttccctatctattggactgggaatcttgcggaaaataccatgatcagttggagaattcaccttagtttctagaattcactgctacctttatgaagtgcttacatgctgataaagtttaggtaatagcatactttttttcattttcttgcagaattctaaagcaaaacagaaataggtagaatggattatggtctctgctgatacagacaaaaaaatactataatttattatcttgttaaaaatgcgaactaattaaaacaaactatatggatgaagttaggcagaagaaaaaccattttgagcaagaagcctctacaggaagaaaaccctccactctgacaccctttaaaatacatggtagttacagacagagcagaacatagcaggtggaaatactgtcaggagggctgtggggcgtgtttataacaaggcaggtacctacgagtcacccatcatgacttgctaacgtctggatcattttttctggggcagcatacagtatttacatacttcagggacctaactcagggttagtggaggggcttctcttcccccttcccaaagtgcaagataattttataagccccttcctgtgggagttgagctggagcgggggaggcacacaggcacaggtgggaccgtgggggcattacctgacggctcggatggcggccttcagggtggggatcatgtcttcgatggggaagtcattcccatagcccctgtcttccgccatggggtcacctgtcccggcatctgggagggagacacacatatgaacggcaggccacagacctggaaaaggcttggggaccccactgttcggtcaaagccttccacgcctctggatgtgtcaatccccagagtctttatttccacgttgcaagactccacggtattctcaagctgtgatgctgttcagcctttcttggcaccctcattctattacccagaagtccaagtcaaaagtgtgcgcagctcatgactggtagtgagggaaaaggctagcagggaggagaagtgagctccgcagttccagagtggcccccagagccagaagccagcaaaggacacagaagccagcaaacaacacacactgtgcaggcctcagctgggacttttgctctgtcagtctctatcctggtgaccttggagaagtcactttctgagccgcacacatcagaggccttggagagaactgaatgatacaatgaggattgagggcctgggtgggctcagacactgaggaaacaggcttttctgcatgtcctccctttgcataagtaaaagaggcacatgaggccatggctcctacagcctccagagggcgcttttctgccactcttcccgtgccctggtctctaaattgctttgcacctggcaccgccccatccttcaagttgacctccataacaatccaatcatggggcggggggtcggggcggacccttagaaaccaaggtgacaggtttccaggctcctaacttgggagcctgcagccctagactcctgggaatacatcacaatgcctcagcccaagggacaggaggagttagggaagcaagaagttggcttgtcgagggaagggagagagttaccttgtggagtcaaaggttcttaagtgggcaaagggagaggtgaggaaggaagtggacttgggggaggaagaagtggaagagacagggagggagataaaaaggcattaccttcagaactctgccagaaagcgtaggctttcatgcggaaggccgtgcggaaacgctctttattgtttaagccaacaggctttggttctttagaaggactttcttctatggcatctacattcagaggggtaaatagctttcctttagtattgctaccacgaggattagaaaggcgaacccgatccaagagacccagcttttggctacaaaataagcaaaagtgaacaattttcctccttcagtgcaggctcttaaaatttcccatccctccataaagactcacacattctcctccaaggagaaatggggaccgtgcatttcacagtgctgaatctgactcagcagcttggaatcggacagggcgtggttcaaatcctagctccacagcctgctagctcttataccctgggcaagacttctctgaatgtcaattttcccatacgattaaatgtagcttacatgaggtgcccgctataaattgcctagctcatcctagtatgctgcagagattcatctttccccatgcccatttcctgcatcaataacttcctgcctttcctgtgtatcatcccatggtacccagatagtgatttacacagacaaatccttatcaaaggattcctccttgaaaagaaactgacaacacaaatgacgtaaagcagcactcttaatttggtgtccacaaacagaccctcatggatagaatttggcagtccgtgagtttggatggggaaaaatacatttttaatttactaacttctaatgaaaatttagcatctctttccagtatgaatgtgggcaacaaactccagtaatatcctaaatgcctgagacttgccacaacagaaatcacagataattttatatcctgttatttcaaggtactgtttatgctcatgctggcttccaaattatggtggtattcaatctgccaccaggttcatcacaaagatgcacatatatgactacatctcaaaattttaaagactttgataatgctgtttccatataatcagcttcttttgtatattgtattttgtttatagattcaaaattattctgagaaggggtccatgggcttcatgatacttctagaagagttcctggtacaaagaaaatggttaataatgccaatataaagttgccctggtgcaaaaagccagttgcaccttgacttaagcccaagtccacccttcccatctggctgaccttcggcaaatctgtgacctttttgagcctcagttaccttgtctgtaaagtagggataagcattccctgctttatctggttgctatgagatgatgtttatccaggattcggcatagagtgtgacacagagcaggtgctctgtacatgttaatttcttccatttctcagcttttgcccccttaccctagtgagcacgaaggataaagtccttttttgtggtactttccagagagtgccacattgcgtgttttcgcccagtggtatactcaatgcagcagcttctgctcccttaccccacacagagcttggcacacaggaggcattccctcatgtacttgtgaaataaatgagagagtgaatgaatatgggtgatcaaatcagctctgcatgggtttgcgataattttgtgttttctgaagagcatgtctggttaggctagtcatgtgcccctgccagaagctgctgctacctttgaagctgggtgcagtgtggaggtcatggtgttgtggctgctggaaggggagtgaacactccttctgccacacagtcaccctgtgctttctgaacaccaggtcctcgtctgtcatggcggcctaacaacatctgcttcatagagggttagggagtgttacatgtgataatttctgtaacatttcttgcctacagtccagcatacggaaggcattaagaaacctttgaaaaacaaacgagtgaatgaatgaatgagtatatgaatgagcagtgagcagttgttattcctgacttcctctggatctgttctctctcacccagcactgttccagcagtttgattgaggaactccattaataaccagcccaggataaatttagaaaaacgccaatgctcagccagctccatcttccttgaactgaagtcaacatttttggaattgctttcctggctgctactagataaatgactaataggacagagcccatgggctaaaaatagtgaatgaagcaggaactgagctgaacacacattgaagtctttctggcactgcgctgtatggagacagtacatttccatgcctgcccgccccactggactatgcagtgctagcaaggcaaagactctgcctggctatctttgaacacagcacatttccctgctcagaacatctgaatgttcagtacggcaactaagatcatgggcaaaaccagcctggtggaagcatcctgacaaaccatgtgacctaggacacatcatttgtgctttctggtctccagtttcctcatgggcagaatgatgaccataagcccatgcttttcatagatgtttaagggttaaatgaggtaatgcatgtcgagtgctcagccaactgagattcaggaagcgctcaatagatgctggctgtcattattaactgagtaagtaatccttttcccacagaagcagtagaaggctgacgatgtgtgtgaaaaggatggatacaattccctgggccacaaataaaggtttttttggttgttgttgtttaaatgaactgaaatgagtttgggagattcatatattattttacaatacttcttaatgctagtttaaaaagttcaacattgtcattctactccacttccgtatgagataagtatatgaggagcttaattccagataaactaagcaagacaaaattaatagcagccactttttcctgaattgaagtttcagtataattgttgaatataaggaagataatgagaggactctcttggttctatctgtgctgggatttaggatttgcttgttagatatttaaatgcttcactgccaacctcaaacggtctggattgttttggccacgttcacttaaaacgccattggtcacagatggcagtttagatggtgttaggaatccagatgcgtggaacaaagtcagaagtctcggctcagaattgctcacagccattgcacctaagaggcttatggaattcttcctccagcaaagtggatgatcagcttacttcttaattgtgttgcctgaaatccaagaccccaaaggataatcaaatgcaaggcaaagttcactgctgaaactcaaaacccaactctgttctacgctgtatggatttccagtgcataattaaggtgttgttctaggagggcactgcagatcttgcaagaaaagccttccccagagatgacatcagattttcttcgaaagctagggctcttgacatgttaagtgcaggcaaacaacttccaaatatgagttgtaaaaactgcaaataggtggactgggcatggaaaaggaaaatcaaggttgttctatcctggacaatatggctcttgtcctgggctcctccttcaggtatcagcatggggaacttcagccatgttcaactccgtgtagtttcttcacattcagtgttttgcatgtgctgtgaactcgacctgggaaaatcttcatccctttttttcatctaaatgactcttacttttgcctaaaacatggtccaagcatcagccccacatctggacgttcagtctagtggctactgagatccattagacatccattctctgtgcccctagtccacttcaggcttttctcatccatggcactcggccactacagggaaatatttcacttaatagggactcccttactaaatcagtggttctcaactaggggtgattttgaacccccagccagggcacatttggccatgcctggagacatttggtcgtcacaactactgctgatataataatggggagcactattgccatctagtggggagaagccagggatgctgttaaacatcctgcaatgcacaggaaattcccaacaaagaattatctgtcacaaatatcaatagtgctgaggttgaaaaactgaatggtaagcttttgggcctgaaactaccatgttcaacttgtatatacaggatctagcacagtatctggaatgtcgcaagcactaaaagtattattacaatgttgaaagaaggaaggaagtaataaaacattcaatcttctgattaacaaaatgtgtctaacctcagctgagaaagggactgctgtatagtggaaagagtgtggactttgaagtaagagaactgagttccaatctctgctctgtagtttatatttcacttaggaaagtcattaactcagattcaatttcatctgtaaaatgaagctaatatttattcattcaacaaaaatgtgttccacacctagtaaatcccaggctcaaggtaacttgttaacatacattggtgattaaaaccaatgtggttttctgtctctagtgagcttatgataaagtcgagaagacttctgtctctaatgaacttatgataaagtcaagaagacatataataagtaaacagacacattcattgctagaaatctgacaaggagaccaagagaatgcagtaatgaagaatgggaggttgacaggtagggtggctcaggaaggcatcttgagtaaatgggaagatgaattaggaaaccagtttcagtaatcaaggattaagatgatggtggtccggagacagaagctgagatctgaaaggcaagaagctggatttcaaagaaaggaggcaagagctctccaggcggaagcactgcatgtgggtgcgaggggcatgaggactggactgtggcaccaaagggagggcatgtggccaaaacattctaagtgagaggcagagtggcaccagatgagatcagagtccagataagtcagagactttagaaatgaaatactatttaaacagaaatagaaaataggagtttcaattgtattctaagtgtacgtggggcccacaaagatttttgaggagaaagtatttgaagtttgcattttaaaaaacacatacctgttcattgcagcattattcacaacagccaaaaggtggaagcaacccaaatgttgtccatcagtggataagtagattaaaaaatgaatggacatacaacgggataccatttggtattaaaatggaaagaaatcctgatacatgttgcaacatgaataaaccttgaggacattatgctaaatgaaataagcccttcagaaaaagacaaatactatatgattccacttatatgggatatcaagtgtggtcaagctcatacaaacagaaagtagaatggtggtttccagggcctgggagcatggaacaggggagcgttgtttaatagaaatgaagttttagttctgcaaagtaaaatgttctgaagattggtttcataaccattgtgaatacaccaaatactatagacctgtacttttttttttttttaaacagggtctacactctgtcatccaggctggaatgcaatggtgtcatcttggctcactgcaacctctgctcctgggttcaagcgattctcctcagcctcccgagttactggaattacaggtgctcatcaccacacctggctaatttttgtatttttagtagaaacagtgttttgccatgctggccagattagtttcaaacaagcctggctaatttttgtatttttagtagaaacagggttttgccatgttggccagattagtttcaaactcttgagctcaggtgatacgcccgcctcggcctcccaaagtgctgggattagaggcgtgagctgttgcccctggccgagatctgtactcttaaaaatggttaagatagcaacattttatgttatgtgtatctgactacaattttaaaaaaatttaaaaagaacacaatgggctttttggtggagaagggatccatgggaagcaaaaacaacagagagagactgaaaaggaagccactgaagatatccaggcaaaagatgctactgctgtggagtagggtgattgattgcagtgggtggagtaagaagactagaactttgacatcaattttcaactagtacaccaatattccctgacgggttctagatgggctgtgaggaaaaagattgataaataaccacccctggtttctcgttgcacagataagttgtgcaatcacataggtacccgtattataaccatcataagctattttttttggagttgggcaagacttcgaacaagcaagtgtggagaaaaaatcaaaagtggagtttgggacatgttacttttaggaagactgagaggcatcgtgtcaagtaagaagttggtgactgtgtcttttttattcattgctatattcccagactctataatggtttctggtacacaggagtgtcttaataaatattcattgaatggtagatgaatggatggataagtgaatggatgatagagagatgaatggatggataaataaatggatgatagatgaatggatggatgaagatgggtgcatggatgatagatggatggataatggatatatggatgacggatgaatggaagcagtgtgactagagtcaaaaaagagagatttcgaagaaagggttaatctgtcttgcgccattttgatatgagtgctcagtacaatggtgcagactgagtgcccagcacagaacagccaatcccatttataggagtcaaggccttctctccttcattctttcatcctttaatcttttcatgtggaaagggtggggactaacaaaagatctgcagttccctttaagagtacttttagaggcttcctaacacatggtctatcctgagagagacagagaaagcagacaggtaataaacacctgtcaccttccatatgccaaatttttgaggctttggtgtcctatttttctctctaagaaaagactataaatgaaagttgctgtcagtgcttatttcttaagatattttattctttaaaataaaatgggaaatgctaactggagatgagatgataatgaacgtgaagtggccaaaagaaagggggtctggaacttgacgggccttccttaaatggtataaacattgaagaagatgatggtaatttctttttcttttttttttggagacagagtcttgctctgtcgcccaggctagctcttggctcactgcaacctccgcctcctaggttcaagcgattctactgcctcagcctcccgagtagctgggattacaggcacacaccactacacccagctaattttttgtattttagtagagacggggtttcaccgtgttgccaaggctggcaatttctttacagctttcacactgttcgtggtagagctgggagaaccaaataactcctatcctttgtgtgatggttaattttatgtgtcaacttgactgagccaagggatcctcagacagctgataaaacttcatttctggatgtgtctgtgagggtggaagagattagcagttgaatcagtagactgagaaaagatcagccttcaccaatgtggatggacgtcatctaatcctttgagggcccaaataaatcaaaaggagggaaaagggtgaattcactctctttgtttgagctgggacattcatattctcttgcccttggagattggagctcctggttctcaggcctttgaactccaggacttacaccatttgggctcatggttctcaggcctttggacttggactgaattaaactgctggctttcctggtgttccagcttgcggacagcagattgtgagatttctcagcctctgtaattatgtgagccaattcctataataaatctcctgttataaacctcgctatattccattggttctgttttactggagaattctgaccatacactttatttctctacagaggaatttattattttgtagctagaaacaaagatttgccgttcatgtaggttttctgtgcgtttttcttgggacatggttgtgcttcttagctgatctaaccaattgacatttctagagatttttcatatagaattgatagatgcaggaggcagatgagggggaaggtcccagggaatctctaacaggcctgtgcactgggaggacagggtggggccgcaaaaagttcctgctgcttgcagcggggaggagcctggcctctcctgttcctgggtggggacttgggatgctatctgtgagatggcggcctgttaataggaacccttctcgctttgctgagtggtttttcctttttccttttgcccactaagttccgtaacccctctcccttcaaagtgtctgcatgcctaatctttcctggtcatgtgacaagaacccggtttcttcctacaacatttttttggtgcccagaacatgggatctgaggaaaggagggtggaatggggacccaaaacctttaacttttgcttctgagccttttggttctatggcatttatcttctttgttttggaacagtaatgacaactatctttccttttacaatacaatactggaggtggtccacacccaccccaagggccacagacacgcgcgcgggacagttgggccaggcagctgcctgtccctgcttccctaccgactggagtgcatggctgtagtgtgtgcctcatgtgtgtgcagtgtccaacggccatgcagggtaagtatgagccacaactgctgcctgggccccaagcaactggctggcattccctgccacgtgtccacagagttcccccctcccccagccagagagtccagctctgtcccacaatagtttagcttctctccctggtgcagaaaccatttgccataagaataagaggttcttcccccagtcatccttttctcttctccaccctgtcagcagttaacacagccctggatttaacctccttttctctaccctgtcagcagacgacttttaaacaaagcttttttttttttttccttttggaagacattttgttgggctgggaatgatggggatcactgtatttttggtagagttttaaatgtgagaaagtatttgtgaggttagtcttaagctgtagccattctggtgtgctttgcacgtctttctgtatggctggtagcaaactttgctgcaggcctccatcttgatttacatccttgagggcgtggcctgtaacctcgtggcagggctttgtttagcctttgggtggcctagattcaatcctggcctagggaattagtcctttctggtttgatatgtgagcttttgtggtttgttgattcccttaccctccacgaaccaccttggattttcctttctctgagcctttagtaaagtttgaaagccagaaacattggctgcttggtatggctaaagttggctaataagggaattaaaaggattttcttaaggagtgctcaccttaattaaaagtggattatccaagttatagttatatttacaaggactttatgttttccttttcttggaccttgttttgctgggaaaaggtttttttttggttgactgaaatatttttctccatttttgccttgccacttttaatgcacatatgagaggggagagacctctgttttcttcatggaaccccaggaattaatagtacctggaggtcaataatccaaataggagattggcaaacaaaagatcttatggggactgggttttcttctgcctgtctgtgtagttatatatgtgttgtgtgtgtgtgatgtctgtaaaaagatctttaattaattggcctaaaagaaggtaagtgcttggatcaaatattttttaaagggaagataaaagctgtggtaatttcacgtggctttaatcgttgaaaaataaaaacattattgttggttataaaaaataattattggtaagaagcagatgtcatcaaaatataaataggtggactaaattatgcaggtcagatcctaggttggctaaatgttttaaggttataggctgcttttttggcttttgagaacttttcaatttgccagcttcacaactggtaaggcctggggacatgtggaactaaccacacccttagttatgctggaaggagtcaaaccttggctgcatctagcacataatcaaaacaaattaccaggttctacattaaaaaattgctaactgttaccattatgacatgtaattgagactactggaaatagatttatgtgcaaggcgtgtaagaacagtaaaatgtgtttttaataaaaggttagaaaaaggcataaaaatataaattcttgcctaaggctaaataattgttttaaattagatataataaagctaaaagtttaaacaaatggtggaaggattgtaaaaattaatcttacaaaattccatgtgtgaatatattgattaaatacaaaagggtattatatggtttttctgtaaattgagcattaaaataaaagcacaacaaggtattctcaaggcattaatcttctctttagcaaaatttgtaaagggttataaaaggtttttgcttttttaaaatttctgagtcatcattttggcaaaataatttatggtagtatgtaattctatttcataatgtcaagtgttttaagcctctaacatatttaacaggcttgcccaaatcaaacttcagtttcaaaactgtgtttcctgatatctggatttttggatgtttcagagggcctctggagtatccagaaaagagaagtaaataggattatttgacatgtttacgtacatgggattgctacagtggtatacaatcttctttaggctatattttggtgaataacatcaatatatgttccagaattgtatgggatttctaaaattctaatgtctaagtatatgctatcataattaaggttatgttaagttattggataccatgagataatcaaacttcgttgtcaattgtgtttctaactctaacgaccccggacatttgataattgttgtcttgttttaatctctttcaaaagacggtttataataagctacagaactttggcagacactctcaaatacaggtttctgataactttggagattgtgccattggaataaggaaaaaatgtacaggactcatgaagagctaaaatgttcatgaatatcaagcaaaacaagagctaaccgaatgaactcacagaaaaccaaagcaatctttttgacttttgcttggaatattgctgggttttgttttgtttttcagagtcaaggaaacttattttgaactatttacagcctttaacaactgagtaaggtatactctgtgaacaaaatttggagcatgtttctttctgtctgcctgcttgtcctagaatttggaaactagttgtgagtattctctactcatggcaatacaattgtttgcatcactgcaataagaatccattttcttttgcaacaggaaacaattgtagaaactggttgttttaccaaggctttgactggaagggtattcttctctttaaggagtcaagcttgacttgcagagccaatacaagccccttggaaaaaaactggcctcatacctttgcctacacagtccctgtacagggttcctgacctgtggtcagtaaaaaatgtcattttctaacaggcccaggagttccaagtttatcttgggaccttaagaggagaggatcacccaactcacaagtatttgaggatacaaacccatggctgggctctgctttaaaaggtcttatctgagattccttgtgggacagagttccctcaaagccaatctaaaaggcctatgtagacataattattctagctgcactttatgcaaataatcaggccaagtataagactaaaatgtattttgcaaacaactctatcccatcatgatttttttaaacaaaaatgagtattggagagagaggaattatgtttcaaaacctgttataagtttgtcattaaattctcaactcattagttgtttttaaaagtttttgcctacattttagactaaccctgattgttcctgtgaaccaaccagcaatctctggctgcagctcagaagaaacaagagggatgggtaatgtaaaaatctggatcaatattctagttctgagccattatcttgcaaatcccgccagatgacaggaataaatagagtgcccctaacccagaggtttcctttttgggaaagtaagaccaagagagaaaaccaaagccaagcacatgcatccaaagagatccttttctctgcctgtatgtgtcataagacatccttttctctcccttgttagagaaggactcaattccacagcttcactttagtattcagcttatgataaggagtccatgcaaccccccaagacacatttttgttccaaactcaattccaagctttgggtcaaagccctaggaaagaaaactggatctgagggatccagaggcagatgataacagcagttaaaaggcacagcacaggtaagcatgactgattcctgctgattaagccaagcttcccatttcatggataaaaacaccctcttatatcacactagtattcatggcataaatgaggtctaggtaattcaaggctgttgacagcaggagaaagagggcatatgtgggtaatagtggatactcctaccccgcaagccccccccccattaacatgggtgaaagcctctttaacacccatgggtggcacccttcatggtcaccaggactcagagatagaaggaggaaggagagaaaaaggaatgcctcattttccctcccttatgtaccctaggtatttgctaggaagagaaaggagccagggacacctattcccctctttctagatgagtagccattcatcttcagtctgtacccctttcaaatgcatcctgaacccctgggacgcctttgaaaaaaaatgccattttttttcctttttcctcctgtcctctcttcattgataggtaattgtgtctctgtattatgggacactcccttcagatggatcctccaaactgggaaaagttaatgtcccaaaccttaagctggttggcttaggactaggctcagcggaagggaacccagaagcctgatgtaccatcaaaagggtaaaagttttttttttttttttttttttttttttttagccaatcaggctttttgcccccttctccccatacaaactggtaaaagcccctgggatttttgagctgtccttaccacacactcttatttcatatttatacgtgttttctaataactcagtttgtctcttcttcaggccatgaaactccagtcatgcaactggagccttgggcaatggccccttctcgtgggaacccttggataggcccctgagggcaatttgactgccgttttcccaaaacagcaccccctgtcaacaggaagcagttaagatctgtcttcatccttatccttatccttattctaatggcagttagatgtacttctttagaggagggaatgatagatgcaggaggctggtaaggtccctggagaatccccaaccagcctgtgcaatgggatgatggggtggggctgcaggaagtttgtgccgcttgcagggaggaggagcctggcctctcctgttcctaggtggtgacctgggattccaactgagagatggaaacctgttaacgggaacccctctcactttgctgtgttgtttttcttttttccttttcacccaatatattttgtaacctctcactcttcaaagtgcctgcatgcctaatctttcctggtcatgtgagaagaactcatttttttcctacaacagaatcaggtgattggagaaaagatcacaggcctaggcacccaaggcttgaaggatgaaagaatgaaagatggacggaagaaaattaggaccttaattctttgttcagttcagtgtaaatctacttagcccttgagaggacaaaagaaaggtcttcagtggattcttccctgttctctcgtttctggtagagcttaagagtttccttcctttgtgcctgtttcacctgcccctgtgtctctaacatctccctgccagcacccccgacactacattgttcttttcagctgacacatctgctcctcccatcagattgtgagggcctttcccgttaggatatgagttacaattccctgagaatcttcagggctgacaaaaagcagagctcttaatgctcagtgtttaggttagggaaggcagaggatagaatgaagaaaggatggatggaagcaaggagaaaagtgttgcaaagccaggattcaaatctaggttgatctgactcctaaactagctctacgccatatggaaataaccccgggccaagaaaacctggaaatatggttgcaaatcaggataacaatgataataaaagcaaacctttaaataatacttaccatgggccaggctctattctaagcatgcaatccttaccacagccctaggagataggtacccttattataaccatcatatagatgaggaaactgaagcacagtgaagtctgtaatgtgcccagaatcacatagccaacattattaaaagtaatctgtaacgtgcaacgtctaacgtggcaaaacaacatggttccaattctactattgtggctggaaacttatagcacaaaggacctgaagcggcttggaaatcacctagctcaatctctgccttctagagataagggaccttgggctcaggtggcaggtgattcccaaaggactggctactctggggaaggggaaggacagataaagcaaggaggaagcaggattgtgattggactgaccactggattggaaggaacagcatcattattttgaaataactctgatgtgttaattgggttctctcagttaaacaggtttgcaaaattagttctgctgaactcgaaggcctgtttggttccctctaatccagtgagtctgaggatctatgaggatgattccaggacatttgcagctggtactccaatgacactgatgtgaatgtggagagcgacatattattttcttccggtctcataagaaatgttttctccatttacccaaatctcttgtctgaataatacaccagttgatcagcactgatctctagtgagcacctatcatgtcttgaagagagcatttactacaggctgagctctcttcaagacatgataggtatgattccagccagcccatgtggtcagcattattatgatttccacagacaagaacatggagacacagaaagtttgcataagttgccaagagcacacagctaattacaagggaagccaggttttgaagtctagtagtctgactctggactctgtcctcagtccctacggctatgactacctcctaactctactacctagttatttttattccctggttaaagagaagaaatgaccatagatctggagggatccaggcagacacaggttcaaatctcagcccctgtgtgagttgtttcaccttgctaatccctagtatccccagtggtgtagggggataatacaatctaaatctttcataaatatctatctcaaagtcatgtatcctggatctgctgagacaggttcccaccatatgcaacctaccacacttgtttttggcaaacacagagggttaaattgtgttgccccacacaaacatgtagtatcgctaacccaatacttgggaacatgactttattttgaaatagggtctttgctgatggaatcaagtaaagatgagggcatattgaattagggtgggcctgtaatccaatgactgttgcctttataagagaaatgagagggagtttgggacacagacacactcagagggaagaaagccatgtaaagtgggaggcagagattggaggaatgggtcgaaaagcccaaggatcagcatgaactacctgaagctaggaagaggcaagaaaggactctggtctagagcctttggagggagcatgggcaggcaacattttgattccagacttctagcttccagaactgtgagagaataaatttctgttgttctaagtcaacccattatgtggcaatttgttatggctgctgtagaaatctaatagcaaatgagggcttggtgaatgtacttagtggaaagttctattttcagactgatgaagccaagtcagggagccgagacacattcttgtgtgctaagggataccatgctcataggtagagagaaggccacatgaaccataaggaggaccatcttttccctatttttgaagtcataaaaatgcaatgtcaatactttcagaagaatttggaagaagctgatagctctactagcttctctacatggaaggaggtgaattatccaactgggttatggtgtgtgcaatagccattcacccatgttctttgattgggagagttctgtattaaatgtcagtgttcagatatggtctttctctctctagctctcagtgcccagtggctggctgggagagtgtctgctctgtccctgtgctgtttccaaggacacacttggtgaggagtgttgcccccagagccaaccttgctttacccagaaaatgtaacctgtgttttattttattttatttttttatttttattaatttcactttaagttatgggatacatgtgcagaacgtgcaggtttgttccataggtatacatgtgccatggtggtttgctgtacctatcaacccatcatctacgttttaagccccacatacattaggtatttgccctaatgctctcctgccccttgccccccatccaccgacaggccccggtgtgtgatgttcccctccctgtgtccatgtgttctcattgttcaactcccatttatgaatgagaacatgcggtgtctgataacctgtgttttaatcctttgacttctaggtatatttcttaattggttcataattcagaggggaattacatagccctccacaccccattatcccaagaggaaaactgagactaagtcttcaggacatatctgggatccctctgaggttaaataaaattggtccaaatctcacctctgcatctgttactctgcagcctgggataatgttgcagggtctggatagcaggagaaaatactaatagctatggggttgtgttcaagccttttgttttgctctggttaacaatttcctcatcagtaaaattaggggattggattgattgagctctaaattcatgtttacctttagtagtcattgattttgaagcatggaaggtgtttgattgccaacattgttcatgactctgtgagataaatttcatgtggctgatgtcacagggagaaggcaaagcgtgaattatagtgtctgaccaaatgttctttcacaccacagatgaccctggctctgtgccttttcttgcctctatagcctcctcctgtgtcagggacttcagctaggtgggccaagaaagggtagaagagaacagaacgagcaaaagggacacctgctgtgactgactaggtaactgttcccaacagctggaaggaggagcatagtggtaggaaccatgaactacagagctagaccaactggatccaagtcttgctcttgcactttctagctttgtgaccttctgcaagtcacttatctatctgacctcagtttctcatctataaaatggggattaaaaatagtacctatctcttagggtggttatgaagaagagttgtgcttacaactatgccggggaagcagtcagcattctttgtaagttactattggattctttgatccaaagaatgattctctactaaatttgaccactctgtagtgggaaagacataatcatcacataggaaataaagatggtacctgggacagatttttttccctctccaaatatgaatacagaggagaagattcctgaaggctgctgttcagattgaattggtagaaaatacagagtgaaccactgggctcaggcaagcaactgctgtcaacacagttatctattttgagaatttaaaaaatgctagtttctatcaaaaagatgtccataattatcagcactgttgcatgtctactgaatagttattattgctgttcaaaatgatggacctaacacaaaatgccagtcttaatatggttaactgttcacgttctttaatgcaatattattattaggaatttgaaaacttacaggtagaatttatgcctgcaatgaacaattatcgtgttttgtctacttgatgtttcgtccctcattctttgaggaaaaaagggccctattcttttcaagaactgagtatcccacttcaatcatgtgactctaatgggggttgctaagtatagtatcttacaccacacccactcactctaacaggtggaaatctggtccagagcttagacagtagcggcttttactcttcaaggggtagagattgtccagggtgtgaatatgtaactcaaactgggtcaatctgagtgcttctctgggattttagaaactggtgtttggtgaagggtaggtggacagaagagagaggaaatatatgtgattttggagctgttagtatctactgcttcactgatatggagaaagtcggctgagagtaaaattatcacaaaaagagaaacagagataagagataaagagagaaaatcctggggtcccagtccttgtttcttaggggttcccaccctctctgatggctgcctatgtgaaccagtacacctccctcagtttaagttgggtggaacactatgacacttgtagaataatgagtccatccatccatctatccatccatccatcatccacccattcatccatccatccatctatccattcatccatccactgtctcacaaagttaatatctactgaaagccaaccatgtgtcaggctctgttccaggcactgtgtcaggtgtaggagataatgcagcgaataaaacagaaaagagcttagccccttggaggcaactgacttaatatatataacaggcaatcatcataggatcatggggatagagacagggtcaggggcagagggtcaggaaaaatctctcttgggaggtgacattaggcaggcttgcaaaggaagtgaaggagggggctacataaaatgtgagataagaccttctggctgagggaagacaagagctgagatcatgcgtccattgtattagccgaggtcattctgcactcatggataacaagggcatgacagccacctgtgttgcaggcagagtccagctgatgcggaggaaggctaatggactccctatgcatctgcaaggtccatcttcagtgtttgacttagttgtaagttatgtaaatgcttgagatcaatttcctcataagtaaaacagaggtacaactcatccctgaattaggtcattttttatagtcactcagcaaatacatgtggggtacatcttacacttcaggcagagtattagccttgtggagctcatggtctagagaggaagagaggatttaacaggtgtatatgtaaatatgtattatatttatgtcatatataaaataagaaccttattatatttgtatagatacataataactttcaaatcagtttattgaaaagaactcaagcccatagtcagttataaagctgtcgcttatgagggctgtcttgactgttttgatttatgaggatttgtttgaggaataaaagctcagttgaattcttacaatgagtgggaggttggctttgataattttatgcttccttctcaggctttctgattctaaggttaatcagaaagaaaagagccaacttctaccgtgggcttactaggggccgagcgttataaagtatatatgctttattagggaagttctgagtcctacctcagggcatcatgagttgggcatctaaactaggtgagaagggatgggagggtgtcagctgccttcactttcatgagaatcaaataagatgacatatgtaaaatgcttagcataaaattatcaaagccaacctcccagtcattgtaagaattcagctgggcttatgttccacagacaagtccacgtaaatcaaaacattcaagacagcccttataaagccatagctttataactaaatatggacttgagctttttccaataacctgactggaaagtcatttttcttatccccaatatagcaccagcatgttaagttacagagaatataattctttcatcagcctgacaaataaacaagtgtataggctacctatgctagaaggaggcgataagataaactccaaatctgactctatttagaaatatgaataaaggggctgggcccggtggctcatgcctgtaatcccagcactatgggagaccaagacgggcggatcacctgaggtcaggagtttgagactagcttggccaacatggtgaaaccccgtctctactaaaaaagatacaaaaattagccgggtgtggtggtgctcgcctatcatttcatctacttggaaggctgaggcgggagaatcacttgaacccaggaagcagaggtttcagtgagccgagactgtgccactgcactccagcctgggcaacagagcaagacttcatctcaaaaaaacaaaaaacaaaaaagaaaaagaaaaagaaaaaaaaaagaaatatgaataaaggaaggttggaacaccaggtggctgtcggcctgttgaagaagctattgtaaggtggaaaatgcataccatcaagtgtgaccctaatgcacacatacattcctgacattctgtagtcacttggttccccgcctcctgcgtaaaggaattgattcctctgttggcaattcttgcatcccatctccaggtctcatttccatctgtaggctatgcagctataatcacacctggcatctcaactgctaatgcatcagccagtctgactctgtcccaaccctggatgaaggagactgagtgacttacataatgactttgctcttcttctctgaggtgggtgagccaccaaacacccagcaataatgggatagattttccctctgtgctcttggcagagtggggggttcttgaaagggacatgagcaagttgattacaagatatcagaagccccttttctagggaggcatccccaggaaagcctcaaaatgcatctatctgagccctaattaaaccggaagtgctgaatccagggcacagtgatatttgaatgcagatttcaatgaattttcttcatgtctgtatagaaaaggctctaaaggtagatttaataattcacttgcagtgtcaaaatctgcacgatttataaacctgttggtcatgaaagaaggaaagcaaagaacaccctgttgggagtcttgagaccttgatcatctactcctggtgcttatggggtgtgtgatgtgggatgagcctgtcctctccagggaccttggtttccatagaattatctgcagagatctctgtggtgtcctttcactctgcctctgggagccacgagctgctgaagattctctagtgaatgtcctgacaccattactgtcattcacctaaccctcctttacgatctcctcaaaggcccttacagtcctaagtgggtccaggaaagaaccacgtggttcatttgaaaacacacccaaaggaaacagaactgacactgtcagtaattgtctcttccaagtgggattttgtgtggatagggcttcatggaaacacttgggaggatttgacttggcctcccaaaggccactgttctcaagtggctcccctataaggtagtccagggtcctctcacctcctctgcccaaattctgtcagcactaggaggagagcatttggacttagtgtccaggagattgattgtgaggactcacaaatgattggtcaataataatcgtttaaaaatggtttctacatgtcatataggtatatagatagatgtggtttactgggaaacctccacagtcatgatgatcatgaattacagtctcgagtcaacttaccatctgtgagcccaagaagcagatgaaatgatatatcatgaaaataacatggtcttaatatttgcacctgactttgaattttggtcttgccactcaatctcaacccaacctctctgagccacaatctcctcatccacaagggatgatattagggcctatcttacattgtggttatgaagaccaaatgagataacatatgcagaactcctgacacagaacccagaccctcaataagaggctgctgccatgattcctattaagtttccctcagatcaaccagaaggaaaccaggcagaggactatggtggtcagcaacagtgtgaccccaaagactctatcttgggaccagcatgacctcccatggggccctacaccatatggagcaggatgctctgtcttgacacagagatgtgaagaagggaattcataatcagaaacttacctggatgctgcctccagctgttctttcctagaaagagaagagggagaaaaaataaagcataaattacgtgaaacagctgtatccttcctcgaaagattgctgcaaagcttctctctgaagatgatggagcagagttgagctctaggacaggatggtcagtgtggagggaaccaatgaaggaggcgggtttacccatccagaccccagcccatgctactcccgttggctctgaggttttcagggctcttttcagccagtcattcattcatttattcatccagaaaatggttgctgagcacttactctgccccagctctcatgttgagctcaggaaatttatttggtggtggagacagaccaggaaaccaggaatgtcataatgtagcagtcacacacccccataactttgtcactaccattgtcatcatagcgaacattgtcttaactcaattaatcctcataacaaccctatgaagtactattatcatcccatttccctgaggagaaaattgaggcacagagggattaaatgaattgctcaagggctcacagttaggaggcagcaaagtcaggatccaaacccaggtgatctggctctggagccctcactcctaactgggaggtgcaccagccgtgctttacacatattcatgactccaagccttttctcaggctctccttctgcctggaactcccttcctcttttccctgcttggaacagtcctactcatcctttatgtacacctggaggggccctcctaggggttcttattcaattgcccaaggtctacactgagcaaatcccctcacaagtggaatggtactctgtcattattacgtggatcacattgtagtagaattacatgtagtctcgttttttttttttcttgtctaaaatatgagcactctggagcccagcacgtgagagtgctcactaaatgttgaaagaatgactggcctaacatagggatccatgggtgggagggatgaagacagaacaagagaatcatggcagagaagtaaaagagttaagaatttctgctttgagggtcagctcagcatttagttacagtgtggccttgggctggccatacattctctgggcccatttccccgcgagcacaataaagtgatgagttagttgatcacaaagcaggtggacacagaaagctgtgactctctaggatgttctgagtctctgaggccaggagaagtaggaaaggtagtaaggggaaggaaagggcaagggggcagctgaagagcatattggaagagaaggcatggtagggagaaagtttaaaggattagcactgtccattcctctttcactctccacgatgagtatttcatgcttcctcttctaccatcagacttctctcacttctccaccttcctcccagctgatgaccttgactcccctctcactgagatctacccatggtctcaccatctggctccactcaccggacttctgttttgtgccaatggatgaagggcccatgctcttaatgaaggcccatactccacagaccaggccatctctgcttctctctcctctagtctttccccttctcccatatgcacatttatccttctctactagaccctttccatcaaagaaaaaaattcttggcctcacatccactccagctgtcacctacactcactgaacccacttgctcatttcctcatcacccttcagttcatgtcatctggcttctgtgtccagtactccactgagattgctctagccaaagccccagccaactccaagtcacaacatcccatgagcacatccctatcttatcttcactacccttatgataggaaaggaccagtgcagttgacctgtccagttaactgttagatccccaataccaaatagagtgcacataagggatgatcaataaatatatgctaaatgaatggactaaatgaataaaagggttttaacaacattccagagtgttctagatcatggttgctaacagtggtttcccagggcagtaattcggaggcttcctttccccttcggcatcaatactcccttgcagcccagattcaatcagccgagactgaacacttgctatgggctagggactaagacaaccactctcacacattttactcagtttgaccatccaaacaacaatcttcaaaaatgggtcttattatccaaacaacccttgtgtcatcttacttttatccagttttctccctaaataatgttttcttcccagagatacaatgcaaaataaaaacataggttttggcacaagacctgagttccaatctttgttccatcacttatcagctgagcgatattaagcaagctaattaatctcattgactctcttattctttacctataaaaatggggttatgaaaaatggagttaccccttctacttaccttccaggacatcctaaagcttaaataagatagtatgtatgaaagcagatccaatgttatttggccataggaaatgactagtgcatatagtcccctttctccatttctaagcactccaataatcttgaccctggtcgtaaaaggaacaagtcctggttacacaatgaactacctgttcttggtcaagtattttctacatcgtgggcgaagtcttcttatctccatttcagttctcatagctaacaattccagagctgtgctgtccaatagagtagtcattagtcatagaaggttatttactttaaaattaaaaaatctgttcctcaattgcactgctaacagtcaaattctcactagccacatgaggctagtggctaccatattgaacggtgcagctatagaaaatgaaaagccagacataattccactctccctaccaggaataaaacaatgcacatgctctgtttataaaaagcaatgtctgatttttaacagcttccctcatccctgcttgtatataagaacgtataatctgccatcactcctaccccagcatcttcctgtaccccctcggacccttatgaccaacttgtactaagtccattcagtctccactggtcagcagatcagaagacctgggtttgccctcagttatgcccagcatggtatgtggcctgaacttcttgggggttcctgaacttctgggggctctcaggtttttctcatagaaaattgggtttggacttgaaactctttgaagttctttgcaattccaaaacaatgagtttataattataatttgtaataaaaaaaataagaacagaccaccgtcatccatcactgctagcccccaaaacacagatacttgcaaattaacaaagaactacactaagctgaaaattgtgatatggcatcatgttgcagatgggctacgcaacttcatccttccaaacctttggcaggaatctaaaatggtgcagccactatggaaaacagtctggcagttcctcaggaagttaaacatagacttaccaatcctactcctaggcatatacccaagagagttgaaaacatatgtccatagaatgtgtatgtgaatgttcatagcagcattattcacaaaagccaaaaagtggaaacaacccaaatttccaacacctgatgaatcattaaacacaatgtggtatatataatcaaatattatttggctataaaaaggaaaaaggttctgataggcgctacaacacaaatgaaacttgaaaacattatgcaaagtgaaagaaaccatgcataaaagaaagacaatatatcatatgatttcattatactatgaaacgttcaggataggtgaaagaaagacagaaagtagatagtgattgcaggggctgaggagaagacggaaccaggagtatctgctcactgggacagaatttcttcctgggataataaaattgttctagaattagatagtggtgattgataccccactttgtgaatatactcaaaaccactgaactgttcactttaaaagggtaccttttatggtatataaaatcctcttgtgagttttgaaatgtatctcaagaaagttgttattaaaacaagcataaacaaaagacaagaaaacctttaggaggtaggtaagaaaacaccagtgtgtcgtcagctacttctttgccattaacatacagagtgggttggaattcagggacattcttttcccaagggactgccttgcttcagaatggttgctaaatgaatttctctagggacattatactttcgtccttgaaaaaagaaagaaagaaatatattctcttagtttaaaaaccattctcatatcacagcagctgtctgcagcacaatgtattcctccaagtctctgacagctaggacaatgccttatttataatacatcaacccaaaagaatgggcccattgccaacaccttgggatgcataccaaatggaaattgtcttggttctgcatccaaagtgttcttgtttgagttcaaggtcactgtggtctcttaaggggaagtcatctgcccattctaagaagactctgctttatgctatcccaaatcttcaatgattataacagggatagcattttagaatcaaatggaaacatgtaagtcatgttctgagcaagtaagtctagttacaagtaagtatacccaaactttcccattcttttattgaagacttgcttcctctgacccctctaactctcccaccagtcatgggtcccttttgcctgttctctttcaggtcctccttctactcccccttcgaactgcttttaccttggtctaggccctcatttcctcttactctgaaccctgcaatatttgctagctgatcttcttgctttgacttgagtccatagatccatcctccacactctttgctatcatcttcctgaaaagtagatctactgatgtcattctctggctcatctagcttctcattgccttcaggatcaaagttagattcctctgcaagtcacccgtgaccctccatggttgtcccagtgattaacacatacaaggggatcaaaaatattagtggacggagtgccctgagtgccctgaacagaaagtggcacctgccaccagaaccttttgaggagtgaaagcaagataggaggtgtgtggcggtggtgatcaggggcccaatctttcagggtcctggaggtcatggtcaggttttggactttctttactttgtcatggtcactgactggaaggttttatgccggaaaatgagttgcaattctcttctatttccataatctggagatgggagtagaaagagaaattgaggataatgaatatgtgtgtgtgtgtgtgtgtgtgtgtgtgtgtgtgtgtgtgtgtgtgtgtgtgtgtgtgtgtgtttgcagaggagttgtggctgggcacagagagagccccctatctagtagcattgggttatatgagggtccactgaacctgtagacacaatgacagaaacttgctttgaggcaggttccagccccaactatgaggctaactgtccatctatgtttctttccaagtcaagggttctaggagtccagcacactacccatacgcttaacaatctgagctcaggcccctagtatcaaaaacaaaaaaatgcactctgttctagaagctcaagtagtgaaaagaccatgggctttgaaagcctccagatgtagctgacattggttcaaagtgtcagagcctgactctgctagcttctctgaaagtagcctgggagtttaaaccattcagcctggctccaggtgtggactctgggccactggctcagccccaccccaggggctcctgttcaggatgcatttaccatcacacttccatcagaattgctgaaagtggaggccagatctactttgcacaatacccccattaagtctgatgcacctcaaatcttctgacttattttatagggtacctgtggggaataaatgaaataatgaactcgaatgcctagagcatagtgggcatccaatgcatattaattttgccttcccttttccataaccatagaaaaaggttcttatttttctctgagatctttagttcaatctcccacctctgagaacacgaaacagcgtctctgggtggctagaggactcttcctgctgtcctcttccgcatttcctttcctggagtccagagtagtctgtgggtgcaggccatgcccaggttggaggaacatccaagatttcagggtggctcattgtgtgggctgcccacttcctcaacccactgatcctgctcacacattgatcggacctttccttatcagctactccatgccactctgtgctggctaactgggaagccctggctgcacagaggaatcacctggggagcatcaaatatactgatgctgcggccccggccctggggattctgacttaattagcttgaggtgtggcctaggcatcagattttttttttctttatttttatttttatttttaattttttgagaaagggtctcacgctcactgtgttgcccaggctgaagtgctgtagcacaatctctggtcacagaacctccatttcctgggttcaagcaattctcctgcctcagcctcctgagtagctgggattacaggcacacaccaccacgcccggctaatttttgcatttttagtaggaacgggatttcaccatgttggccaggctggtatggaactcctgacctcaggtgatccacccgcctcggcctcccaaagtgctgggattatgggtgtgagccaccgcgcccagccagaactgtttaagctaccagataattctagggtgcagcccaaattggggaacattgccctgaagagtgttctccagggacccgtgaggccacagacacgaatacagaccgcaggagagatggctggtcacgccctgagcattcaggtgagtccccacttgcctgaagaaaggaaaagagacgactgattcataaaatctccatgtcgccaccaggtcaatcctgttggggttggtagcataatacctccaggcagcctgaggggcagaaaagaggggcaacaatgagtgggcaccacctgaaactttcgcacagactcccacaccaacaaaacaatgtttaagccctggactcctaagaatttgaatgtgcattgagccaacattcagaaaaaccgagattcttggctttttgaagctgctttgggaagaaaaacttccttgaccatcttggagctataattggtgttgtggtgagtgggggaatggagagatgaactggagtggagggagagaagagagtagtaggcataaaatccctgaaaggaacaagtactaaaggccggtgctatggctcacgcctgtaatcccagcactttgggagaccaaggtgggaggatcacttgaggccaagagttggagaccagcctgggcaacataattaaacttcatctctacaaaaaaaaaaaaaaaaagaacaaagctgggcttggtggcacgtgcctgtagttccggctacctgggaggctgaagtgggaggataaattgagcccaggaggttgaggctgcagtgagccgtgatcgcaccactgcactccaacctgggtatagagtaaaagaccctgtctcaaaaaaaagtaaacaataaaatatttaaaaataaacagaaacaagtgccactctttccagaagattccctgagacttctcagtcaaatatataggagaacagagtcttttgtaccatttctgggtgcaagagaaagcctaccagatgaggttttgacataaatatcctagaatctctaggattctctgatggtttggggtgtggggagttaatgggtcaggctcttggaaactgggacaggcctaggaaccacaatatgcgggatgacatcatgcaccatctagagtcaggcacacagacccacagagacactcactacaactggagaaagctcaccagtgggtggccatgccctcgcacacaggcagctgtagacaggacactctgctttcctattcactgtgccctcatcctccaataacccattaaaacaaagcaggaactccctctgaaatataagaggaaacacttctgcctctctcatcacctctcactgctccctgcaacccccagcccatgtgaggctagtgatggagatggaaggctggcaggtgcatgtccaacatcctctggtccatggttgtctactgggcagcacaaatgggaaaagtgtttaatattttgcacatgtaaggcatctctttctctcttggcttatgggctctctgcttggcagatgtgacagagactgttctccttgtagctgattggctaagtacctggactttaggctgactcttccctatgggtccctaggccaaatctgaggggaagtagaaggagaagaaagcctagtgcagccccaggtccaagccaaattctcatctccaacacaccatcagtaaaaaagctgaggccacgtgccacaactcatgcctataatcccagaactctgggaggccaaagcaggaggatggcttgagtgcaggagtttgaggccagcctgggcaacatagtaagacctcatctctacaaaaaaaaaaaattaaaaaaattaaccaggtctagtggtgtacatggtggtacgtgtggtggtgcatgcctgtggtcccaactactcaggaggctgaggtgggaggattgcttgagcctgggagatggaggctgcagtgagctatgatcgcaccctacactccagcctggacaagagagtctcaaaaaaaactcaaaaaaccaccgtatcaaaaaaaagctgataggttggtccttgagttctgtgtctatttctttcttggcttagaaactgaatgagagagtgacaggattgtcaccttcagtacacagaagaacaggtgaaatagatacccatggaaactccccatagccatccacaagtaagcatgtgcaagcaggcctgctcctgcctgggcacattaatacacacacacacacacacacacacacacacacacacacagacacacaagacacacagacacacatggaatcctgggtcctgtcccagttcatgagtatgtcccctccacatgtgcacacatgcacacatacacacacacacacgtatgtacatatgcatggatcttaatcccattccagttcattcccaggcagacagacctgaatgagctcagcagctggcttcctccttttctcaaagtgcttctgacggtgttgctcctgcaccttgagggccagcccggaccccaggatgccctggagggagaggcaggcaggcagtcagcccccagctagactgtcccagcattcccgctccattgccagggtaatggggactgtagggctcaattgcacttcaagtccttgcagtgacaacactgtacaaagaagggaagggggaaagagcccttccttctcttgaagagagtagggagcttggttaagtgaaatgagccttgaagtcaggaagacctgggttccaattctgacactgccactttccaggtgtgagggcctgggcaagccccttagccctgttgcatattggttttttctatagggatgtgggataataatacctaatgcatgattagaaaaaagtgagataacctttataaactgccagtaaggggtactgcacaaaatagatgcccagtaatgttaactgagttttaaaaatattttagctgcttgaactgtcacgtgatactttgactatagccggaacttcccagaattgggatctgttttgattttcaggtcagacttgccagtggattaagtggccagaaacacacactttccaagctgaaagagaacttgaagatcttgcaacattcctatggccctgactcatcaatgagaaaactgagatttaagaaggtcatttgctcaaggtcaaatagcttaggaaaaaaaccgacaaggtagggctgcaaatagagaaagaacatcaccaatgaaagaatggaagaggaagtgggtggcagggagattgttacttaaaagtttttttcaagcttcatgattaagagccaggttttagaaccagtggacttgggattcctggctctacaacacagtagccttgtggctgtagaaaatttactaacccaattaagtctcgggtttcacatttgaaaaattgagataaaaacagcacccgacccataatgttgccatgaagattaaatgagatgatgtgggtaaagcatttggcatgattcaggcacacagtgagttcaacaaatgcaatctgctttcattattattacgtacctggacactgggcgttggggaagttactctatcataggtcaaggcttattcttgagagacatgtattttttacataagccagtaagtaacaggacaagagaagggaactcacataaatgaaggacctgctccgtgcaaggcactgggaatgcatgaatgaaaaatataatcccagaacccaaggaattcacagtcctctggggaaggcagatctagaaatgtgtaatcctagcatagggccagaaactcctttacagaattattcccagagttatgcccagagcgactagctcagcctaaagaaggcagcattgaaagaggagttgatgtgtgaagaaatctttggcaaaggaaagcagcagggcctgtggcaaaaaggcaggatcatcatgcttaagggaatggctagggagttggtagggtataagaggatagaagatgacactggaaagttgagctggcaccaggcggtaaggggtcctgcacgtcacattggggatgtcatatatcaaaggtacttaccgctggaagggcaaaaaaggagacgccaattaaggaaaaggtggcggcaatcagacggccttcccacgttttgggtgtcttgtctccatagccaatggtggccagtgtgatctgaagagagaagagttcagacatggagtaccacatggagaggaatatcaggaacgtgttaactgagctctacctgtaagcctctccatcagcttgggcaatgctcccattcataacaaggttcccttaggagaaaagacaccaagtacctactaacttatatggatgccttgagacttgttgataagttaagggtttcctaccttagtcagtcaacaaatatttcagcaattgcaaatgtgtatgtacacgagcattcatgtgtgtgtatatttgtgaatttgtgattttatttatagccatgtttgtgaatatatgtgtgcttgtgagtatatttgtatgtattgtgtatatatgtgtgtatgtctaatgtctgtgcatgtatctgttctggtgtgtttagtatattcttgtgtgtgtttacatgtttatgttatcagtatacatgtacttatgcatgtgtatctgcatgtgaaaggcaggattatcagagcagttgacagtgtggcctccggagcctaactatctgacttcaaatcccaggttagccacttactggctgaaagaccttgaagttacttaacttcttcatgcttcagtttccctacttttaaaaagagctaatgatagaagttgtttgagtttaaagtaggttagtgaaagtaaagcacccagagagatgctctggagcaaagaaagccttcagtgaatgccagctttagtactgtgtgtccttgtgggtgtagggttgtgcacacacaggtctgtgtgagcacacatgtgtatctgtcactgggtttgtttgcacatgcatggcttggctgaaaatagcctatgactaataaggctaagtccataaacgaccatgcaaccaggctgttccaagccctggcttcttataaacgctagagaaaagtcaattccaagtgcccaccttgaaggagggtcttctgtcagcaggttctgagctgaaattggtctagagcttacctctgactgcagaatgcagctgcctggctgaacatgctcatgtgatgccctccacctctctctgactcttgacagtcaatctcacagaattggcctccaaggtagtgactcaccaggccccaccacagggcatctgcataggtctcaaactcctctttcatctcctctccttgtgcatccacctctgggacgtctttctcaaccaggtagacaagaaatgaagaaaggatgagtgtcaggaaaccgatgtaccaggccgtgatgagttcctgaaagaatgaacagtggacatgaaaagtggtcactggggagtcgttgagtggatgctggagccagacacaccagagttagagtccaagtttaccagctctgtgactgtggtcaaatcactcaccttctctgatcttcatcttccatcactgtaaaatgggatcattaacatggtagttatttcatcattaattaacagaaaaagtgtatggctccaggaggagaggaagatttctagcttagggccacttcaatatcacagctcaagaggcttcagaggaaggcaagaaggcaggaggaagtggctccttcttctaatacaaggctcaggactcaggagacttgggtctatgcaggactgcgtagagcaaggagaaagctcggtacaaccaggaaagcagggtctctgtccagagacccagccctgacaccagtttatggtgtggccttgggcaaattctcctcttctcccaaatctcagtatcttcatttgttaaatgaagggacagagccacagagttcctgaaatcgttttgtgtaccactggtgaaatgcagctttacattaaatattgatttagagcctatgcaaaagaaggtatcaagcctgtaatttcatggatattatcatataatagactaggacatatgactaagtaaacaagagtaaggtgatttaatgaaaagtgttaagtaatagtcaggatggtatggatggaaacttcactgaagtttcaaaacccctaatggagacaagacctaatgctccttccagctccaactttctctctttctctcattctattccagtttcaagatttatcatagtaggttgggcaggaagaaaggcaaggttattggtgaacacaatctggagatttaagactgtctgtcattcttgctgagtcatctcagagaacaaagttgttcacattgatatccttcctgtatctgaccatctgcggccagtcagctggcccttctgggccaatagaatcttcctgacagggttgcttcctgcctccctgcaggacttggctcacatgggtcctgcagtctgaatagccctcccacactgggaccaaccaaagagcatggagtcatcttcagactcatgtcacctccactatgaaatttttctagatgtttgctcccccaatgaaagatagagttcagctgtggttcctttattccctccccattttctaaacatacttctccaagcctccaacattttattatgctcatttgctattatgctctggccttgcccacagcatcacatacacattgtacgggtgtgagtttggtctatagcagaggggttcacttagataatacaggcgacccagccagccattctctttggtgagcgaggttctgtgctgcagggaatttgaggacggaaacgtacatggactagtccttacccagtgattgcctgggcataagcctctcgcctatggagtgtggtcctagtgcttatatgttttttcatactctctggcccccaaatgcaagtcagaagtttcatctggcacttaaccaaatcaacagttgtctgtttctgtgtgcacataaaaactgactgttctggattaataagagatggtataacagtcaccattaaggagtgaaaatgggtcctaattctgtactttggagtcatttactttgcagttattccaaataattctgactttatacaatttttgctagcagctctgtggcagaacctgtgactgttccccaacaggtagctcctctacctgctgaggctcccctgcagtcaagttgaggctaagggactggggtccagccaatatggaaaagtgatgggagtgaatccctccttgtcccttaaatccattctgcaggattctccaggttcctttcccctgccttggtgactcaagtcctcataattcaagacgaaaggggcccacccagcacacatcggatacactgtaagccagaagacgtctaggtttttgtgctgggtggtgggagctctagggctcatttattttgggaggagaacctgacctatcctaactagtgaaagcattaactttgaaagtttaaccctgtgcaacagagcctcccacacttgatctttgagtgcccagaagagttagccatagtacccggcccagagtacaatgaataaatgaatgaagaaatgaattgataaatgtccatttgccagtactcttggtgatttccttggggaagagcttcctcccagctctggtagcacagctttcgggaggactcacaacatgtactttggagtctaacaacagcctgtaaatctaagtctatgtgcagagagctctgctccagagcccattcccacccctgggaaacagtctctgcctcactggcgtctggctgttgtgcaaatccatatatactgaggaattatatcacaaacttccaatggtctctggtaattacatggcaaaagccagcaggcactggggatctattatagtctagaggaacacaggacaagggcctaaaccagcaatttttagcaccagtgttgaccagaactgtgaatcaactcagctccatggatacaggttatggctgaacccataggggttttattaacgtgtcctttgataaaagataaaatagaaggtcaggagaaagaaaggggcctgtaaagcatgctctgacctcactgattctgcagccagaagtagcacagacaaaaaataaaacacagatggcaagaaattgcattctaagctgaaagattcccaggtattttatgctttcattccactttatgtctatgcttatgtgtatggtatgtgaggaacagcatattcagaataaaaaacactactattaatgagcacctatgacttaccaggcacttaaatgcacattttctcgcatgagcacccaggaggattcacatttttaccattgaggaggctcattaaaatagaatgacatctttaaggccttctggctggaaggtggcagagctgaattttgagccaagttgctgtctgactctcaagctcatattctactccgagatgcaatctcataggaaaccactaccccttcaacgtatctaggtgcatccttgagatagagaaccaggggttgtgaaggtatgttctggagctgtccagctacaggtggcatggtcacgttaacatgcataaggaaaactctaagctccttaatgtcaaattgcccagggctcactgcctcaggtccagctctccagaaacagaacccaagaaagggatttcagtgtatgtgacacatttccatgtaattattgaggaaatggtcatagggttcctattaaaagagacctaggtgggacaacaacagcatctagtatgcctaccagggtgggtgcaaaaagatactctcttgggaagcaaggcaagcttggctttgtacccccaaagaacatccatcccagggatttctcctgatttctcctctcgggattttttttctgcctgagctgagacacaggggttttccttcattcctccagaatccagctaaagcagctagattaaaacaaagtgctaccaaagacctgggttaggaataggaaggaaacacaagcagtaccatgaatctaaatgaactggattctggctgcttgggttccatacctgctcagccacgtgggactctggaaaaggaatggactgagttccatccctcctggattctgatctacctgggggaggtgagcaccaccaccccagcaaaccagcagcaaaccactggacacaaaccctagaactggaatgccagggtttatatcccactgcgtgaccttgagcgggtacttcctctttctgtgttttctttcttgtcagtgtaatggagtggcaatagtgcctgattcatgggatgagctagtccttgtcaagcactaagttgtaggcactgtgctttgggctttacataataattgcaactgaacaatctccatgagcttggtaccttctaagtgctcttcacatatcaattcatttcatcttcatctaaccctatgaagtcaatgcattattattctaattttataaatgcagaaaccaagacgcaaaaaattcccaacgtcacagaggcagagttcagattcaaaccaacctgtgtgatccccaagccttcttctcccactgcatgtggccttgaatgagctcattccatcctctcaaaaatctgaaggaataggcattatcattcctattttaaaagtgagaaaactgagggccaaagagggctgagcaacttggccaaagtcatttgcatatggtggagccaatacctaacctcagtttcacctgttcctgctccctgaaccacacctgctcctgcccctaccccagccccgccacttcctgtttctcctcctcctcttcctctttgtcgttatcatcaagggtggcagaatgactgccttctggggacactgcaaaggaagggatgtcatggaagggcataggtgggtgggaagcccatgtggtcctgcagtttctccaccacacttactttgctgtgggcacagatggctgagcccagaagcttccaggtgccacctctccggtccatccgcagcatgcgcaggatctgcaggaagcgcaggcttcgcagggaggtggccagaacattgccttggtttcccacagcaaccactggcacagaggcaatcagcacaaagatgtctgggagagaggacagacagagtgggagggaagagggaaaggaaggtcatgcgaaagcaatggcgtcatcataggtgctgtttgctggcagatcagcatgtgccaagcagtgggacaatctgagcactgctgttgaatcttgccaccaacaacacatggtaagtgggattattctcccatgactgatgaggaaactgaagctctgagcctgagtgactttccaaggccacctggccagaagtagcataggcctaccacactttaatgctggctccagagcagcaatttaccaaggccccccgcagtgtggtccttgagattcactctggggcccagaggacagctgcagctgctcagcctatggaggtaaagcctgacactcagacactgtttccatatgtgtttctcctaaaagcatcacctgaggtaggaacttgggttcaagtaatttattggaagatgatgttaggaagcagaagtgacggcagaaggagagagagaatgttaaaaaaaaaaaaaaaccaatgttgggggtgttatcaaggccactgttgagtcctttgagctgtggacagacttcccaagattatccatctgaaaaatgggaagctgggacatctgtttcttgcctcctgctggttgaaggtcatccctagcactgtcaacgcccccacacatctgagctacactggcctagtgatctccctaagcttgagagaaggccttggggtagattttggaaagatgtaaggcccacccatgacatgggatgctggtatcaggagatggcatgagaatgtccactacagacatttcagagatggaaaaaggggatgagacacttctgagatggttaagcaggctcttgacatcaaatcctctagtatggaagagggaggaactgatctgttttctatttccttgtagtcaattcccatgtcaattatcaccccactttcctgcagagttaccaagtaaaaaagaccatatggccaagtaaatttggggaaaaactccattaaatgggttttacaaaattattagtgttatttatttttagtgtcactaatttttttattgaaacataataattgtacatattcatggggtttgcagggcttctcagagtctttaatctgcagatatacactgtggttctcaactatacaagtgaagtatagtctttcccaaaatattttgaccacggaactattttttgcaagggctccaacagttccaaggaacacacttaaggaaatatttgtccactgggaaaagtccaagctctgcaaagccctctgtgttctggctcctgggaatctgccagaagcctgtgtagctcattgagcacacatctccatatctttgtgtgttctggtctctcagcttggaataacctcctcaactcatatcaaggcacatttgccaaaaaagctgatgccggccaggcacagtgtctcatgcctgtaatcccagcactttgggaggccgaggcgggcagatcacgaggtcaggagatcgagaccatcctggataacatgtctctactaaaaatacaaaaaaaaattagctgggcacggtggtgggtgcctgtggtctcagctacttgggaggctgaggcaggagaatggcgtgaacccaggaggtggagcttgcagtgagccgagatcgtgccactgcactccagcctgggcgacaagagcgagactccgtctcaaaaaaaaaaaaaccataaaaaacaaaaaaaaaacaccaaaaagctgatgcctttcctaccttattaaagtgtcctccaggtgtacctagcctttggaaaaacctgggggtcaaacctctggatactgatacatctgcatcatttgccaggcttctcagattatctgtgcaaacctatctatctgtaatgcttgcagagaaaacaaaagaacaccaagatgtgtagtaaacactatggtctaagacgctccatgaggcagttctgacccatcttcactcaaaatggcagggtccgaggctgccttgaatatgaaagccatcatgttcatgggcgtgataaccatcctctttcccatagggccacattgtggaagaattggatatgagtacaatggaaaacatggcaacactaagtaaggaccgtgtgatgctgaggcccagcctcatctccccagggagggtggagggggacctggagctctgtgaccgcagctgattttaaaatagtggatacttccccaagggggatgcacctgtccagcagggatctgggctcccactgtcgggatgttctcaaactgagaaggagtctctttgaatgtgggcacaatccatcataaagctaccacccacacactcagaacttctggtcagccttggataggtcatgcaaagaagaaaaataagtctgcttaattgtgctgcacttgcaaaaaacttggagggaagaaaaatagagaggaaagaaagaaaagcggggattagatactgaaagagggcaaacgaagagagaagaaagaaatatgaaaaaatcattaaaaaagtcctccaatatcgcacacacacacacacacacacacacacacactcacataccttccgtacattcaaaattctgagaaaaaccccaaacctcagaagtccaaccttagcatcaggtgggaatagggcagagatttcagctaggagtgggcaagacaatgcaactccaggctgcacagacagaagcctggcacctgggacaaaggacatggtccagctcttctctgagctggctgtccatccccgaaggactgtgttcagtcctgggaatgacttttcaaaagtaaagtgaagaatgagtagcatgctcagaggagagggagtatgatgctgagaatgcgtgatgtaaggtaagttgaagccactgatgacgttgtttcttggtaaaagaagactcttctggagtagagagggggaataacatgtctagactcaaatacttgaagagtgtcagaggagttaaaatgagataaatgcctggatgagtggtgagcaccttgtgactaggggcatgcaagcagagccaggtgaccacttaatggctgctgctggggactggagcatcagacacgatggcaagctggactaaatgcctttggaggtccttccagccctgacactctatgatcctgtaattccaaccttcccatggatttgaagctccaagactcctacctgtcactcaaggagattttgtcctgcaactccatggattttagtccacactggaccaataggttggtgagagtttccacctcctctactatcaaactgcctgcacacaaatggaaggattccagtgacacctctcaaggcaaccattggattaagaagcaagaccacacctgggtgttaggacagaatccactgtttcctgcatgactgaaaaatgactcagatctgtgatcctctgtttctatttctgtacaatggacataacatgatgctgtagaagtagattctcagccagcaacggtgtcacgcctacagcttctgtcccaacccgtctggaaatgtatgggtaactttgattgtcacagtgactgggggtgctactactccagggactggggatgctcaatatcctgcaacctgcttgctgctccacaacccaattgccaagagtgacaccctaccctgccaaataagaatccctgtcctgtgcagtccttataaggaccagtcacagaaggaggaatttgaggacccagaaggttgacactgtcccttctcatcgaggcagcgtcaggggctgagctggcctccacagtgccgcgtgatttcccagaatagctgcttaaacttttctcagagaaacaatgccccaaaagaagggaactgaggaggctgggaggctcagggtcaggacttacccaacatgcacaggggcttcctggcaaacttcagtcggccccgccagcctttgtatcggcagcaacatccagcagcccagatcctcaaagcaaactcggctccaaagatgaaaatagcaaatgtctcctgcatggaagagcatatggagaggcactgattaaccgagatccacttgtcgggagctggtgatttctattcggaagttctgaagaactccattttgtgctgttgctggttgtctggttggcagggatggctggggatgggggtggggaaggggaaccgggagaacaggtccatcaccgccattcagtttggaggcctcccatcttcattctgatgtgctaattgtccttaatgctgttaaacctggcacagtgattactcgttcttttttctatgtttttgttccaataggtcagctttaaaagtccctttaatgaatgaaaagcccccaagaagtgcagttgggttgaaaagagagatatgagtgaaacacaatctgttaattccacccagtgcctgtaccctggcattgctaattgtggctaatggttattaagcctggctcctgggccaggcagccctgaaagtgtttgataatattattctcatcttacattttgagaaaccaaggcacagagtagttaaacaagtttttcaaggcaatgaagtggagaagaagggatctcaggctcaagtaactaggctgcagagcccaggagcttaagcactctccaggacacagggtccccctttcctcctgcaactcccttgatgatcagacaccaacacctctgcctctctctcttttgtgacctccctgggtgccctgaggcattgctgctccacgacaatccctggagcctagttcctggagttggatggtttccagggagttccacactgaggtctgagctctgggacgtgctgttgcaaacccctgctctcagaaggaagagctgactctggtgcctcgatggcttgcccagtgtgagaagaaggctccactattttaaaagccctaactagggggccacaccactgccctgtgtgcaggatggggcctcaccccatgcagtcggcattgccctgaagaggcaggactgactcctaatcacggcaagggtgtggtcattcaaggggccagttgaccagtgctgtcctgtggctacagaaggagcaagcccttgttagagcctcctctcaaccaggcactgagactgggcccagcccatgtctgcatttgctgctcatctgaccttacattttttaggcaaggacttgagcaaacagagtcaggggtaccttagctgacttgcccaagaattctaatcctgctctgtttccatcacaccacctgatggaggacagagagtgaaaacaaatgcaggccccaggaggggagatttagaggtttcgtgtataaatggaattctgtacctggccttggagagaatgagagatccttggagtttagattgtaggataccaggaagaaaaagcagagacaggttttagaatgaaacatgcctttgtgttacctttcagaggattgggaagctgtattttataatttaataacatgcattggtttttgctttgactttatttccccttctctctaatgtggaatagcaaagctttaccaggaatgccattcttcaccccacatgtgcccatggcgggccataccaagtaatggaggctttgcttttccttgggcctggacttgactggagactacaagaagctgcaaccagtcagggaggagtgcacccaagggcaacctccttttcatcactctggaagcccaaccagaagcatttaccccagaatgcaatcttaccagtaacagaagccagtctcccgagacagtctcatactccttgaatgtggtcaggacagccagaatcaagcaccccaggacaatcaggaacctagaggggaagaaagaaatggactaaggaacctttgagtcatggcttgctttgaggctaagatggggaaaggtgtcttccaggatgaagctgcaacttctgctggacattgacatgtgctttatatgctatcccattcaatcttcacgacaaacctgcaaggcaggcggaaacaatcatcccagttaaataaaacaatgtgagagaagttgaccaatgtgcatacttttacttaaccagctaattagtagaatcagctagttagaatttaaactagatcatctggttccaacctcgaggacattgctgaaagtccaaaagtcaagacaacttttcacaagtcattaagtatatgaattaattaataatgtgttctacacacataggactgatttaaaaatatatgaaaatgttttcttagaatgaagaaaacacaaatttattccaaagattgaaaaattcagcaaaggcttctgtgaccaagtatgaatattgtcaccaagtatgaatattgttcatttttacagtcaatggaacctctttcaattggggatctttggaattgtttttgaaatgctagaaagaagaggaactaccacactgaagcatgcagaatgctggtcctttaaaattcacagagaggtcacctggttcatgaccaggctcaggcaggagtgaactacaaacaattttttaagattgttatctttataaactgtgaggtgcgtgtgtgtgtgtgtgtgtgtgtgtgtgagagagagagagagagagagacagagagagagagagagagagagagagagagagagtgagagacagtccctgtttcattgttttaccaaggaaaatggttctccctcttggtggagagtctttggcttagttgtcagtaccaggttccctgggtgtccaaaagggaatttataagctagggtttatgggtgaagcttggtagtacatactctaagctctcctactccaggtactctggttttctactctacttaggttctacccatgcttttttggcttttgttcattcattcattcaatatttaaatggcagacgttgcgcatacagagctggaattcaatgatgaataggctggatctgtcctcacgagctcacagtccagataaacagaaagttgtctcatggtgtgaccataaggaccatgatgtaaggcggatggaaatgtctccttctgaccttggctgggaccaagtactgcctctgacccttagtgatcctgatcatattttctgatctataaacctgctgatcttcagacctgaatctttgtgtctccaatcatgcccaggaacctaaacaagatccccaactccttcctgtgtttggacattttatgtgaaattcgactttaacccatgtttgatatctgcctcccctaagccccatatcttctcagttgacgatgatgatggtggtggtggtggtgatgatgatggttgtgatgatagtggtggtggtggtggtgattatgatggttgtgatgatagtggtggtggtggtggtgatggtggtgatagtgatgatggtggtggtggtggtagtgatgatggtggtagtgatagtgatggtggtggcggtggtggtgatagtgatggtggtggtggtggtggtggtgattgtggtggtggtggtggtagtgatggtggtggtggtggtgatagtgatggtggcggtggtggtggtggtgatggtggtggtggtgttggtggtgatagtgatggtggtggtggtggtggttgtgatgatggtaacaacatcagtaactgttactacaacctccaaagttagatatgaccattcccattttagagatgaagacattcatcaaaaagaatcactaccatcaggataactatgttgtcagtaaaatgaccagaaagcttggagtctaagcttaaaaggaagctctggtgctttttatgtgattttgagcagctcattgacttggcagatcccggtcatctcatctggggaatgaggataatgaatctgcctagagctcaccatgattctgaagacttcaggaaataattgataaaggatattgttgagtcaattgttgaggatcatggtgctctcatacaaacatgctcatcattggccagtcaagcccttggcaacatgcagggaacttaatcactctcagaagattctgcaagtccacattatgattctctcaagactttattttattcattcataggctctgtagagaagaccttgcttagaatcattttctttctcttatgacctgcgtgttcttagacaaaatacaaaacatttctgcatcatggtttccttctgtgtaaaatgaatccaattaaatgtccatatcctccattattcagtgatgtaatccatgtcaggtgcgtggaaaagccagccttcagtaagagttaactatcattttattgcaatttaatatcaatttatttggtgcctcttttgtcccagacatagtactggttttaaggatacaaacatgaataaaacctattcctcattatgcaaggactccttagttcaatgtggaaaacaggacaaataattactggagagtgtggttgaggttatgacccacgtgttcacatgctttgggagcatccaggaggggctgcagccaagaggttggaaggaaattcaaagctatgctacagttgaccatatgtccaagtttatccaggacattccccattttacatgttgacctggagtctggacccctaggcctcatgaacaacatgtacacgtgcaggaggtgcaaaagttcatggacaaagaaccaggtttgatttttcttaacaagggatgtgggccttttatgatctagccttgccctcctcacagccttgtcatctcccgctgcttccccacatccaggctggtcgtaggaatgacagaacttcctcaaattctctgagcccatgtgccttctgtcttgatggtcctcttccctgtccacttttgccatgtccccatcattaacctgctaatgtcttggcagtgccagtcatgccttgcctccagagccttccctgaccccagctgctctctgcaggctcccttgtgtgatctcatccctgggatcccagagcaccctgattcacttctactccagcatggacaacaacccgttatcatcttgtaattgtttgcgcacatcatgtgctaaataaaacatactgtcccaacacctgacaataggactcccttaagggaaggaactgcctttgcctggagaatactttattgatccgattgaggtagaagttgcaacccttaaaacatgagactgctaaactacttagcaataaaaattaaccaaaaatggctgggcacagtggctcatgcctgtaatcccagcactttgggaggctgaagcaggtggatcgcctgaggtcgggagttcgagtccagcctgaccaacgtggagaaactccatctctactaaaaatacaaaattagccaggcatggtggtgcatgcctgtaatcccagctactcgagaggctgaggcaggagaatcacttgaacccgggaggcggaggttgcggtgagccgagatcatgccactgcactccaacctgggcaacaagagcaaaaactccatctcaaaaaaaaaaagttatccaaaaattagagatggggattggtgttgagggctaaaaatgaccaaaaaaaaaaaaaaaaaaaagagagagagagagagaagaggatatggtctagccatatgctgaaggatttttaagaacaagattgtttaaaatcttaagttcttggtccaacaatgcaagccatcaaccacagcctcataagtgactttgtttttagttggcatcgatcctggcgctggaacccatggctggatcagtgcatgggaaaaggagacaggttggtgtcccacagctgaactaatttggcaggaaaaggagtccttagctggactctgagactttacacagctccctgtacctcggatatgtatatatgaaagattcaagttgtgtgtatggtgggcatgccctaaggtaatctccaatgagtcaggcagttgcataattgtcttttctgagtgcaagcagaacctgtgacttgcttctaacaatagaatatgcccaaagagataagatgtcactactctgtgtatttttttttttaatatggcaaaggcaactggatagtcatgcctgtgattgttacattatataagactctgccattgcattctggagctagagattctcctgctggtcttgatgtgagctgctgttttgaaaggcctgtgagagctatgtggcaaggaactgtgggattcttggacttgactgcagccactggctgattaccagcatgagagtgggacctgttctggaactgcaagggtcaacaatcatgggatattggggagtcctcccacaagatccagagaagaacaagtcccagccaactccatgactgctgcttcgtgagatgctcagcagaggacccagttaagccatgttcatactcttcatgaaaactgagattaaaaaattgtatgttgtaagccactaagttagaggcaatttgttatgcagcaatagaaaactaataccatgtggaatgggaatctgcaccaaatgcatctcacttttatacagcaggataatccaagggaggtctgggctgcatgtgtgcatttgctctattagactctgctcatggagggcagagactatgtcttgttcctctctgtatctcagtgaatagctcaaacctggcacttaataagaaccaatgtatgtttagagaatgaatacaaacaatttcagcgattagcaatggccttgttgaaattaaaggcaagggatataaggtgaacttggagagacaggctgggagcacgacatgaaagatattgtagatcaaatgaagactttgagctttattctgcagaagattttttttaaagatacatggtctcattctgtcacccaggtgggaaggcagtggcgtgatcatagctcattgtaacctccaactcctgggctcaagtgatcctcccatctgtagtagctgggactacaggtcccaagtagctggaactacaggtgtgcaccaccactcatggttaattttgtttttatagagatggggtctcgttatgttgcccaggctggtcttgaacgcctagactcaaaagatcctccttctttaacctctcaaagtatggagatcagagacatgagcttctgtgcccagcctagaagatctatctgcctatctacctatctatccacacacatacatatatatgtatctctctctctatatatatatataatatatggatggatatatatatagatagatggatatatatctagaaagatggatatgtgtgtgtatgtgtgtgtatgtatatataatatatataattaatatatataatatatataaatctccatatctctgtctctatctctatctgtaatctctatccaaagacaggtctctgccaggacagcagtcaagacgacgttatcatgagctgaccagagaggaggagggtgcgctggagagatgacaagggtcccatgagagagcatcctcctgtgtagtcctggcaggagttgtgactaatgggatataaagatcgagcaagaggagcactgggaggggtcttggggtgggaagaaagtggataatgtgctgttcgcagacatcaagaagctgtgcagtgcggccagcaggaccgcgaagataagaagctacttgcggacctgctgcacttgaggtccaagtggaaatctccatccggctgattgaaatctaaatttaaggcttaggggaaaggtcagggctgaatatctaactctctttcagctctcgttgtctgcttttagagccaggagaagggataatttcgccttcgccaaccaccaaaatgcagtttcagccgattcccatccgcagggagcctgcggagcccatctttggccaggagggggcagcagaggcccggcgtagccccgcgcttctcacgcctcaccagcaaccgcaggaacccactttctaagacaggagaacaatcattaatttatacagctaaaataaatacggaaaccctccttaacctgagaagaggaaacgccccttagtttcttgcatatttcaatttacccttaacatatgaacttaatttcagacggagaccacgttatcagtcccactgatggacaaggatgtggcgctgaacgtggggctagagattctcctgggggtcttgacgtgagagccgcccccagctgctttcttcctggttttctgcttctcttcctgctttggtttcctctctctacattctcaccaattattcctgttcttccttttcgtctgtcctttgtcacttcagtttccttccctatagtctggtgtttcttgtgtttgtttgtttgttgtttttttattttcaagacggaatctcgctctgtcacccaggctggagtgcagtgacgcaatctccgctcactgcaacctctgccttccgggttcaagcgattcttctgcctcagtctcccaaagagctgggattacaggcatgcagcactatgcctggttaatttttgggatttttaaaacgagatttcaccattttggtcaggctggtctcgaactcctgaccacaggtgatccacctgactcggccttggaaagtgctgggattacaggtgtgagccacagtgcccggtctttctctatagtcttgactgtttcctttcctctgctcttctcttactgccctggcgttcctgagttcttttcctctccttctcctgcatcctttcctccactgctcctctcctctcttgttcctccttcctctgcgccttgcccaccacttctccctcccttctacaccctgcaggagtaagcaagggtttgcggccaggagtcttggggagagccaatagcagccttctgtctgcagcatccaggctgtctttgcaaacaattccagtcaaggtcaacagtcacgaatatgcccttaaatcagtctccatcacctccatgcttccaccttcagtattctttcctcaccttcggccatcttccatccaagcccaggttggggaggacaaaagggaactgacacaaggaagcctgctttgtagctgcacgtggctctaaagcggcagatgcaggggcctcaggacaggaaccagtgcgagctgtccaggcccactggatacctaacctctgtcaggcagcaggcaaggaaggcttttgcagatgcagatgtgagggatgaccacagtggtaccaggaaaaccctgccgcctcttctcacccatgtctggcatccatttatagactccaaagctgagcctgctggaagtaagagttaaggttgccagccaaacatcccctcacaggcttcattcacagtgagacaaacacggtgaaaacattgatgcaggaattttttcgtacatcattttctcttttactcctgagagcaacactgcgaggaaggggactatcattttatttgtatccccattttacagatggggaactcagcctccaagctcaggcaggagggacacaaagggagtgagaagtcagacactgtgctgagagcactggagccttggaagagaatctgcagagaatgaggtgtggtcagagccagagggagagcagggaaggcagcctggcctgctgctctcagttcagctgggagaagtaaatgtcttcccttctcttcctctggagtctgacatttggcagagaaaatctcagtaacattccagatagctcccagatacccctgctggctcctgctctaattacagctgtcaatggacagctttcagagcatctgtagccctcaaaatgtcctagaaggtagcactagactctctttcttagaatccttgtctgtctgccattgaatagcgatgcatagaaacatttttcctagctaggtgaaggcagaattgaattgtctaaaagacaggcattgttacgtcatagttagctgcacttgtcctaacccttggccaccattactgatcttcgatcttaagaaggagacataaccttaaaaggcagtgacagacctcaaactgcgtgaggatcctactgaccctcaattgaaaagcctcagatgttaaagcacccactgtgtgccaggggtttctttattttctatgagtcagccccaaaaaggatgtttgagtcatctcctaatgagaactgttccatccactaagaacagggttgacaaatcattttttatcttgaaaacccactaggatggattggttaaggctgccaggaatgcgttattgaaaagaatccagattgcagccaagttaactggggggaaatgccattattgattcgtgatgtctgtcacaggtgcaggaaaagaccaaccatttgccattcccttggaacccagacatgagaacataagtcagagctaaaatcgtttttctaaatcttcctcttcctgatttgactcatgccaagctctttcaaaaatttgattagctggaaatttcaggaaaccttaagaaggacctattattctttcatctaacagaaaggaaatttgtacatcagagttcggagtgatttgcttatggctacaaaataactccctgcagagctagaaagaggattttggtctctcaactcccagcctgctacatcctccactgtgccactttctactttatctctggtaaatcaaagagtgaatctttatggacatttgtgctattcttttacctgattacaacccgtccacttctgccaaaccccaccaacatcagggcaaaaggctaaataccatacaccagggtcattcagggaattaaaacaaaactgatgtgttcatcttctcttttgagagttgaccactgtttttcttcatttaacatttatactttttctctctccaaatatgccgtgtgcttatttacctatgaggtgttaggcactataaaccatgttggcaaatgtcagacttttataaaacacataaaaaagtacaaggaataatttcgaagtcattcaaaatgattccatctcttaatactatcttaatacaaaactcacaactatttaatagaagagcacgggaggcaaataaacaccctgtgttgtgaggctgcgtttcagggtcagcaacttgacgcagctgagccaggcaatggcagatatcctcatgtccccttagggggccttcagtgctactcagccctctgagctggaaagaggcagcaagagctgtcagtgaggagaagaaagcacaggagagggtactggaagagtgtgcccttcaccatgtagtcatcggtacatgccttccagtaccatttttctaagcaaggatactgattatgccaaacccctgtctaaatacagctatgggctcctcatatccattacagggtaaagttccaactctttagaaaggtaaaccaggttccccccaaatcagatcatgtcatgaaagaaaggataaataacatgattcaactatatgctgtctacgagagacttactgtagatccaaagatacaaataggttgacagtgaaaagatagaaaatgctattcctcgcaaacaggagccaaactagagctagggtggctatagtaatattagactttaaaatggacttcaagacaaaaattgttacaagacccaaaagagtacattatctattgatgaaagggtcaatccattaagaagacattataattataaacatgtgcatacctaatatgcacctaatagatctccagatacctaatagatctccaaaatatattagttttctttcctaggcttacttcttcattctttctccctccagtcacatcaaacttacaatttcatcaaaatgtggcaggcctttcaaaattccgttcttctccatcatatgctttctctccctcatccaaatgactcctcctttctactctttaaggctcagctcaaatgtcacctcctctattaattcatttattcaataaaatatttacttatcattcattatatgccaagagttaggaacagacattccattgtcccctaggagctaattgttcatcctctcttgttcaccagtcaacattagaaaaatccttttgtgcattcccataggatttcttcttatctcctcatagaatccacccattccttgacatgcacttaccattctataccctgggcattcaatgatgaacagagcacatcactttgtgcttgcaccccgtgccactgtgttctcttgtaagccaatctggagaagcagagatgctacaattttcctcttgggatcacagtgaccaacccaaaggattggctgaagaaactacacatctcagatctatttccagttctgccatttactcactgtaggagcttggagaagttctttcctctcctcagatttcagtgcctacatctgtgaaatgaaggaattaaagcagatggtccccaaggcctgtcagggctattatcatgggttcagactttcagccaataaccctggtgggagggtctggaaaggctttcaaagataaatagacttgatttcagacctcagctttgccacttagcacctaagggattgtttcctcatctgtaaatagggatgaaaatagctcctaattcagggatgttgtgaaaataaatgctcacagactacacagtactgatatgtcttaactattgcaagagtgaattttagcttagatgggtgaggccaatgactgtgttccaccatgtctcatggattttttttttttttttgccattttatgagacctgggattcctttatttagaatgagcaaatcaactaaaaatttgtagaacccctagcaagatgatatctcagttccctcacacactgtcccttgccccattgattccagtctgagtaaccatctgtctgtttctgaagacctcctttttgtcagtattcccagattcatccaacctgctctacgcatgccatatttgggtgggtgatggttgtggtggaggcttctgcctaggatagagttctcagccttcaccaggccaagcagctctgttccatgcctatgtcctcctccacactaacactgtcatcagctaaaatatacaacagccccattaacactgcctccaacaccttcgctctatccctgttctcgtttgacacttgcatataaaagcaatgctagtgaagctctggcaagtcacattcctttctccctgcaggctagagacaagccattagctaggaacttccaggtccacatgatcctctggccacactaagtgggcaggcacagtgggaatctgagtcaagcaagaagagagaaacagtccatctccagatgttttctctttcttctccaggacaaaccatgtctctgatatatcctggatgctaaggtcaatctggtgacatttaatttttcatttgtggcgtgtattctatgtatcaggcatgctacggactgaagtatttgccttctcttgtggactgaggtctcatcactaacaaagcattttattaaacatccaaaagtttcatgccagggtaataggtactacaaagtgatgtgaggtttcactttaagtatcttcatgttgcaagtacctgccatgtttccctcataaacgggtaccaaaaaggaaaagattaaatatttcagagtccagctgtggcaagtacactctaaaatggctctcagtgatctttgccttctgctcatcacattcttaggtaattccctctgcttaaagttggctgggacctgtgctttgtttccagtcaatagactacagtaaagggtgtcaattctgtgattaggttacaaaaaatttcaacttctgtcttacaagtagactgtctctcttgctggctttgaagttgctgtgctagagaagcccgtgtagtatagaaccaaatgtggcctctggccaacaaccacaaaagaaagcttggaagagaatccttcctcagttgagcctttggatgagcccccagcactggccaacactaactgtagcgtttgtgagggaccctgaacagaagacctaggtaagctatgattggactcctgatccacagaaagtgggagataataaatgtgtgttgtgtttagctaagttttgtggcagtttgttatgcaggaatagataactaatactagttttccaggatctgaatcttagctcaccgcttagcaacgtgatgatatttggcaggtttatttttccaaagttcaatttcctatctataaaacaggagtaacggctgagcacagtggctcatgcctgtaatcccaacactttgggagctgaggcgggtggatcacgaggtcaggagttccagaagaccctggccaacacaatgaaacctcatctctactaaacatacaaaaattagctgggcatggtggcgggtgcctgcaatcccagctacttgggaggctgaggcaggagaatagcttgaacccgggaggtagaggttgcagtgagccgagatcatgccactgcactccagcctgagcaataaaactggacttcatctcaaaaaacaaaaaccaaaaaaacaggagtaacgaattaaggtatctctgttatcttaatattccttatttcagtcttcttagttaagagattgcacaggacagcaaaaacctttataaccaaaggcactaccctaatgaagtctccatgcaaacatccttgacaatatcacagcaacctataccctgggcatgtcatggctttgcaagtcagtctctgcctcaccatcagatacaccattcagtagtacaacatgaaccacttgcaaagcaaaaaggcaaagtttacaaaagatgcaggatttcacaaagttgatagaaatgatgatggaaagctgttttaaatacagcagggtcattgacaggtgacgatcttgcaagaaaaataataaaaaaaaaccaactgatactttaaaggattaaaaacttcaaccaatcctacccctaaatgttgggaaaataaaatgtaaagtcatattgtattatataatttggcattaagagcatatcccccaattaatacctgagtaagtcttgttcattctaaaaattagagcacagttgcaattataacctaactttttgttaagtgtgagatactataaacacatttttgtgttttaatagttttttaaagacaaagtactaatatgatatttttgtcttccctctttggtatgaagtattggttcttgttttcaataggctccccttaagtaggtttttattgattcctattaactgtggaataaaaggtttcttctaaatctacctcgtgggataatcaaatggacttaaagagtatcatttaaagtgtaaatgtgggtgaggtgcggtggctcacgcctgtaatcccagcactttgggaagcctgtgtgagtggatgacctgaggtcaggagttcgacaccagcctggccaacatgttgaaacactgtctctactaaaaatacaaaaattagccaggtgtggtggcaggcatctgtaatctcagctattcgggaggctgaggtaggagaatcacttgaacctgggaagctgaggttggagtgagccgagatcgtgccactgcactccagcctgggtgacagagcaagactcagtctccaaaaaaaaaaaaaaaaagtgtaaatatgtaaaagtgcctaaaaattctagtacatagtgggcacttatcaaatgctagttttttaccttgttccttcttattgtataatcatagaaaataccccaaaattgacttaatacttgtaggaacaaaaataaactgtctttaaaaacttccatattctggaaatggggaaagaaaatcatacctataaataacacagacaaatctatatctatttctagatccatatatatgtttatatctatatcatatccctatccatctataaatccacaaaggtataaaatagaggtaggttttgaccacctaacccaggtgttagcaaactatggcattctgctcatttttgtaaataattttttattatgccactgtatttgtttaattattgtctatggttgcttttgtgatggagcagaagacctgagtagttgcaatagagatggtctggcctataaagcttataatatttactaccttgagcattaagaacaagtttgccaacttctgatgtaaactatgagccaaaggcaatttaattcactcagcaccacctgaggacatgttacgtgtctaatattgtacagaaaaaaaatatttaaaacttaaatatatgggacctaatcttaaaaacacccctgtcgtgttagataatggagcatttaaaatgattagaggaataaaataggggaatatacacgttttatggaggtctctttaaagaaattaatataaattacgaataaaattagcttagggcctgcagtttaagcttctttagtactgtgataaatctgcctctggaaacatctatttaagtttcatgatatgttatcatgcgtttcttcctgactgccttatcttctccttagtggtttttaactaagtcaacggcttgtttgaattcactgttgctgccccaggtgcatgtttacagatagtgtgtcttaatcctttttcggttgctataacagaatatcacagactgagattattttataaacaacagaattttatctaagaagcccatgagtgtggtgtgagcatttggtgagagccttcttgtcatgtcataacatggcagaaggtaccacatagctagagagcaggtgagcaagagagtaagagggggccaaactcacatttataagaaatccactcttgcaataacaaacagacacccctaagataatggcattaacatatttatgaaggcagagccgccctgacctcatcacctcgtaaaggtcccacatttctcaacactgttgcattggggattacatttcccaaacaagaacttctggggacacattcacttcatattgtgccaccctttacttgccaaattcatgtccttttcacatgcaaattacattcattctatcccaatagccctcaaagtctttaactctttccactatcaactcaaaaatccaaagtctggagtctcatttaaatcagacatgggtgagtgagactcacagcacaattcatcctgaggcaaatacctctccagctgtgagtctgtggaatcaaactagttatctgtttccaaaatgcaatggtgggacaggcacaagatacgtactcccattccgaaaagaaaaaataggcaagaagaaaaaaaaataaaggcctcaaagaagtccaaaactcaacagcacagatattaaacattaagataagactccggaataatctttccctccatatgccgcctcctggacacactggagtagaggacagaccctccaggccgtggcccctatgtctttgctgcactcaatccatccagcagctctcccaggttagagcctcatgcctgctagagttgcatgtgggtggtcctatagttctggggtctcaggggctgcctactctcatgacttcactgggcactgccctagcgaggtctctctgtaactctgcacctgtgacaagtctctgcccgggcccccaggctatatgcaatatcctttgaaatctaggtggaggtccccatgcccccacagctcttgcattctttatgtctgcagaattagctccacgtttaagtttcatggtacgttatcatgtatttcttcattaatactgccaaggtccagggcttgcacattctggagcagtgggttgagccacaacttgttgacccaattgggtcatggctggggtggctgaggggtgctgtgctggactttggggagcagagacctaaggcagggaatagcaaatgctgaggcacctctctggaagcctctctggaaaagagaggcacccaggcacctctctggaaatcttgctctcaaagtcctagattttgaagatctgaaatgcctttcagttcattttcccatggttttgatgaatagaactaggcttccttctatctatattaatatctttatcaaactgtggcttgatcacacctttggtattctctcttgaacatgcttttttgttctttacatggccggactgggagcttcctacatctttcaattctacttctcttttaattataaattcctttataatttgactcatttcttttttctctcattttattgcaagaaggccaaaagaagccacgcagcaccttgagtgctttgctgcttagctatttcttctgccagatatcctagttcatggctcttaggttctgccttccctaaagtcctagggcatggacacagtttagccaagttctttgtcactttataacaaggactgcctttactctagttgccaataccttgttcctcattttcacataagacctcatccaaatggcttttaccacttgtattacaatctcggctcactgcaacctctgcctcccgggttcaagcaattctctggatacaggctttttctagcctgctcttccaaattcttgcagcctctgcccattacctagttgcaaagctgcttccacattttcaggtatttgctatagcaacagccccacctctcagttctaattttctgtctttgttttgttttgtcataatagaataccacggactgggcaatttattttaaaaaaaattgtttctcagagttctggaggctgggaagtccaataccaaggtgctggcctcctgtgagggtctttttgctggatcatcccatcccaaggtgagagggagagaaagagagcaagagagggccaaactcacttttataacaaacccgctctcaggagaacaaacccctcctgagataagagcattaatccattcctgagggctctgcctcttgaagtttccacttctcaacactgttgcatcggggagtaagtttccatcacatgcactttaggagacacatttaaaccatagcatgatacgaactgtgtgttactttaggctttgaggcaaacttccctatgacctgaccaagcatcatgaggagctcctgtcaaggaagaccctgggtccctgaactggacacatcagggtctcaaaccagtctcagcaaacgacttctggttcctcatctctaaagtgagaataaagtgtctacctcataagaggattcaataaaataatggatataaaatctttactggcaggcagtcgtgactcagtaaatagtactttctctctgttttgctgacaaaggcatgctcccttgcaaattatttatcatttgaaacataaattcaggagtcagacagggaatgagtttaaattttgactgcattatttattgctgtgtgactctgagtaagtaacttaacctctctggttctccaatcccttgtgtttattatggggataatcatttaaactcaaagggttgctgtgagaactaaatatgcctccatttctccatctgtaaaatagggataataaaatgtttagtctagtgcttgatagatttcagggattattattaatgattgttatttttattatcacataacatggtgcctggggaatttgtaaattcttaataactgaaagcaactgtcactattacaatacatttggatttcgtcaaacatatatctttggggacctctaccaagagacactatatttcattgtctttcagataccatcacttgtaacacacacaataattgtacaaactactaagaaaggaaaactgacaattaccttatgacagccattgattgtgtctcacatcctcattttagagacgtcaaagtgggaaaaatgtgcatcttagaactgatgaaacggaagtaggtaaaagttctttataatcaagtccttgaggacaaacccttttaaacaggaggtgactctgggcatgtctgagctgcgccggaggcagatcctgcatctccaacaccagcaatggcaggtgcatgaaggcagggtttatttggcctaagccttattctatgttttcatattcttccccttcccacaccacagctgtgcactatccctgcctagcctctggcacacctgatccactagcaaatggtgtccatttttcctttgaaataacatctcacatctggtctacctctatgactaaggatggaaaaggctcatctttctccagcctcattctggtcccccattctctgcctaactcctggccttggctgggcatcagggcaattgttctgctccctgtctcctctctctcctcctaacccaccatctcttcatcctccacccttcatacacacagagccacttggcatttgggcaacttgatttattagaaagtgaaggatcttctcaggagtcaggtagatctaggtttaacttctgaatcacatttctaaccatgtgcacttggtcacgttgcctcatctctggaaacttcagactttatttatgaaatgaggctaataaaatgacattgtagatatttacataccagagcgctgctattcaagtgcaaatgaaaagccagcatcagtaaaagttggtaaattcagaccctttctcatcatcctccatgcttgaaatgcagatcaccccctctctgttttcttccttaattttcaccatggtgataagattatgtcctcctacagagcatcttacatgcacagcacagcccttctctaatgtccatccaggaaagctgatcctggaagcttggacaatatacaaaaatgcctgagcttcatttccagttggctcactctcatcaggatcatttttattgatgtcttcctaatttcttcaagagcttgtcataggacacattgtatctgagagctggatggggttgtgtggtactcaccctccaaaaagataagaaggtaaaccttgaacaatcagaagagagaagcaccaagagagaagcttacttctcttcattgtaggaatctgcatgatcttctaaggtgggagaaacaaaagtgttactaaaaatccataaacctcaaaccaaagtccattcagctttgtaaacaaaacactatttgcttgcgctatggatggtatttgttgaggtctgaattcatccttccatggacacccactttgccatgaaaatgatgccaaatgtcaggaggatgtttaatttaacaaacacttacagagcacctactataggcatttatacagcactgtctgtgtacaaggcactaaactaaaagcagtgcagacttggggaaagagcgtgagcttcagaaccagatgctatctttgatcccagcctcttatcctcaagtttttgtgactcaggctaaggtatttaatttaataaggtaaatgatcttagccctagcctccttatttgtaagttggtgacagcagtgtccactatgtgagactatagtagaaactggtgagaaaggatgcaaagtccctggaagaccctcttgtaggtggagatattcaatagattggttcaatgacagtcttgctgtgactgcaggtattggggacagcaccctgcttctaggaagaccagggcaggaaatatctagaacagctgtattaatagatgtgcaaggcagagcatcacctctctctctagcagaagtccctcagctgctcttccctggacccagggagagaagactttggtatgtgaaggtggaaggtgagaaggtggtatgaggaatggagaacaggttgcatggctcccctcgacctctcacactttccagaagaagaggacatatctataacaggctcacagtagatacaggcattttctcgtcagtcctgccccatgtctttccagccataaggatgtctcagaatggcttggggcttctagtccagagcctacgatctagagcacctgctctgggtcatccctgtccttccaccctatatcacctgggtttccacagcctcccagccctctaattctgccctgccaggcttttcttcagcatttcccactgcaagtccaaactgttccaatttctgattggttcctggtcactttgcatgtccactgacagacaccttggtcctatgcatttctagtcctctgggtttaaaagaatcaattcacaaaagacaatttaaagcaaacaatggaaatcaaaataaaagaatctttatattgaactcagaacctaataaatcaactattttcatctgtcccctttccagaccaaggacacagtcatatacgaggtttacaaaattgcactgttacaatgtgatagtccacattttatattattaaagcatatctagaagtttgtccatttcttctagattttaaatttattggcatatagttgctcatagtaaccactaatgatcctttgaatttctgcagtatcagttgttatgtctctttttcatttctgattttatttatctgcatcttctctctctttttcctagtctggttacggtttttcattttgtttaacttttcaaaaaaccaactttttctttcatcgatcttttgtgttattttttcatttcagtttcatttatttctgctctgattcttattatttctttccttctactaattttgggcttggtttgctcttgcttttctagttctttaagatgcattcttagattgtttattattaaagcataaacagtcttccacttagttataaaatattcaaaacaatcatgtttaatgaaaaagcaacattctatgacatcagtgctctaaaatatgtatagccattgtcttactgctagatatttgggtttagattcttccaattgcatgttattataaataatactatgagaaataccattgtgcatacagattttctttaagaccaactctttataataagtctttggaatttctgggctttgaacatctgtatggatttttgctccattctgccagatggcttgactaaagagtgacatgattttacacgatctctagggtaaggtatgaggacctattttcatcccaatttcaccagcattggtgattactatttgctagctgtattgctgctttaacaggtataaaatggcacctggaatttgcattttaatagcgaataaagcattgtgccaaaggactaagccacttcttataagattgccagctgaggaagagaggttctaggaaaaacggaaactagaattctcagcagctccaaaattacctcaagtaggcatttaccttctccacctccacagcagccaaatcagactccagccttttcaaccacttccaggctgaaggcagtggggaaattaccaatgagtaattggcatattacttacatttcttaccatgccctggagacttttttcactcagatataaaaattggtcctctcagactcaaactgaaaggtgtaaacatctcagacttttttttttttatcccattagcacctttctacaaatggccccactgtttcttttgagagccaaacacatagacacaaagtcagatctgagtcctgtgatgtttcccaccagcatgacacaaacatggattattctagacttttttcttttccttttggaaatctcattagaatggaaacatttagtggcttcaagtttccaaaatgagagagattaaaaaaaaaaaaaaaaaaaaagaacgtgcatcacaccagcattagcatggcagagacagcttctgcttgctcagctgtgtttctagagacaatagccatgatggctgattgttgtagacatttccttccctccctgggctccatgttcatctctaaatgctcctggattttatatttactttcacagtcctttgttcaacacatgtttactgagcaattactctgtaccaaaccctgtgtcaaggtacagaggtgacccaagaatcagttctgcccttaagatatgcatggccttataaggaaatcaattacaccaattactttaatcagccttaaggtaggcatggcacatgctactctgctgggagaaagggcggtcaacagtatcctactaagctcttggtggtgaccagctattggctgcaattaaaaaaaaccgcacagcattttgtggctttgagacccctaagttaaggctagtcacttaacttaggggaaagaaatgcaaaaaggttattcactagctgctggtgttgtgagccacatccgcttcagttttgttggccctactattcccaactcctaggaccagcatcaaactttgtgaaatgaggcacaatattaatctaggagagccttgagaaagtaagaacaggctgcatatgttttgatatgtagaaaaagaggggtagtaagggaaaggaatatcagggtcagaaaatatgattttaagtttttgccaccaacttcctgggcgatactggactaggttgactctgagcctcaatttcctcccctgcaaaacgggtctaatcaatagacttctaatgggtctaatcaaaagacttcttagagcaattgtaagatgttgggtgggagaaacaagtgagctcatacacagaaaattctagtaccatacctggcacataggaggctttcagctcaggctcattccatacgtctccctcctaaaacacctcctggatctagagcaggtttgtaacttgtatttgtatcagggtctgggagggggaagcagggagcattttggcctctgggctattgcaaaggaggcagacaagctagtatggctcagcacaggccccaggggttcaattatctgggaatagtgatgaacaggaagcagacaggccccttctcacagactgtttatttgcatgggaagagagacaggtcacttgtgggtatttgggcttctagacacactgggagcaattctaacagggtccatcttctctgaggataatgggtggtcagacttcccattcactagcctctgcctgtctcctccatcagtaagtctccaccctccctgaaaggagccctcctcattctctaaacctgtgctcctcctctgtgcctttcctttatttctctctagcagacttgtcagagtacttggagaagatggttggtgccagcctaacacagactgaatggtgtcttgccctccttaggcaaaaagagctggatgtggaaaaaaatgtttgtgtttcaatggaaaattgtgcctgctctgggttatcaggttctaggcctgttcattgtcattaagccatttttttgtataatgtacgtaattcacaccacacacacacacaaacacacacacacacacacacacgtattgatggtcccctacttacaatagtttgactttgaatttttttactttataattatgtgaaagtgatatgcattcagtagaagccattcagtacagtattcaataacttgcataaaatattcaccattttattacaaagtaggctgtgtgttagatgattttgcccatctgtaggctgatggaagtgttctgagcatgtttaaggtaggctaggccaagctatgatgttcagtagttcaggtgtattaaatgcatcctcaacttacaatattttaaatttatgatggttttactgggacatcaccctgtcataattcagtgggcctctgtgtatgtttgtgcatgtgtgtatatacatgtgtgtgtgtaaattgtcttctatctgtataagagtcatgactgcatcttttctagaaaattttattttaacaaggatattcttccaggatgtaatgatgacttagacttcctgggcatcacaatgtcctggaaccccagtctgcaaagctagctgtgaattaaaatcacctgtgcaccttaagaaaccaaacaccaatgtctatctttaatccacacatcttctaatgtactagctctgggtggggcccatgctggtctggtttttaaacttcctcatgtgatagtcatgtgcagtcagggttaaaagtcactctccagaaggaagaaatcaccagctcacatcgtgggctctggagtctgactgtgtggatgtgagccatgtctcttgctggtcacctgtcaaagaaacacatgagcctgcagtgagtgcctgccatgggcaaggctgtgtccctgcagtcagaaagaatggggtttgaatcatggttctgatactttgagtaaggagcagtaggcaagtcacttgatagctatatacttgctattttcttgacatttttacactgtgtaacaaattaccccgaacatggcagttaaaacaacacacagttatcatctcacagtatctatgggtcaactgactgccacagcttatctaggtctcctatttaaggccacaaagtgttggccaggactgggttctcatcagaggttcgactggggaagaacctacttcgaagttcactcaggttgttggcagatttcattttatttcctgtgactgtagagatgtatggcagcttgcttcttcaaagccagaaaagcagagagaaaaactctagcaagatggtgctgtactttgatgttatatcaagagagaagatcatggaggccaccttaaagtctgtccaccacagtattctcatctggaaagttagtatctacatcatggggtggttgtaaaaattcaacaagacagtttattaaaatgggttggcacataatcactcaatggatgttattagtaaagtcctgcacagaagtcacttttgcataccttcccatagcaaagagcattgggtctccctctgggcccccacagcactctgcacaggcctgccttgtcttctatcacagtgtgtcttccatgtactccttgagcctactgggccctcactgaaatcttgccatgtggccagctttgatcaaagatttgatcaaaatgcaagtcatgcatcattttttgtaatcctcacagcaaactattgatatacaagtattgccatttccaagatggacaaaaatagactccaatacatgtgagaaaaaattgtgcttcagtagaaaactggacattggttagattacacccttccaggtgaactgactcaagttttgtattgtctttgagctattttacaactctgtaaattataaacaactgatagcaatgcaaaaataattcttgcctttagacatgtgaattctctcctgtctagtaaagtttcaattgacctttccccctcctcctgtgtagaatcagaattggctccatttgcctgtttagttcaatactctgatctataaatgtgtcactttttcagataaccttttgagtcctttataagatctgcctggttccctcactgactgatgagttaaagaaaatctttaatatgcattcattgtatatacatatgagagtcataagtctattttttttatttaaaaaatatcttttggacgggcatggtggctcatgcctgtaatcccagcactttgggaggccaaggcgggtggatcacgaggtcaggcatttgagaccagcctgaccaacatagtgacaccccatctccactaaaaatacaaaaaaattagccaggcatggtggcggacacctgtaatcccagcaacttgggaggctgaggcaggagaactgcttgaacctgagaggcaggggttgcaatgagctgagatcatgccactgcactccagcctgagtgacagtgctagactccatctcaaaaaaaaaaaaaaaaaaaacttttaacaaggttatgtatatttcccaagccacggctaataattggtagagctggccttcacctctcacttctcaaccctgaccccctgggcttagctacatcaggattcacattttttgctacttgctgtagtgctaaacacagagcaggtgcccactgatgcattatttgcatctttgctcagctgaccctgattatatttgactcatcacacacagaacataggctcacacactcacttttccaactcaagaatttagctaattcctgcaattcctatggcttcagacaaaaggccttcaccactggcttcagcaccaaaaacctctacaaatccttcccttaaaggagcgggcacctgtctttccataaattcccctcaactgtccttttctctcctctggaaacatatggaataccacctttcttccatgaaaagctcttcaagcattgggaggcagttctttaatttttctctattctttttcagaatcatgttccttaaacctggtcttctaggactgactttcaagcatctttaccatcccgatcattctcttcgggacatgtcccactctccctgtttattgaataagtgatctttaaatctactcaaaggctcatcaggtccatgtcaagcagaaggccttccccatctgtgtgttcagccaggttcatttaagaaggggaatcctggctgaagactcaggcaccccgccatgcttcagtcattcagctgccgactatgtgcttcctcccacagattacatcttccccgcctcactctgcttcacctccactgctgtcactatccccctagcctgtgactttggctttttcccatataggtattaattacttgatatgactccctccaggcctgagccatccctgggatgcccttctgcaaacacagacctgtaggcaggtgccgctgcacttcctgacactacccacggagcaggtgcacttcttccagtcacaccaggagcctacgtgtgcagcctctgtattcactagagttcaggacacctgcatgacactgttgacttttcaaagtgaacttatggaaaactaaaaccaagacttttttttttaaatattattttgaaaccatggatcatttatcaatggtgtctaatggacttcttcctggacctaagcacaggccttcacattgatcttcattcaatttcttcttcttagacccagcccataacgccagccactgcaattattttggaaactcagttctgccaccagagcttaactgtcccttccagctttgtcatctgacagtttgatagtcccaccagtggcaccaggggctccatttcactgaccaaggtgccgctctccttctgcaatttctaattgcttcccctttctttacttcccaaactgcctggggggaaaaaggattctggcttagacttcctactccctctgccccagagttggtctccttgaaggagttttcccagtttggcaggacaggctatttcatttttctgtgtccaagaatggctgctgacaacttcccagggtcaggacccaagacccaatccaatcccagttaccctcagctactgcagagtgcatgtcacccctctcatgctgagctgatggcagagctcacccttgttctgttcctccctggctcaaaggccacaggcttagaggatgaggagagagacagctttctgagtgggcccatctaaaggccagccatcactttagtaaggtattgcaagctctggtttgaaaaccatcgcagtcacagtaacaaagaccccaagtccacttatcaaggtccccttgacctcacggggctctaatgggaactgagcaaatcaatgcttctcaaggctaagttatgaaactgcatgagaaatttgtcatgagtgcagcatttcaaatgggatgtttttttctctctctctgtagaggtgaggacactaagttttctccttgaaatgaggacaagaaaaaaccacggaaaatacacagaatgactcagaacatacctagctaaggcattgtaggtacctatgttcatcttcactataaagataaataaagttctagagcaaggaggcagtaaaaagacctaagacttgggttaggagacctgggttctagtcctggctgtgcccccaaatcacctcggtgctgtaggacaagaaactttacctctctgagctacagttccctcctggtaactgaataatttccataggtcttttctagttctgattctgagatacagaccgcaatttatgcaatagatgtactcctgaaaacaagcaggtaaatgtttcctcctgcaactgaagatgattttaaatgaaccaagccaatatttctctctctctcctttctttccttctttccttcttctcaacttccttcccttctttccttccgttaggagcagaattctttattcaaaataaatcttaggtacaagtccaataactgtcgtataatagaaaaaaggttggtggcgttatggggtggggtggtgaggggcaaccctgcctgtttgttcacccttgacatcctctcctccctcccctcccctctcccctcccttctccatatgcacaaatacaattggtagcacttgcaaagcacagatttaggagaattcctttttcaaagcgtcttcatcttgatgaatacactacctgagaaagcaaaaatgacattgccacatggcaaaacatgtttatgtcattccttcattaactctcccctacaaatctgccaggctgggtaatcaaccgcatgccacaggtgaggagacttagacagattagaggtggaatgtatccattttgatcactgctgtgtttggcacctggggcattgcctgggattcagtaggtgctccaggaatactttttgaatgaatggtaggagttttagaccttcctcaatcaactcctgccagggctggggctccaaaccctctgacttctgcccatccacagatgccggactcctttctgggacatgtgatcacttccaaatgtcaccttgtaaatgtggattgtcagtcaggcttccatgaagtggagtgcacctgtcgttccccctggctggagaaggcagatggagccatgcactcgggcagcttgtagctgcagcaccatcacccacacctgagtctcaattcagccaatccatagctgtgggaccttaggccagtcacttaatctttctgaaacttaattccatcacctgaaaaatgggattaataacaatatttatctcatacaatgtttacatgggtgccctgagattatgtatgggaaagaaatatggagttaattctaagtgtatggaagagagaaaaatatttaaagtcaaaattaactatagctatttatgctgcagttaaccacagggacaacagcaacataatatgtaagggcagtgccataattcacagtagaagatgcatctctattctgttttcttctctccataaagacgattaaggaggaaaagagaaagaaatgtgttctaaaaccttgggcagttctgttttgccctgaaagactgtagcagatgctgtccatgctctgccccatttctctcctcaaggatcttttactgtttcccacgcttctgcctctgaggagcctgcacccactgctgtttgttgaaggaagtagaccatgagttactggaattgctttctctgtggtcaccagcagagggcagatgtgcctgccaggtgagggttgggcttagcccatgactgataggtgagggtgctggtgaaggcacggcttccctgccctgggtgggtaattcatgttccagagttcccctgtgggcagaggctcaagttcccttccatggggtgggactttgctaaagttgtcccttagactgtgcctctctccttctcttctctgctccctcttgctcaggacgcctcatcttatagtccagtttttgggaactcaacgtaagataaaggggagacttggacctgagagtctatgattatcagtaaatataaatgagtctgagaatatgcagaaaagtaaaaagagccacatttctctgcataataatctcctctcataatatatcaggagctgtattatgcagtacttggaagagccacagaataggggcctagagaaagaaaaaatggaaggctttacagagaataaagggccaaaccacatgggaatgtaaaacaacaatgatgacaacagcaacagcaactatgaccacaacaacagcaacaaaacacaactctgaagtagcccaaacctcagcgaaatgtgctacatgcgcaagtgttttgagcgcgtgatattctgagggacatcagagagaaagtgctgtgcaccagggctggatgccacaggcactaacaaggacataatgatgattcctttctgggataggaaggagtcacctgcagggtttcacagtcaggggacagcaggcaaacctgatccctccccagccctgtctttgggcagaatggatgggagggagggacgcagcctcccaccagtggcacaatgcgttggaaccaattccacttggatcccaaagacagagaacttcaattgacatctgggtttcgaaattttgattgcatagaccccagcctaggagacaagtacacaaatcattcttaacacacataggaaaagtgaaaaatgccacaaaaaaaggggtgcagagagttggaggggctgcacagagggatggtacacacactatcatttggttatttgcatgttaggaagcacttattagctcatagtcctctctgacaacacagagagggcagagtgggcacctgttagagtcatgttactcagagcttgcatatgttcaatgggcaagaagaagtgtgctggtgccaattcctaaggagtcctgtgaggccactcttaagagtctctggaattttgcaaggctggtaaacttattaaagaacaaattatatatatttacaataaaataaattatgttaaaaacaaaggcaataaatgctcaaaactcatcagcacctaatgatttttcatttcattattatctatgaccttaaaattatatcttttgcatctgtatcttggaattactatacaatggcgcacctctctgcccaactctatgttaagtgaggtcagattggcaggttgaaatttaccacggtgggagtatttataccagagaaaccggcaaacatgacaggtgattgttaaacattcctcagcacaccacgggagaagagtccagacagatggcaaaggaagaaaatcaaactacttcattcattcattcaacattttattgattacttactatgtgcaatttacatttagtcaccatttcttcatggctagccttcaaagctgattcatggaatctctacctcattgaggtaaaggcccatataaaacactgagagtcggccggacacggtggctcacgcctgtaatcccagcactttgggaggccgaggtgggcggatcatgaggtcaggagatggagaccatcctggctaacatgatgaaaccccgtctctactaaaaatataaaaaaattagccaggcgtggtggcgggtgcctggagtcccacctacttgggaggctgaggcaggagaatggtgtgaacctgggaggtggagcttgcagtgagccaagattgtgccactgcactccagcctgggcgacagagtgaggctctgtctcaaaaaaaaaaaaaaaaaaaacaaaacactgggagtctgaactattgagtatctttcaataagtgcattttgatgactttccagctcatgtgcagcagctccaactaatagctaacaaagagctgccaaggagaggtctggccaggcctacttcaataaatagataaggatcatttaaaagcagcccattaagtgtttgcatgcaaatggccctgccaggctcctcgaaaaacagtttgttctcctaaggaggttaaatattttcagtcttgtttatgttattaatttgcttagccaagtgtgcggttgtgggtgtatttttaatagaggatggaaaaaccttgcaaaatgagctttatccctgaaacataaatgaaggaggctttgtgaattctatacaaatgaccatggtccttgcctgtaccccacggagaaaaaaaagctctgctccattcatgtcaggtagccctggcataggtgcaacccacaggggaggacataaagtagaaaaataatacatcccacatgtgctgcacccctagcacctgggacactacctagcacaggtgtagcccacaggatggatggcgcataaaacagaaacgtaaatggacagagtcatgctacatcccaagcacccagaatggcatctggcacatgtgggcacacagtacattttggttgaatgaataaatgaatgagtgaatgctcctatgctataattctaaccacagttttgaccaaaaaggatcttctaataacaatagacagaaacaatcatagaataaaagaagggagagatggagatttataaagagaataaggctttttttatatcacatctcatttaaccctcacaaatacctggaaagttttattatccccattttacaggtgagaaaaactagaagtaggcagtccactcagcatttgcacagataggaagtgcagagggaggtcaaaatctggtatgtttggattcaaaatccaggctcataccttgtactatgtaatggtagcaaatattcctggaaatagtcaatttaaaaggagaaatcttttctctgcttccaaaaaagctatgataaatttcccttactgtggaagatagaaaattgaaaacaaaaaattcatagcagaaacacatggaggcccagtctcccttcctcacttcccttctctccttggccacagaggaatggagggatgactgtgcatgctttgttactgtttttcactattttctacaacattgacctttggctaggctcagggctaaactctactcatagcatctctgtcccacaaaactctctgtaaggtgaacactatgacctctgtggtgtggaagagaaaattcagaaaaggaaagtgatttggctaaggtcaataccggcaaatggagcatctcagaatctggtttatctgtttctaaagtgtttttccactgacagttttctggaactccagtgtgcactggaatccttggggaccttgatgagtgcagattttgattcagcaggtctcaggtggggcctggcaagctcctgggtgatgccaaggctgtaagtctcagaccacccttgatgagcaagtccctgcacacgctgccttattcatgcccagtgagctataagcaactcttaactcttctccttgtgtagagtcagttctcagttcttcccgctttgatgaaggtccagctaaccaactacactggtgacttggtaaacccaggtagaccctcactatccccactggaccctggctagctaccttcttctctacccgctctctgtccctgggacatcatactgcttaccctggagcccccaaacttccctgctgttctctctcagtctggcttaaacaataatacctaaaaatggtctttgcacctgcaattctgcctccttgaatctttttttttttcacaaaacaatcactttgaactatttaaatataaatgtaatgatgtcactctagttcttacactccttcaagaaaggacaagccactaatcctcttgtcctgcctcaaatcctctttaagcagagcttattttgtttgtttgtttttatctgctgtggatattgtggtgcaacacaagctttaaaagaaaatacaagattttgctactaaagagaagtaagaatccatctgatcaatatactccatgtcttccattttacagatgagaaaaatgagtcccagagaggtcatacctcattcctgaggtcccccagaaagataactgtggcgtgagcatgaatcccaaaaaccttgatgatatatttttttaattctgattctctttccatcgcaccatgcttctcataaacaacattctttctattttttcatctacgtcttccctaagttccattaggtgggtttatttattggcagagagcaaagtactcatgtctgcatgccccctccaaacctaccccctgcaattccaagaataaagaaaggcatgcagactgggtgagttcttacaagcagtctgcagcagactagactgactacttggccatgagatcctaagtgtgggggcagttacagataaataagaaaaactgaccacagccacctctgcccctcaaaactgaaggaatactctttaaggcatcatggccaacttaagctggttctccagacatgataaaatgaatgcagaagctgatcaaaattagtatattgagcctcgagctgatggactttttcccaaataattattcttttttaaaatatggccaggtgtggtagctcatgtctgtaatcccagcactttgggaggccgaggcaggtggattgcctgagatcaggagttcgaggccagcctggccaacatggtgaaatcctgtctctactaaaaatacaaaaattagctgggcatggtgatggatgcctgtaattccagctactcaggaggctgaggcaggagaattgtttgagtttgggaggcagaggttgcagtgagtcaagatggcatgactgctttccagcctgagtgacagcgtaagataaataaatatatacataaatacataaataaaaaattaaaaaataaaaataaaaatatcaatggcatgaaacttttttttattttttttattatactttaagttctagggtacatgtgcacaatgtgcaggtttgttatataggtatacatgtgccatgttgtgtttgctgcacccattaactcatcatttacattaggtatttcttctaatgtgatccctccccctgctctccaccccatgacaggccccggggtgtgatgctccccaccctgtgtccaagtgttctcattgttcaattcccacctatgagtgagaacatgcagtgtttggttttctgtccttgtgatagtttgctcagaatgatggtatacagctgcatccatgtccctgcaaaggacatgaactcatccttttttatggctgcatagtattccatcgtgtatatgtgccacattttcttaatccagtctaccattgatggacatataggttggttccaagtctttctattgtgaatagtgccgcaataaacatacatgtgcatgtgtctttatagtagcatgatttataatcctttgggtatatacccagtaatgggagcactgggtcaaatggtatttctagccctagatccttgaggaactgccacactgtcttccacaatggttgaactagtttacagtcccaccaacagtgtaaaagtgttcctatttcttcacatcctctccagcatctgttgtttcctgactttttaatgatcaccattctaactggtgtgagatggtatctcattgtggttttgatttgcatttctctgatggccagtgatggtgagcattttttcatgtgtctgttgcctgcataaatgtcttcttttgagaagtgtctgttcatatcctttgcccactttttggtggggttgtttgtttttttcttgtaaaattgtttaagttcttgtactggtaccaaaacagatatatagaccaatggaacagaacagaggcctcagaaataacaccacacatctacaaccatccgatctttgacaaacctgacaaaaacaagaaatggggaaaggatcccctatttaataaacagtgctgggaaaactggctagccatacgtagaaaactgaaactggatcccttccttacaccgtatacaaaaattaattcaagatggattaaagacttaaatgttagacctgaaaccataaaaaccctagaagaaaacctaggcaataccatttaggacataggcatgggcaaggacttcatgactaaaataacaaaagcaatggcaacaaaagccaaaattgacaaatgggatctaattaaactaaagagcttctgcacagcaaaagaaactaccatcacagtgaacaggcaacctacagaatgggagaaaattttgcaatctatccatctgacaaagggctaatatccaaaatctacaaagaactcatcttcattttatgatgaggtaaatccgtctctaaatcagaaaatcaactgaagaaaaagcttatctttatcaagttcatgtgagcaaacaatgatacttggtatctcacatccacccattgatctgaaaaccattcaagacagtggttagaaaacatattcacagcaggttaataaatattccttgagtgagtgcgtatatagtaagaagcttactgttctcagagaaaataatggatacttggcatataattccttgctaagttgaatggtttagttagattctgagaagagtgagtttagggtaggcttaaggcaagggaaggtattctaaggggactttgggttggtggaaaagataacattccatggagattctaagaggagccaattcagaggcagggagatgtgtctatttgttctgggtacactaaagaggacatcaggctggaagagaaagccaagaaccagatgtagaggagcttaaaatcagaactgaacattccagtatctagtgcagtcagtcacaggaagatgaaggacagtcagtttcatagcgtgggacacacacgtgggtgggatgcaagggcacatttagtagtgcttacatagttatgtgcttaatgtggatttgaagaaagcataacttcacacatcagatacatgacttcacagatagtattgcttacttaacgagaaaaatattaaatcaatgccagcttggatgtgacaaaatccaggggagcaagaatgattggaaattaacaaacaatttggctaaagctataatgtatccataatcattactggttgtcccagcaaaggctacagtgtgggtggaagtgcttttttattcattctttcattttcaaatgtgtaaattcatacattcaacaaaactaatgaagtgagataatacagagaataatgactaatttctcctcatgaaaggaaggaaggagggaagaaaggatggaagaaaggaagaaaggaaggatggaaaagataagggagggtgagagggaggatttttaaggacctaataagaatctaataatgtgctaggtctggggactcagacaggaatgaagcacagtcctcctcctcaaggggcttgctgtccagcagggaagcagacagctgagcaaatcactgtaatcccacgtgagaggaggcacaggtataaaaatgtgcacaaagtacaaaaacttgtgggagcctgtcagagcaggggtagcttgggagaggtgctggtatttgagtttagcacattttgccaggtggggctatcaatttgtattagttataattaagatttgtaaggagttacagttcatggatcctaaaatatggcactattgggaaagcatgagtgcaagctattactattatttagtgcaatgaatggcattaaactgcatgagatgatcagtaaaacttatttaaaaacatgcattttgagacactcccttacggggccatatagtatgcgtggagtatggttggattaatcttaaatttttataaactctgggaggttctgatgctgtagacaggtactcatagagagactaaattagagaggtcatggatcttattgactttggattccttagtagggggcacaatacctggcatatgggaagtattgaaataaatgtttggtaaacatgaacaaataaattattaaaaatccaataacaaatctaaccaccaggatcatatttttgagacagaatttcactcttctgcccaggctatagtgcagtggtgtgatcatagctcactgcaacctcaaactcatggcctcaagcaatcttcctgcctcagcctctcaagtagctgagactacagacacacaccatcatgccaggctattttttttttttttttttttttttttttgcttttggagagacagggtgttgctatgttgtcagggctgctcttgaactcctggcctcaagtgattctcccacctcagcctcccaaaatgttggaaattctagatgtgagcctctgcacctggtcaatattttgttttcaaataaatttaatttattgatttaaaatttatacttgcatccttccagaaagtgatggagttagcctgtaattaaaaatctaaacaggattaattgctttttaaaatttaattttattaattgattaactcaggctcattctgatgggtgcctcctggtggtggaagcactgagtgtctatatgtacttgaaagtaaggaactgtccttaagaacattcttccttgttactccctaattctcactggtcaccctactgattggtctccactggtgagatctgactcacaaacttctccatcagcaggaacataatgtactctcaagaaccaaacccaaggcatgctttcacattttgcagtactctctattcctgaaaagcgttaaaattagatttattatggctcattaagttaaagggaacaggacaattctctttctaagcagctgaaaaataagccaaattttctagtccatattcaactcaaataccttgattttgatacttttttttgagttctcagcaatgctctgtcctaactttccattctgctcattggaatctgttgtactagcatcagctacataatggttattcaactaattggaagaagaagggaaaatgggagagggggcagggaaagggtcgggtcttgttactgagtgtatactgtgttccaagcattatactaggcaccagtagaatgattaacagagcagacatagccccttccttccctgtgcttacaattgacagaatgatgctacattaatcaatcatttatagtaaagaatgagacagaatagacccaccagtttgtcccctgtttgcaaatcaggaaaaaatctggaagtgatttccagcaggacttgccccagtaggaaaaactgcactctgttggcagaataacagtaaagaatattgtgcccaaatgaaaacggcttttaaaaattagcttcataattctaatagggatgtgataagaccaatacaaaagtagcttgagttgagttcctgctcaaaggtagagggcactgagttcttagccagagttgaaagtattcaagggaaaatcaggtagtccacctggaaagatcactggaatcatttttagggagtgagaaggagattgtggctgggaggcagtatagagcttgaagttcttctaaaaagtcatagaaagcaactgggatcaaatgtgaattcagatacatcagaagacaggatgggtgagtacatgggatttggaaccaagaactgggacaatatgaaagatttttatcctacttatatatgctaccaagagggtgacagtgatgtgctgcagcctgctaataccatcttgcaaaagccaattatggacacctcttccaaatccaatttcagtcacttcacatgggcagcttgaaatgggttatcatgggagtatttacaccacagaaagtggcaaatgctatgaatcaggacttcgctttaagagaagttatacaatatttaccagcaggtcactacttacagagtccaggctaacagcctccaggacctgcatgcaaccagaaatttagaactggatctgtacccagttagcattggttgccttggaaataatgcatttctcctcaactgatatgaacaaggagattcaagtgtcagagaggtgcatagaacaaatgagcttgaagcctactccctactttgagattctgcattcttattctaaaaatatttatggaggattttggccaggcatggtggctcaagcctgtaatcccagcactttgggaggccaaggcgggtggatcacaaggtcaggagatagagaccatcctggctaacgtggcgaaaccccgtctctactaaaaatacaaaaaattagccggacatggtggcaggcacctgtagtctcagctacttgagaggctgaggcagcagaatggcgtgaacctgggaggcagagcttgcagtgagctgagattgcaccagtgcactccagcctgggtgagagagcatgattctgtctcaaaaaaaaaaaaaaatcatggaggattttaagatcatctcatggtgataacatacacatgagaattaaataccacactgtataatgtttctatcccctgctgatggaaaaaggtgtatatgtgtgtgcatgggtgtgtgtaagtgtgggcgcgcatgcgtgtgtaggggagtggaggcaggtaaagggattcaaggttttgtggtatatctaaaataaactaagaaattgacaagtagccaaggtccaaattataataatttccaagaaatacagagccagaatgacataatattacacaccaggaatggtgttcttaaaaataaacctgagttgtagctattaaggaccatgctattttgcagaagtatgaagaaaggcaggttgaggctagcatgtggtcaccccgggaagacagcagggtatcaagtgtcagtgagctcctggagctgaagtctgactgagcagaagaaaatgggtcttcttgtggatcctgccaaaacgaaatcaatgaacatggcctggctggggaggatatcactgtgtccacattttggcaatactctctgagggataaaaacaagaaatgacactcatataaaggtttagaaatatcacatccattatcctgttgaatcatcccagcatttttggagaaaaatatcattgacttcatttttcagaaggcaaaactggatctcagagagcttaagtcacttgtcatagttacagggaaggaagtggcacacacaagacaatatataattaagtacttaaaacatatctcactcttttttttttttttttttttagatggagtctcgctgtgttgccaggctggagtgctgtggcgcgatctcggggctcactgcaacctctgactccctggttcaactgattctcctggctcagcctcccagtagctgggactacaggcacgtgccccaacacccagctaatttttgtacttttagtagagacggggtttcaccatgttggccaggatggtctcgatctcctgatctcatgatcttcccgcctcggcctcccaaagtgttgagattacaggcgtgagccaccacacccggccccactggtgtctttataagaggaaatctggagacacaaagaggcactggggtgtgtgtgcagagaggaaagggcatgaagacacagtgagaagccggatgtctgcaagtctaaaaggaaggcctctgggaacccaacaccttgctgacacactgatcgtggacttccagcccccagaattgtggaaaaataagtttctgcagtttaagccactcagtttgtgttattttgttatgacagccctagcaaactaatacagagggcctctttggccctttgtggaaacctgattgaaggtgactacactggcggtgccgggggcaaatgacactctcccggggctccaaggaaaaatccatagtccatctcagttcctcatttgttctgttcttgcacttccagtggtcacaccagttatacgagttcaatatgaatgcagagaaggaaccaaatggcaattagaaccacgatcaatgggaagaggtagtctttcacacagagaatctattgtgtgctagaatgtcttcacagaacctgagttctgtgaagttggtgctgttataccaattttttcagataatgctcaggctcaaagaagtgaagaaacacactcaagttcaaacagaagttaaaaaaaaaaacccaataaatccaacatgattgtgtttagttccctcaacagtaaataacttgcttttgatgaaaagtcctttgctcatgcaaaatgatgttaataaaaccaaagccgctgcaattagtcagatggtgctcatattaatttgtcatagatgtaagacccaaacagttttgcctctgggtaaactttcttgatttacagaaataagtccatatgatttctcaaatagtgggccctttttttcaagaatccaaaatattcaggcatcaaagtgacaaatgaataattgtattaagcagtatggacagaaaggcactgtattacattgaataactcactgattcatccatccatctatccattcactgagttattgagagagagagagagagagagtgtgtcccttctatgtgtctggtttagaattaggcactggcaatacctaattgcgaaagaaacaatccacagtccctgcttccaaggagctcaaaatttggtacctacttcagagaattcttgagagttttagattaattactacacggaaatacttagaaaaatgcccagaacatagtgaacactcaaaaaatacagttttaatttttattgctatctgatatataatcagacaacaaaacatgttttcagtcccccgtagtaaaggttcagtatgtttttgggggagggtgctgggaagaagttctatctcagtctgggggtgcctgaaactcttcctccagaagtagcccctcagctgactcttgaaaaaaaaaaaaaaagaggcaagcgaagaaaaggagaaaggagttctatgagatagagccaggaagatgaaggccagagcttaaagagcttcatgcattgtgttagtgagttgagcatttatcttgcagataagagggaaccattgaaaggtttgacacagggagagagggaacaatcaggatcacatttgtgtatcataaaaatctttctggaggctgggcatggtggctcacacctgtaatcccagcactttgggaggccaaggcagatggatcacgaggtcaagagattgataccatcctggccaacatggtgaaaccccgtctctactaaaaatacagaaattagctgggcgtggtggcacatgcttgtagtcccagctacttgggaggctgaggcaggagaatcacttgaacccgggaggaagaggttgcagtgagctgagatggtgagatcatgccactgcactccagcctggtgacagagtgagactccgtctcaaaaaaaaaaaaaaaaattctggatatgaggtaaagaaagccatgaaaggtggtaccagtgcagtttttcccaggagaatgttgatgactcaaccaagccagtggcaatggacagcaagaggctgtgggcaactcaaaatatactgaggacttcaagtcaacttgacttcacaactccagtaaggagaaggaagagtcggaggatggcatggctagctggtgcccttgtctgagttttggtacatgagcaggttcggaagaaagttgatgaaattcattttgaaggtgtgttcaaggtgtctgtggggaggcttctaggtggtgatgtctaatcaacaaacacaggttggaactcctaaaagactattacctggggctagaaatttggagtcataagccaaaagctgggcaattaaaccacaggagccaagcaggggaccagagacaagcagagggcggtgagtgggacaccccagggccttccaagaggcatgttcttgtcaataaatacactaagcaagggagcaactacagcatccccaccaagggtgaaacataacaggtggagagaagccctaggctgaatgcattaggattctaatgacatgccacaaactcctatcaggagacgtggtggaagggagctggcaaatatatcaactcacataattggcatttttgcagcacacttctggtgcagaagagctgctggctttcagaaggaagggcaggatggggtctgatcactcactttttcaagtctactcttaggatcttctgtctgggaagccagctttgtcaataactgtttttctctgcctcagggccatgttggatctacctcaacagttttcagatgacagcaccaaacaaccctcccagcttctcccaaaggctgcctccaatttggatgtaatcagaatccaaactggctcctttccatgtctcctagtaggaagtgaccctggaagctgcaaagtcctcatttgcaaactgacagtcactttttcagtttcctaggccaagatgaaaaaggctccttaccttccaagataaagcccccccgcccactagagcaaagagaaatcacacccacacccagctgacattcattttccattttcccagcctgtcactgctgagaaagagacagctgctgctgccaccacaggcagagagagagagagacagagagagagagagagagagagagagagagagaaaatcctttaacctcttaccatattaagtcacagaaattttcttgcaatgtgtcttcctgtcatttactcaggaaggtccctatgacatagttttgaaagattttacagacagcagaaaaacaagagtgttatcccaaacctcaatcaactaagcaatgtaaagacataattcctgaaattcttgcccacaatagtttttggaaagaaagcactacatttcactggttgtttccaaactgattttgtgtgtgtgtataacactttgctgtggccatctccagaacattaggttgtctcccatagtgtcaatcccttctgtccaaagaattacatccacttcttacccccttacttagtgtaataagctcaactgtgtcctcctcaaaaaaatttatgttgaagtcctaatccacagtacctcagaatgtgaggttgtttggaaacagggtcttaccagaagtaattgagttaaaatgaggttatgatgggcccaaatctgatatgactggtgtccttataaaaagggaacatttggacacagagacagacatgcacagagggaagattatatgaagacactcagagaagatggccatgcgaccagaatgatgcattcacaagccaagcaatgccgaggattgccagaaaacagcagaagctgggaagggccaaggaaggattctctcctagcacagtcagagaaagcatgaccctgtcaataccttgatttcagacttctggcttccagggctgtgatataataactgtctgctgttttaagccactcagtttgtggtaagttgttatagcagccctgagaaaagaatacactcatataggtgggtttcttcacagatgcctttctagcttttcctttgatttgtgatgttttctctgttaaggactgaattgtatttgccccaaaatttatatattgaagcctgaatcctcaatgtgactggatttaaatatagggatttggggggcagttattagggttaaataaagacacaaaggtgatcctctaatctgataagattagtattcttataaaaagacaaagaaacaccagagattgctttttctctacacacagaagaaagggtatatgagaacatagcaagaaggtggccatttacaaaccaggaagagagtccatcagaaatcaaatgtgtattttgatttccagactatgagaaaataaatttctgttgtttaagccacccagcctatgatattttgttatggtagccaaaactaactgatacacatgccaatcctctgccatgttctaagccacattcatgctttgcatgatggctctaagtcacaatgatcattaggtctttcctcgaatccttggcaagagtgacttcagaccctaatagttgtacgacagttctaattttgagtattcttagaaatgtgcattgattgagcccccacaacattccaggcactgtgcttaacacttcagatattctgttccttatacctccctactggaatagtgactaccatcccagtaatttccaggagagttaacggagcatcagaaactaagtaattggtcacccaccaaggaaatggagacacctggatttaagtcctagacaaatgactcctctgaatatgctcattcccctatatcagaggagcatctactcttgctcttgtccaagtttatagtcttggttctgcaaatatgatcaaggcacttcaagcattactgtagcaccagagcttcttaatctttaatgggcacatagatcaccaaggggtcttgttaaatggcagactccaattaagtaggtctagagggaggtgcctgataagctcccaatggtgctgatgctgtaggttgttggaccattccttgagtggtgaggatttacacacaggactcaatcgttgataattttatgctttcttttctaattgtcatgtggatgaattctttatcacacacattcagaatctactatgctcctagctctgtgctaagtaatgtggacccaaagaataattaagaacttaattttaaattccttaaaagcattggctgttattttgactattttttatttgaacaactaacacagtgggcacatagtaagcacttggtcaacatggctgtacatccttaacatctagaacagagcattcaaataacaaaatcagattgagatgtgtcctgtgacagatattcttagtcaaccactatgactcattcacccttttctcctttactaatgaagaccggtttcattaaaaaacagccccaaatactcacgccccagcttcccttgtggattggggtgttcgtgtgactttgttttggccaatgaaatgtgctaggaagtcttttggtttttcctcataaaaaggtctccatatctttcttcttctttctcgtatacagatggattaatgcacacagatgccgtgtttttatgatgatgaggcaactaaggtgagaggaaagctaagataatcatttagatattgtctctggcattgctaagctgctgaacaaatatcagcagctgcctgcttcaaatatcttgccacgtgagaaaaataaaattctttcctttagccaatcttattggtgacctatacatgcagctcaaagtgattttaaccaatagtaacccttcctaattaggacatttccgtcatgacaccagctgaggtaagagtagtctagtcaaaagttggaagcaaaactgttaggcatgaaaaacatgttttcaaaattaattccagccaaacaccaaccagaagcatattccatgacttgatccagattctgttagatgcaaatcttcttttctgtttttattttcccttgctatctaatccaaattctataggtccattccataaaattatttcaactcaagtgctggtatgaaaaatgctaaatcccaagttgacctaatagttgccaccttaaccttgatattccaccagggtgtgtgggaagcctagtgcttttaggatgcattttgggttatctttgagctgcagccttaacattagcattgactcatggctaatatatcaccaggacagcctactctaaaagcatcaatggaagtttggtttcctccttagactttcaatgccagtaagaagaaaaagcagagacctacatcctgctttcttccattcatctcacacacaaatacatcaattttcttcactgcttaagacagacatcagcctaaacgggtccctcatttcactttgtttcagttagaggacatagaaaaaagtttgttttcattaatattttacagaaaccttatataatggaattaatcacatcttaatgttaactttaaattctgaaggtggagaagcgggcaaaaaaaaatattcaaagctctttggatatttcagctgaagcaataaaggaaaaggtctaatttgacctgtggggaaaatgacaaagtaaataaatcaagtgaacacataatttattgtccaaaccagaccactttgaacagtgaaaggagaagctattaataattatgctggggcagtaggcgtaaactagaacataccaggacaaaccgggacatgtggccatcctgtaaataaagggttatgtctgtagtttttttgcaatcgagcctacatagctcaacagtgcacagaagaaatgactctgctctgtatttacagataggaaatcacacaaacgcccctctgcctttgcacagccccttgtgttttttatggagcctcatatcaggtctcacttagtctttgctctgtaaagtgggtgttcagatcctcttttggtaagaaagagcaaaaactgtgcataattctgtccatgaaaagtttttttttttttttttttttttttttggcaggtgaaaggccaagcagttcttccaaaggattctttccaaatttgggaaattggctcagggaaagcctgcctgcacagagttctggaaagccagtcctatgatggggctaccttctgcgggtgggtggaggcagggggcagagaggaaagaagattcaacctgaaaaatctcaaaacagaagaaaaacaaagtttatgaaacacacactatatactggacactgtggtagacacctatgcattctatcttacttgattttcacaacaaacacacgaggtaagtattcgcagtcccatttttcagattgagaaactaaggctcagaccaattaagtgatttgactctggttaggcagctagtaagtggtagacagaaagggaagttgtccagccccatagcttgtgctcttgtcaccacatcaggttgcctgacttggataactgggagtttctggactatgcactcctctccatcaccacggctgccctggcccagcccccatccaatattccctgggctgctgcagggtcttcattgccttgcctcatacagtccagaatgtaaatcacattccgtggtgatggttgcccaaccttatgaatatattcaaaatcattgatttatatacattaaaatggtgaattttgtggtatgtgaattatatgtaaaaaataaaaagatgcttggcagccaacacaataacaaatcataaaagtttttaaaatgtgagtcagatcccaccattctccttaaccctctctggtgtcttcacatcacagtgcatctggaaaaacacatagccttctgggtgtcctaggaagccctaagtgatttaagaaacttcctggccgggcgcagtggctcacgcttgtaatcccaggactttgggaggccaagggtggggggggaatcacctgaggtcaggagttcgagaccagcctgaccaacatggtgaaaccccgtctctactaaaaatacgaaaattagctgggcgtggtggcaggtgcctgtaaccccaactacttaggaggttgaggcaagagaattgcttgaacctgggagggaggttgcagtgagctgagatcacaccactgcactctagcctgggcgacagagtgagacgccatctcaaaaaaaagaaacttcctgtccagccactagctgaccaccaagctaactggagagagacttacgtgaccacacatgaaaaacaatacagacattacagaattaatccaggaaattcactaaagccagttacctgcctccttgactagccttctctccttcactcagtcggtgccagtcattccctgaacacaccatataacctcccaggtcggaacgtctgcctttactccactttgtgtctcaaatactctgctcacttctggagggctggctcctttgcatcatttagatctcagccaaaatatcattttcttagaaaggccttccctgaccaattagaataagttagcacctttctaagcggctttcagtaacatcaccaagtccatttcttgctagcacttaaccctgtctgaaatcatctgacacatgacttggcatgtgctcttggcgggagtgggctccatgctgggcttcttcacagctcagtctctaagacccagcacatgccctggcaagaaacagttgataaatgggcttcttttctggataaatccatcataaaaacttgcttctcctccacacagtcacctataccagcatggcagtgggactgggtaaaactagaaagagtggagagctatctattctactcttgttaactccaccactactggaaagagttttctgagcccagttatgggatccaaattgcaaagggcaaacctttttcatttggaaaatatttaaatcttccagggagtgaacattttaaaaacgctttcctaggaacaattgttttccaacaattgcagcaaacatgacctccatcaggttattctatccaaacacacgaagcaaacaacaaatctttgaagctcgcagggattcaaatgccttcttttgtaagttaaaacaaaaggcaaaggaggtagtgttgacaatgaaaagacagaggcctaattgagaatgactgagattaatgctaataattaaaacaataaaatatatatggacactgtcaatgaatgtctgccatgtgccaagtctcatgctcggaagttcacctaagttatctctttataaacccatggtggcaggcagaattctaaggtggaccccaagattctctgtccctgcataattccaagcagtgtggttatgatggatttcactccagtgactgtgtttccttagatggcacagttgactttgagtaagaagattaactgggtgggtctgactttatcacaagagccctttaaatctgagtgtagtggtcagagacagaggagtaagaaatttaaaataaaagatttgacacaagtgaagctgtccattgctagctctgaagatgaaggggaccatgggtcagggcacatgggtggcctctaacagctgagaatggcccctagctgacagccagcaaggaaacagagacctcagtcctacaaccacaaagaactgaattctgccaacaacctgaatgaactcggaagaggatgccgagattgaggtgagaatgcagcctagctaacaccttgattgcagacttgtaggaccctgcacagagaatctagcaatgttatccccagatttttgacctatagagcatgagctaacaaaagggtcttttttaagccactaagtttatggtaattagttattgcaatggaaaactaattcaaccacaataaccttacaaagtaaattcagtctgatgacacatggagactggataagagtaatgatgatgatgatggtagctatgatgatgatgataatcatgatgatgatgatgatggtacaattgacatctactctgtgttccaggcattgttttcagtgctgtgcatataatatgtcagttgattctcataccaacatttacaagacaggaactagtattttcatctttatttgcagctgaagatatttaggaacagacaccttaattatgtcattggcccaaggttacagcatagccaagattctaactcagaatccatctggccctagttttttgcacttagccagtgcacagcaacccacttggtgctggcccaggcttggcaacaggcaagggcttcacagaaaaggaagaaactcaggctggcagcacccacgagggcagtccaggatattgcagcagtgtaaacagaggccaggaagcttaaggctggatgaaaggtgtgggaaattgaaagctgggtggtttgttggaatttgcgctttaatagtatttcttgattgcaaattacagaaactcaaagtaaaatcacctaaaatataaaagaaatttgtcattaagataaaaacaagaacaaaacaaaactagagcatcccatggtattagtgagttgagtctaaggtattaatagaaccaggtttaaatgtaaagagcaggagcaccatcatctcggacaaatactaccactttaagatccagctccctttctaacctcatgcatttcaaggaaatcacttctcttctaacaacaagcagccagaaagagaacacagtaaagcacagataagacagctctggcacagaaagaggggagaagtctcttgggtaaccaccaaacttcacacttgtacaatgggccccagtaaaacagggggtcccaataagcacattcctttccctttcggtgcactaaattagggaagctaagaacagactcggcggagggggtatgcttgcagctgcaggaagatgtatgggaacagacacaaaaactctccctcctagataagcaagacaaagagacaaagactaaaagttggcctatgtggtcttgaaatggggtgagagctgataaaaactctgctctatacagatagcacacctggtcctaactgaaccattgggccctagaagggtaaggcatcctctcctcatgagcccctgaaccctgaagtacccttagtctgtaagagagcaggctcctgacctaactgcccagaagcctctctcaggtttattctttaaaataaacctgtctttgactgtagatccgctttttgtgtttctttcttccttcttcaactcttatgcaaacactatctctctcctttttggtccttcctgtgcaacattctcattcttctctcatttctatttttctctctccctatcctacttctctccttcttgtcgcctggcttctttgggtaacattattgccaataacttcccaaatatgtcatactctaagcatgatgaatgatggggtctctgaggctcacgagcaaattctcagtgaaagagtctgttttcccagcttgggttaggggtccatccccagcccaatgctgtgtacatgaagtcatatggtcctaacctagacactcagactgcaaccatatgaatgagggagagaagaaaaaagttaatagaaggataatgagaaggctaccctgtaagtgtaaacaaccgtgacatggagcaagagaaggctctggaggtaaagacagaggcaaagtcatgaaatactttatgggctggcttacttaataactcattaattgatggacccaaagtcttggcagaatcttatttggacattgacgtattaccaagaaattcctgggccccttaattcatacaatttgtaggatcagacactcttctgtaattaagcccaactctgaaatgaagctaggctttggaaatgctggaggaaccaaagctgcaaattccaacacatgccctactccagccctccctcctgtttaatttgattcgatgggctgatagctcctgcaaatacatcctgctcctctttggcaaattgctaaatccaagaagatgtaatcaaccacattctcacacatgaataaataaaagctgagtgagagattgaggaaatttaacacctctgtaagtaccactaaggttactgcttggagaattaaagtgcatttcatgacagccactgatttaggaaggtggtgatgtagaagaagacaaaatgaaactcaaagtaatttgagaagggaggagaccagaagaagattgttagtactccaggaagccttgtatgttaacgttgaaaccaacagactgcaaaacctggaagatcacgcccatgctgcaatttgccaatgctatgtgtaacccttgcaatgatttccagtgaaatgtgacatttaagacacacttgcatgatggaaccagaccccatatatgaccaattttagatagattgtagaaaatgctcagttaaagatagcagagcaattcctggatttgattcttagctgtatcccacgatagttgagtgatcgtgcacaagtcatttcagctctctgagacccagtttctatgttcggagaaaaattcccaagtagttgtgaatatttaaaggtccgatgacaacctttgacacaaagtagataatcaaatgtatgtcagctttgctatcttccatttcactttcaatcacggcctttgaggcactcagacagtatttaaatattgattctgctacctattttattaccctggaaatgctctaggtctaaaggaaactttgcagcttgcgtctaatgcatcatttccagatgggttgggaaacactgcaggaacgctatcttcactaccaactcctcatgccactaaattttgacacacagcttgggaggatggcatatccataggcctgtgccatgattctttttttttttttttttttttgagacggagttttgctcttgttgcccaggttggagtgcaatggcacgatctcagctcactgcaacctctgcctccagggttcaagtgcatctcctgcctcagcctcccgagtagctgggattacaggcatgcgccaccatgcccagctaactttgtatttttagtagagactggatttctccatgttggtcagggtggtctggaactcctgacctcaggtgatccacctgcctcagtatcccaaagtgctcggattacaggcatgagccaccatgcccggcccatgccatgattcttaattccagctacctctatcctctgccatgctcacctcccctgtgtagttatcctagaaaataaagcagaatttactcctggaaggcaaccaacacctatctggatgccagagacatcacaagaagccaacggggctttgataagtcagagtgagcctcgcaccacctccccatgagggcagagatatttgtcacttttgttcactgttgtatcccaagcacctaactttgtgcctggcacctagttggctctcagtaaatatttattgaacaaatgaaagaataagtgaactagtcaatgagagtctattatgcacctggcattgtattagggattttatgtatgttaactcctttaattctcaaaacaacccaatgagctagctacaatttttttttttctttttgagacagagtcttgttctctcacccaggctggagtgcagtggctcgaacttggctcactgcagcctctgcctcccgggttccagtgattctcctgcctcagcctcctgggtagctgggattacaggcacacgccaccatgcctggctaatttttgtatttttagtagagatggggtttcaccatgttgaccaggctggtctcaaactcctgaccccaggtgatctgcctgcctcagccttccaaagtgctgagattacaggtgtgagccaccgtgcccagcctagctagctagctacaattcttataaccattttacagatgagaaaatagccttagaaatgttaaataagttgcccaaggtcacatagctggaaaattgtcagagctccttccattgttttcatgtttttgagtacaatgtaaaattcctgataccttataaaggtgttatgcaatggaattatttgaaataattttgctatagttattattatttttatttactttgagacggaatttcgctcttgttgcccaggctggagtgcaatggtgcggtatcggctcactgcaacctctgtctcccaggttctcctacagttattattatctattgcctactttcgtccttagaaaaacactcattgggctgggcacagtagctcacacctgttatcccagaactttgggaggccgaggcgggcagatcatctgaggtcaggagttcaacaccagcctagttaacatggtgaaaccccgtctccactaaacacacaaaaattagccaggtgtgctggcgggcacttgtaatcctagctactcaggaggctgaggcaggaaaatcacttgaactggggaggcagaggttgcagtgagctgagatggtgccactgcactccagcctgggcgacaagagcgagactccgtctaaattaaagaacaaaacaaaacaaaacaaaaaaacactgagtggtagaagggtaatggattattcttattttttgcagaaatgaaactgcaagtggaattggactaacttactgaaaactgtatcaagcattataccgtcaagggcatctaggtagatcaaggatattttaatttgcttaggaacttattcctctgcacaaccacttaacagcaacgaaatttcttctcaggcaggaagtaaatttagctcattcttttgggttgcattagtgggaaagtaatatctatttgagtcatgtcgaatggcaagtacctcatatgtgggtaagtgagagttgctgacctgtgaggtggttaatgcatctgcttgctggtatctaatagctttttactattcaatcaacagacacatattgaacacctactgtccataggacactgtgcagggaattatggaggtggggtgggtagaaggcaaccctgtgtaggaattggagggatgctcatccagggaccacttgtgatgtgctggcaaccttcataccttgccttatctgatcattaaaacggcttcaaaagattgacaatatttatgcttagaggtgtcaatgcacctgcccagggtcacacaactggtaagcagcagagttgcaatttgaacctagagctctctgattccagagcttaagttcaacatctgtactacaccacttctatcatttagttttacaataatctatatcctctttctggactatgtaagtgataggaacctaaattcatagatacactaaaaatataaattccattactatttcattcactgctgtatctccagtacctaggacaatgccaggcacatagtaggtaccaaatgaatatttatcgaatgaatgaatgaataattgaattattttttaatctgaatccccagggcttatcatgatacctgacattacatttctgtgaaacagagcaatgtttatgttcatttataggcactttgcctaaatcctgtggagtagacttcattttcctagttttatagataagcacataaatctctgagagaataaggaggtagctctgggtttaatgaattttagacagagaggctacctctgttcacttccgttctaccatgatattttacccaaagaaacagtggcaatcttcaaatatttttgaggaggaataagacaataaaatccccattgcagaaggaaccctagcagcagtgggcaaaagccttcaggatgggaagacagtagaaaggagaaagagaactatctgattaatatcccagctcaattctggaaactgactatgagatttagctctaataatgttgagcccattctacagatgagcaactggaggcttacaaaggttcaataatttgcccaaacttacaaaactaggaagtggcagagtcaggatttggattcccacatgtgagatctgatgagtctctagtctcactactgacactatcaaaaagggaaagaaaatgtgaggtggaattatgcccaatgcttcctggaggaggtgacaggtgactctcgtttggaaagcagagaaggtgacaaggagggaattctagacagagaaactgccaaggtttgtggtcaaaaaaggaagcatatgtagggcccagaggggcttcagtctgatgggagcagagtaaaaaatagaaaattaaaagttaatccttttcttatccctgtatgaagattatattggaatcctcaccatgtaagacaagagtgcctcatggaaacagcaatggctttggtgtcagagacttgtcctcagatcctgattcccaacttaacagctgtgtgtctttggataaatgacttaatctccccaacctcaattttgtagcaaggtaaagtatctaatggtttgatgtacacagtaagtactcaacaattgttcatttccctttatcccttcctttcactgatggacatgagggtagaaatgcctagcaattacccttgcatacagattctaagcttttagaataatatattgacttcatgctctagatattatcattcttggattgtgcatgtgtgcccatcctttaccaaaaaaaggaggaagatcaatggcaacgagcattcactgagccttcagatgccaggtgctcaggaaagctagtgcttagcagagaaggtgggtgtcctagatgtcattgtgcagattcaaccactgatgaaggactgaggcccctggtcctcctacaccccctggaatctcagaactggtcagggtcagagaccagatagttcagagttctgaaactttatgatgatttatcctccatatttattcaccacctgagccaacaatgactatctttcatgaacttgaattatagtttgacataaaatatttttgtatttatttttaaaagaaaactttatatcacttgctataaatagaaggaaattataaaaattagtaaaatgaaaaaagagaataaaaagagcctaggtcttgctctttttttaagaaagaaaaagagagacagagagagaaaggaagtgagggagagaaggaaagagaaaagaaggaaggaaggaaaatggaaaggaggaggtagtaaaggcaactagtagatgatagagaggtgttaaaaaatattctgtccctaaaataagattttctgtttttacccagaaagatcaaaagaatgaaaaggcaaaaaccttcatcctgtgtgattcagtgttatacagtgtcctgtttctccatttactttctaaaaacatctcatgaacaaaatctatgtttgggaaaatgcagacccagacacacattttgcacatgggagactgaggtcaggtttgaggatctccaattcaagtccagctgcacagaaatgagctgatgtcctctctgctccctttccaagtaagcacagaagcctaagggatacttctcttatttctgcctgtgtcatcccataattatttactggcagctctggagccttgaggtaaaagtcttttcattatttatagaagcacagtttttattataaaggtaacataaccacagcacctcacttgaccaaaaaaaaaaaaaaaaaaaagatgaaaaagctacccacgattccactgctctggctcattggtatattttcagtcagcatttcttttacgcatttatttacataagtgcaaccacaatatacatacctttttttagcatcttgaatggtcttgtccaatctcctgatataatttgtgcctgttcatagcaaaagccttgggaaagaactgagtttcctctgtgattactttcctgtctgtccctcagttctttcatttgcaaaacgtgagaaatactatcatacttgcaccccaggcagttgtaagggttctcagagagagagtatatgtgaaatacttggaaggatctgacttgtacctaccttttgcacatcatcccctgcagtttcttcctatttgtaggcctgttgttcagtgtcatcattctgcaaaactcctatctatttgtcaaagccctattcagatgtgctctcttacaggaaaccttcccttcttcctgaaatgctctcctatattatgcctgaagcctatccatgcatctaatgtgtttagcatatggactctaaatatgcaagtgtgatacaaatacattcattggtcaaaaaattacagatgaagttaaaacttctgaaagttttaaccacccttctccatgcccaccaagaaaatatcttagttgtttccactactcaacttccaggttaaccaccaagttgacacagatttataatgtctctcacacaactgtgtcacactcaacgtatcattttcccattccgtgtatgtctcagaaacctaagcatattagaacatttagattatctaattctatctactgcttgtcacaatttatttagctacttctcaacatatatgctgctacatccttgtacatgccttcctaggcaattttcatttgtttgcttatccactagttagaccgtgagtccttcggggataggatctacatcttatttatctcagcagtcctttaatttagcagagtgcctgttacaacaaaatgcctaataagtagttggtgaataaatattcaccaacttattaaatgaataaggagaaaatcaagggacccttccagaatctagacacagaaacgagaaggctttcctgatctttcttcccaaaacattaaccttgaagattcggagcatggttcgttttccacacggggcatggccaggggccctcagttatttcagaagagtacagctgcttacagaaaacagactgcctgtcccatttacctattcttgtgcaagtgcccagagcccttaggcacaggcaaaggggatttaaataaacctaggaaataaataaataattgcttcgaaatagccaaatgggatatttccaataaaccatttccctacatgagagaaggaacatgagggggaacaatgcccaaagcagcaaatttatgaagaagctacaaagttaacagaaataggaggtttgcagagaaatatgctgctttagcatcccatcttcagggtattgctggagttttcgtttcttttatgaggcagtcatgaagttggaaacataaacaacactttaaatcattatttagcaagagaggagcaatttatttgcttagacaagcctgattgctgccatgataatgtcccttgttcatttgttctctctctccaagaagctggaaatatttgatagattgttacagtctgtgcatttaccatggcacaccgttatatcagattatttaatggaggattccacttcagggttgagacagcacttcctgcctttatttgtgctcgctcttcaactccgtctttcctaaccagctctactgatttctcagctctcatcccagcattacgtcctccagaaagtcctcagcaccatggagaagtatattgtatggactatcagcaccatgcactgcatgtgtgagactgtcagctacacaagactctgagtctcacttttggaattcataaaatagggagaatactggcagccccatcataaagttcatgtaaagatcagacgtttataaagtacttgccaatagccactgcccaagaaattacagtcacagtaataataattgttattatacttttcaacacctgatagtctctctatcaaagacaagctgaggtctcttgtctctatacccacagcatcctgtgactgcctcattgtgacttttattatattgccttgttgtcatctatatacctgcatttccccctagctgtgctcttccagagagcctactttctccatgaactccaacaaaattctgacctttagtaatgtctatgcattttctcttctctattttattttatctgcacaatgaagctagagattaagctgggtaactttttaactttctttagatgcaagagaaaatgaagttcaaagaggcagagtgactcattagggtcccccaggtttgatgaagtccaagtcctgattgaatctctctacaccacaaaataaccttgttattatcccttaacacactggccatcttaactccttgtttgctaaaagggcaagagaaaaccctattaaaaactgagaatatggccgggtgcagtggctcacgcctgtaatctcagcactttcagaggtcgaggtgggcggatcacctgaggtcaggagtttgagaccagcctggccagctggccaagatggtgaaaccccatctctactaaaaatataaaaaaaattagccgggcgtggcggtgggagcctgtaatcccagctactcgggaggctgaggcaggagaatcgcttgaacccaggaggcggaggatgcagtgagccaagattgcgccactgcactccagcctgggcaacaagaacaaaactccctcttaaaaaaaaaaaaaagacagaatatttcattcagcctgatcggaacaaaaagggagaaatgaagttagcagtaacaaacacttacgtatcacttaccaggtgccaagcactgttttaagcacttgacgaatgttagctcacttaatcctaatcaaagccccaggagtgagcactattattatccctatagtatagaggtggaaacagagacactaaacactttaccaaagtttacgctgccaggaagtggcagagctaggattcaaacccaggtgtctggatccacagcctgttctattaactgccattaacattacaactccatgaaatgtacatatcaaaaatatatatctgcatgtaagagaaacacttcctagctctctcttgggtttctgagaattacagctactattctgggaaagggtactgatgaaattttagtcattagatacttttcttcttttcatcagaaaagaatccagaatccacattagtggcttccaaaagctgatccatggaccttttttagtctataagtatatatatatatatatatatatgatgagatagtattctctttccaagtaagtataggaataagcacataaatatcctattaaagttagttcaccaccaccacatctccagttgaaaatgaaaagtgactagagctctgcttcctttgtattagcttctagggaaagctcaagaccctctctggcccactctgaatttcccaatttaacacaatgagcaaaaccaagtgagagctcaaattctaaccagatttgttaagctatttcatttaatagcagcactccaatatcctttacttgtctttccactcccatatgcgcagtccctgtggttcacctggggctgcacctcttccagtcccaccagaactgggcacaggctcctgccccagccaatcagcagattacttctactccctgccacggtgattggctgaagaacaagatccagctgaattactttgtttagaggcaataaagagacagatgtttgctgggactgttgggaaagaggtatttgtcttcagtggaatggcttatggctaggccataatcccgggtgtgctggtgtgtccggaattggtgggttcttgatctcactgacttcaagaatgaagccgcagaccctcgcggtgagcgttacagttctgaaagatggtgtgtccggagtttgttccttctgatgtttggatgtgttcggagtttcttccttctggtgggtttgtggtctcgctggcctcaggagtgaagctgcagacctttgcggtgagtgttacagttacagctcataaaggcagtgtggacccaaagagtgagcagcaacaagatttattgcaaagagtgaaagaacaaagcttccacagtgcagaaggggacccaagcaggttgccactgccagctggggcagcctgcttttattcccttatctggccccacccacatcctgccgattggtccattttacagagagctgattggtctgttttacagagagctgattggttcgttttgacagggtgctgattggtgcgtttacaatccctgagctggacacaaaagttctctaagtccccactagattagctagacacagagcactgataagtgcatttacaaaccttgagctagacacagggtgctgattggtgtgtttacaaaccttgagctagacacagagtgctgactggtgtatttacaatcccttagctagacataaaggttctccaaatccccactagactcaggagcccagctggcttcacctagtggatcctgcaccggggccacaggctgagctgcccgccagtcccacgccgtgcgcctgcacacctcagctgttgggcagtcgacgggactgggcaccgcagagcagggggcggtgctcgttggggaggcttgggctgtgcaggagcccacggctagggggaggctcgggcatgacgggctgcaggtcctgagccctgccccgcaaagaggcagctgagtcctggcaagaattcaagcacaacgttggtgagctagcactgctgggggacccagtgcaccctccgcagctcctggcccaggtactaagcccctcactgcctggggccagcggcaccggccggccgctccaagtgaaggacctgccgagcccatgcccacccggaacttgcgctggcccacgagtgcactgcacagccccagttcccacccgtgcctctccctccacacctccccgcaagcagagggagccggctccagcctcagacagcccagagaagggctcccacagtgcagtggcaggctgaaggtctcctcaagcatggtcagagcggacgccgaggccgaggaggcactgagcgcgagcgagggtcaccagcacgttgtcacctctcactggtagcagtcttgcctccaggggaagagagtctgacagagaatggagactacatggagaaaagcagagccaagggacaaggagacaaacagattcctgacaacatcacttgagcctctggactcaacctggctggaagggtcttcagcaattctttaatgaagaaaaacggaaaggccaaccccatggaatatcttctataaatgggacatgtatttagccctaagttaatgaactaggaaatagtgtgtcgttattattttatactgtggggtcataatgtattttaaatatttcatagtcttaattttctgggtcaggctaaaacaaggctaaagctaccttaaaatacagagtcgaattttgtgggtctcagtggcctagttgtacagcacatgaaccgattataaaaacaatctctcaggagacttttggctcatctgtggaccatttctctatttccaagtggattgggtggacctcgggttgagacactggtgtctcacaggatgcatgggctcctcccccagctcactgggcactctgtcatgggctggcttcaacctggcaaaacgtaatggctgcccttaaggtactcaaagagggtgatctcaagctctcccctacccactatctcccaaaattttgaaagaaggaaactgtattgaggaaggattttgtgaagtgcagttcatcaactctccccagtagtcaaagatcgacctcttagaccagataagatcattagaaagacatgcatttgtggctgggcaccatggcttatgcctgtaataccagtactttgggaggtcgaggtgggcaggcagatggatcatttgagctcaagtgtttgataccagcctgggcaacatggtgaaaccctgtctctaccaaaaatacaaaaaattagctggtgtggtggtatgcatatgtggtcccagctactcagtaggttgagatgggaggattacttgagcctgggaggtggaggaggcagtgagccatgagtgcaccactgcactccaatctggatgacagagtgagactctgaagaaaaaaaaaggcatgcttttgtattgccctccaaaaaagctgccttcattgaactgcaagaaggggagcagcatacaatgaaggtctggatcaggaaaagctgtaaaaagatccattcactgtgaggatgaccccgttgaagatgctgtggaagatactactcctcctgatatcattttaaaagagaactcctgggaaaacttctgaatggttacggttttactgagcaatgggatgctttgtttttgtggtctcttccaaacatgatactttgtgtttctgatgtgttcctgttgttgtgttgccagcttaggcagagagcttggctgagccacctgcagagaaagtgtgttggtcatgggaggctcactcctgctccatttaggtttccattttagttttcctttcaggcttggctcccaccattaatgttatgtatcactataggctactcaagttctttctggaagaaggcctcctataaaacagctcagtcagagaatgcttaaaaacatagttatagagagacagctgggccctgtgggctagtgacaagcaaacatccctctcggagaattttatttctatctggacctttatatgccccactatgatctgaagggttatcatcactatatctaatacaagtgggaaggacagatgaaagtattcttctcttaagtccattagtcctttctcatcttctggatccttcttagacaattctgtagaatctttgtgttggtgtggatctcagagttagcttgccctttgtttttctcctgatggggaggatcatggccactatgtatgatctcagttggcatcatctgctgtttccatcatgaagcctctggggatgcccttcagcacactcttattggacaggcctgtgtccggaattggttccttctggtcggttcttggtctcactgacttcaagaatgaagctgtggaccctcatggtgagtgctacagttcttaaagatggtgtgtccagagtttgttccttcagatgttcagatgtgtccggagtttcttccttccagtgggtcatggtctcactgacttcaggagtgaagccgcagacctttgcagtgagtgttacagctcttaaaggtggtgcatccggagttgtttgttcctcccggtgggttcatagtctcgctaacttcaggacagaagctgcagaccctcgcagtgagtgttacagctcataaaggtagtgaggacccaaagagtgagcagcagcaagatatactgtgaagagcaaaagaacaaagcttccacagcacggaaggggacccaagccagttgctgctgctggattgggtggccagcttttattcccttatttggccccacctacatcctgctgattggtccattttacagagtgctgattggcccatttacaatcctttagctacacacagagtgctgattggtgcatttttacggagtgctgacttgtgcatttacaatcctttaactagacacagagcgctgattggtgcgtttacaatcctttagctagacagaaaaattctccaggtccccactcgacccaggaagaccagctggcttcacctctcaggcctagtgttcttctatccatcacagcatatagacattcagagagtgacactactctgggtaaaacactgccctccttctcacttttgccttcattcctagctgttaagaggtcagccaatccatttcaccacactcatcagtagaacatttccaccatttctggaaaagcacctttccacttcttcagagaggattttacaacggcacttctgcatcccttttcaaaatctacctacctatccattcaaacttgggcatatatttatggaaggtttctgtgtgtcaggaactgtgcaagggagatttaaaaccccacttactccccaggagtttgacttacagcagaaaatgaggttcgtttccaaaaggcaaggacagaaagacttggagattagatgtgggcactactcctggctctacatctagctatcaactgtagacaggtcacactttcttggcttcagtgactgagtctataaaatgagggtaataatgattccttcactgagttaagataaactaacattactaatcacttactatgtgccaagtactggtatgtaggtactgatgttttccccatattacaaaagaagaaaccaaggcgcagaggagacaggcccaaagtcatgacaccaataaatgtgagctcgaggatttgcacttaaggctatgtgactccagaaataatctactctcctgaagctcctggaacacagtggccctcaagcacatgtgtttgcattttccctctgcttcgttttcctctgctttatacatttattctcttcccctctcctctcctcagtgtgcttagagaaaaggtctatgaaagacacattgcatgtttctaaccattcagttttctcttggattcgtcttcaccggtactaatagcacacagcactcagagaacccaaccatgatcgattttacagtgacctggaaatttcctccatctattcctggccctggggcagaacctcacaaaaatttactgtagaagaaaagcttctcctctactctgaaagcccctggaaaatcccataggcttcatctgttacccacattctaaagttcaagtgcataaacagcccaggtggagaaagcagatgggagctattatctattaagaagatgtaggaggtgggctttggaaggccaaagcacctgaatctttaggactctgctactaagtgtgactcagtgatcaacatcaccttggaacttgttaaaaattcagactctcaggacttaccctagaccgactgatttcgaatctgcatttaaaactgactcatgtgcccatggaagtgtgagcactgttgctttaggaagaggtaggaggatgtgtgaaacgagcaggaaagtgcatgttctccctataaactggtgatagagatagatgtgctcgactttacacaaatgagtgattggtgagtaaacagtacagaaattacaggggactttaagaaacattaacaatttaaaaatactgcttgcatagacaaattaaaaacacaggcaaggcataaactgaagtatatcaacctgcaccctgaggatgctactaacatgatcatgaaactgttggatatattaatgtgtttgtcatatgatattttgtttatatgtgtttgtctcttcaagattgtggatctccttgaggtaaaagactatattatttctctttgcattcctaaaggctgataataaatgttttaataatgaatgaggccatgtatggtggctcatgcctgtaatctcggtacgttgagaggccaaggcaggatcacttgaggtcaggagtttgagaccagcctggccaacatagtgaaaccccatctctactaaaaatacaaaaattagctgggcgtggtggcatgtgcattcagtctcagctattcaggaggctgaggcaggagaatcacttgaactggggagacagaggttgcaatgggcagagattgcaccattgcactccagcctgggtgacaatgagactgtctcaaaataataataattaataaaaaagactggttcagcaatggtgaagtaaggacctcctaaagtcctctcttccataatagcaacagaaagcataataaactttttcagatctctaaaagttaaccacaatttggaacaagctgactgtttttttttctttttaaattggctgaattggtaagaacaatgagctttgttgcattttaatttgcttaatcctattcctccaatgccccctcccccccacctcatgatagccttaaaaaccaatggctccaaaaatcacagtgaaaataagcagcctataagtctttggaggagacagaatggagctcctccaaagcccacttcccaggtagctgtcatcagttggtctgtctggtgattccctgaaaaaatttcacttgcaggacttgtctatatttgacctgactcagaactttcccaaagagggcagacttttccctcagagaagtttgttgaaaacaagcagtggcaattgttaaacactgcaggtgcctgagctagcaatatgagttggggaaaataagaagttaagcaaaaaacttaaaaggaaaatctgtgctacagggattttcctacatattcctgggaacctagaaaaccaagtgcatatcttgtctagggctgggcacatgcccagagataagtgcatacccaataaagacccgagagagccctaagctctcaccttttgatgattttaagaccctaagtaagatgtgaagacaaagatgagttataaactagctgcctgagcattaaagttatgccctgtcatgcacacagagacctttatcaatgactgaaagacttattggtcccaggaatttaagacaattcctgtccaataattagctgaccattaaactaactgaacacagacttaagtgggcacacatgaaaaggaatacagaccttacagtgttaattcagaaaattcatttaaaaattacataaacaacgaaccctgggggatctaatttctgaagttgacacattttatttaaaatgtccagtttcaaaaacaatgagctatgcaaagaacaaaatgtattacctatacccaagaaaaagaaaataaacaaaccaaaaaaacagtcaacagaaaattgtcaaaaaaaattgtctgtgaggaagcccagatgtagaactttctagacatagattttatgcctactatcttacatatgtccaaaacactaaaggaaaccacatacaagaactaaagaaaatatgaaaacaatgtcataccaaataggttatattgacaaagacagaatctatatgtaaaaaataaaataaaaaataaagtgaaatgaaaaattcatgagaagtcaacattatgcttgagctggaagaataaaaataagccaacttgaagataagtcaattgagattattcaaattgaggaataaaaagaaaaaaagaataaagaaaaacgaatagagccctagagacctgagagacaccatcagtgtagcaacatatgcacatggaagttccagaggggagaggagatagaggaagggtcaaaagtatttgaagaaatatggctgaaaacttccaaaatttgatgaaaaatattcatctaaacacccaagaaagttaactaaatccaagtagataaacttagtgaatcagagctagataccacataataaaactctcaataggcagaaactgagaattttgaaagcagcaagagagaaacaactaatcatatataagtggtcctcaataagattaacagttgattacttatcagaaaccaaggaggccagaagagtgtaggatgacatatttaaagtgctgaaagaaaaaatactgtaaaccaagaattctacatttaggaaaactattcttcaaaaatgaaagagaaattagggcatttccagatttaaaaacaaaacaaacaaacaaacaaaaaatttgctgcttgcagaccttcactacaagaaatattgaaaggagtcttttaggatgaaaggaaaggaaattagacagtaaatcaaatccacataaggaaataatgacatcggtgaaggtaactacatagtttacatatacaagatattagaaatgtattttttgtttgtagctttttttctatctgatttaaaagacaacccatgaagaaataattataaatgtttgtgagcatgcaatgtataaagacacagtttttatgataatggtagcacaaagaagagaagagagaatggagctatataggagcaaaatttttttgtaaactattaaaatgaaattgatattaatctgaactagactatgataaattaaaagaattaattttaatccccagaaaacaactttaaaaagtagtttaaagaaaggagaattaaagcagtgcactagacaatctatttaatacaaaaatagacagtaatgaaagaatggaggaccaacgaagatgttagacatatagaaaacaaatagcaaaaagacagatgtaagttttataatatcagttattacattaaatctaaattgattaaacactccaatcaaaaagaagaatttagaaaaataagagacacagtttaggccgggcgcggtggctcatgcctgtaatcccagtactttgggaggctgaggcaggcagatcatgaagtcaggagattgagaccatcctgtccaacatggtgaaaccccatctctactaaaaaaaatacaaaaattagctgggtgtggtggcacgcacctgtagtcccagctactcaggaggctgagacaggagaatctcttgaacccaggaggtggaggttgcagtgagctgagagcatgccactgtcctccagcctggtgatagagtgagactccagctcaaaaaaaaaaaaaaaaaaaaagagagagagagacagtttagatttaaaaacataaaaagattaaatataaactatagaaaaacatgtaccatacaaatggtaaccaatagagagctggggtggccataataatatcaaacaaaatagacttaaatacacaaattgttacaccaaagggcattttatgatggtaacagtcaatccattagaaaggcataacaattataaacatgtatgcaagtgataacagagccccaaaatacatcaagtaaaaagaatcaaattcaagggagaaataaacagtttaaaaagaatcactggagatttcaatatctcatatttaataatgaatagaattactaggcagaaatcgataatgaaacaaaagacttatacaacagtatagttagactagacataacagacaactatagaacaatccacccaacaacagcagaatgcacattcttctcaagtacacatgaaacacttcccagaatatagtatatgttggacaataaaacagatttcaaaaagtgaaaataattgaaataatacaatatgtgttctctaatgacaacgtaataaaattagtaatcaaaattagaattttgagaaattcataaatatatgaaaataataataatacattcctaaatcatcaaggggtcggaaataaaaatcacaagggaaattagaaaatactttgacatgaatgaaaacaaaagcacaacatatcaaaacttatgagatacagcagaacaagtgcttagagaaaaatttacagttgtaaatgtctatattcacaaagaagtatctcaaataaattacctaaacttccaccttaagaaactggaaaaaaaatagcaaatgaaccgtaaagtaggcagaagaaggaaaataatgactacagcagaaataaatgaaatagagaacagaaaaacaacagagaaatcaataaaaccataaatttactctttgaaaagatcaacaaaattcacaagcccttagctagagtgacaaggaaaaaggagaagatgactcaagttactaaaatttggaatgaaatagagaacattactagtggtcttaaagaaataaagagaattataagaagatgctatgaataattgtatgtcaaaaaattagataacctagatgaaatggacaagtttctaggaagacacaaagtattaaaactgagttaaaaagaaacagaaaatttgaatagactttagcaaataaaactattgaattagtaacaataaaccatccttgccccatgaaaaagagtatgatcaaatgccttcactagtgatttctaccaaacattaaaagaagaatcaatactaatacttcaaaaattattctccacaccaggaaaaagaatatctcccaactcattttatgaggctagcactattctaataacaaaatcagataaaaatatcagaataaaaaaactacagaccaatatccattatgaatatagatacaaaatgccttaacaaaatactagcaaactaattcaataacaaataaaaaagtttatacaacatgaccaagtgagatttatcccggtaatgcaaagttgattctatgaaatcaatcaatggaatacatcacatgttaatagaataagaaacataaaacctcctcttgagtatttcaataaatagaaaaagcactgacaaaacataccacttttcatgagaaaaatactcaacaaattagaaatagaaggaaacgtcttcaatctgataaaagatatctattaaaaacctacagctaacacagtccttggtagtaaacgactgaattctttgccccacaaaatcaggaacaaacaaagcaaggatgtctgctctcacatttctattcgactttggactagaagttctattcaggacaatgaggcaagaaaaataaataaaaggcatctgaactacaaaagaagaattaaactatttctgtttgcaactgacatgatcttttatacaaataatctcaaggaagtcactaaaaaactattagaactaataaaacagtttagtaaagttacaagatacaaggtcaatattcaaaaatgaactatagttctatatgctagcaagaaacattctgaaaaaattaaattaagaatataattacatgtacaatagtaacaaaaacatccccaaaggaataaatttagtacaagacgtacaaggcttgtacctgacaactacaaaacattgttgacattaacttttaaaaagttaaataaatattaagacatcctgtgttcatagactagaagatttagcattgttaagatgaaactacttcccaaatttatctacagagtcaacataatcaaattcctagttgtagaatttacaaaaattgaaaaccatgatcaactggcttcaattcgatttgtattctcagttttctgcccaaactacacagatgggtttcaaatataatgagaaggttgtagaaaattcatgataatgttttctgtattttctcttctatctaagctttcgggctagaaggggtatgtcattcctacccacaaggaatatgaatatgtattcattcacctaacaattatttactaaacaaggttctacgtgtcaaactttgttctatgagctgggaacacagtcatgaacacagcagaaaataaatctttcttcttgaggagcttacattccagtggggatacaggtaattaaaaaaaataataataaatacatagtatgccatattgggataagttctgtagagaacaattaggctagataagaagaggaagagaggaagagagtgtctggtagatggtgaaggcattgggagtgggtggctggggtaggcattagctgaaaaattgaaattcatggtggtattttcttgctctccaatctattcccatccttgccaatacagcagctgaaattaagtgttctctgcttggaaccgcctcagttttcatttatcaacttctgctttgatccatccaacactccatccatccatccatccattatccatccatttaattattagtccatccaatcctcagtccatccaaacttccatccaaccatccatccaaacatccatccatccatctgtgcatccaaccatcatccatccatccatccaatcacatttcatcctcttactcattcttttattattgagatataattcatataaaataaaattccctcttttaaagtgtaaaatacagtggttcacaaagttgagcaaccattaccactatgtattttcaaagcattttcatcactccagaaagaaaccccataccaattcactatgctcaacagccctagtatttaagtccctacttaggaggccagagaaagaaaagaaactgggactaagaatatgcaggcaattcagctctctatctggcattgagaaaagtagggcattgggtgggatatcctgaaaccaggatctgtttggatgtattggtttcctctatgaagactgagttgccttctttttgttttttcattgtcatgcttcctggtgcagctgccttcatatgtgcctgcctctctaccccagtcaaggctgcgtgcctcacccagtggggctctgcactgctaaatgagcttgcaggattccactcagctgtcccattctcactgtgccaatgtggcctgagtctctcatgcatcttttgttctctgactggctcacttcctcatcctcagctctggggagcttcccacaatggtggggaatgttttgaagcttggaatagaaaggcaatatgcagtcttccctcggctggctgcaggaaagaggcaggtggcagaatgtgtgggtggcaagctcagtggggaccaagctggcaggagcagacgtgactgagaggacaaggaggagcaacagcagagacagtctgtgacagaggactttgaattttctgcccacactgtgcatctccatgttttcagccttcacctgcgcaaaccctggatgctgaggccaacaccctgcttgggaatgaggcttctctgcgggtttgcatctaggctatagaataaaattattgcgtgtagtaacaaggctggaactacagtgaggtaaatgagacactcactttgggcacaaagtttaagagggtacttgtgcacaaatgctcataacagcattagtcataatagcaccaaagtggacaaaacccaaacatccataaatggatgaatggataaacaaaatgtggtatgtccatatgatgaattcttacttggcaattaaaaagaataaagtactgatacatgctacaatgtggatgaactttgaaaacattatcgtaagtgaaagaggtgggacacaaatggacaatttcatcatattgtaccatatgatatgatagcatctatgcaaatgtccataataggcaaatctacagagaccaaaagtagattagaggttactttatgacgccactaattcaggggatggaggagtgatacccaaagggtatggaggttcttttgggggtcataaaatgtctaaatttgactttagttatggttacacaactctgtgaagataatttttaaaaacattgaattgtacactttaaatgggtgaactgtaaggtatgtgaattatatctcaataaagatgtaaaaaacaaatgtaaagatctcagcaatcaaggtaaataatattttaatgcaataacatctcgatgaaggtgtcagggagggctttaataagcaagaaacctctgagctgagcggttcagaatgacaaggttagggaaaaggcatcacagttagtggaaatagtttgtatacaggtaaagaggcaagaaggggtaggccacagtgaaggggtggaatttcttacagcagttttttttttttttttaccatgatatactcttgaggatggagacatgagctgaggagggtgggatcaaaaaacagaaggcactttgggtcccctatgacaccatgacactgttacacccgtcttggacagacataagagaaaaagaaacatctgtctgctttgttagttgggttttctgttttatatgttgaaaactaagtctaactgaaacaccgccactcaccatttactgagttcttactatgtgacattgatcggctaaatcctttagatgaattgactcatcagtgagtctatgagtgggtacagccattgttctcatttcagtcaagggacctgaagctctgaggaattgagcaacggtcccagattccatggttactgggaggtagatctggaatttaatctccatctatctgacccgaaagccaaaactcccaccactgctctgtaactgtctcccactgagcgcaattaagctggcgtcacacactctttcctgttggctggtgctggcctcactgtagtttagatggtaacctcgtgtctgattgcagaagaccactcatcctggatgctccagctcttacagctctgtccctggcaactgcctggtaacctatccactcctaggcagtgatctcagactctatgtgctttctttgagccccctcttaagggctgacttcctggagcctgaatcccatctctgggcctggggccctgattcccctcgacaggcttatctgatgctgacggctccaccctacagccccatttctatccagttccctgaagtgtgggcaagcgctgtcccaaggacaccagtccatcaggctactgctaaggttgcctcctgaggctggggctggatgagctggtccattactcaaaatggccagaagcagatgaagccagagtccacctaagcagactctaaaatttaaatacaccataaggaacaaagaaaaacttgtggaccaaagtcaaaagagataagtgactgcagaaacaaagaatgatgggggaagcaaaatcaaaaagaagtaaaacaacccagaacttttgcagtggggatgtagaggctccttcttcatgagtggctcaggttagaacagcagcctcagtgcttggccagcctgtgggaacatctatgacttcatcttgggctcccagtgttgatccttcgctctgtctcactccttggacacagtgtattcttacttgactgaagatctccagctcttcgggtcaccctgagccacctcttgtctcaccctgtgaccccagcctctttactccacccagttctccttatgtaacctgagagcttactaggtgttaagcacaaagtccagcaccttcatagtagctaatgtagccctcactaggatccaacagggtaaatataatcatcccagccttggacactgaggtacagtccagtgacttgctcaagttgacccagctagcaagtggtgaaattgggattcaaattcaggtttgtctgcctctaaaacctgtgcttttgatcattagggagtacatgctatttcattttagtcttcagatctcccccaggccagccactgcatgacacacttagttcctgcccacagctacttggccacaggttgttcaaaggtctgggctggaatggccccaggtaactgttcactactgagctgtgcagaatagaagcacagccccatttcaccagcccccagctatcaggaggggccacgtattggggtcatctccccaaaccctcctggccatttctggttgtgaaaatacctggagctcactaaggctgttgtgcagtgagtgtagtgggcaggcatgagatgggcctattgggagaatcaacaggaagaaatggaactttcagacagacagtggcctccaggcaggggttcctccttgaaatccatatcagaatcttctgtaggacttcataaaacacgacatgtgccaggagtcccaccctagaaattcagatgccatgcaggtctgggcgaagagcatttaagtgaaaggacagcagatcccatttgtctggctttaaatccgtgctctatctctgtctagtggaacagccttgggtaagttatctcacttatctgtgctcaggttcttcatctatatttcaggataataacttacagggtttttgtgagggttaaagaaacttagaaaataacctgaccctaagtaagcatgtaagggggtgagttgttataatcacttactagctctagctgtaaaattcttcataagttagttgagaactatggcaaaaggaaaaagcaggcatagtagaaaaacccaggcttgggtttagacagacctgtgagttgtgtgaccttgggcaagccacttaacctctctgagccacaactgtcccacctgtaaaatgggaatagctaacatgtagggctgctaaaaggactgctaaaaaggtaataaaggtacaggtcctggcatagcacacagcacatagtaggtgctcaacaaatcacaggtaatatttttaaggcattctagaatagcagcttagctaatttcaactgggcctggtggttttaaaatttgagtaaccatttattctctttgcctagatgaaataggtcctctgcatttccaaacaggaaattcatatttgcttgtaatggcaaggccatccaccaacaaccagtatgcttagaacttcaggtgggaagtgttaatgatacaactttaattccttggcaaagagtctacccatcacttccaggttttcccagcacactaaaccgcaagggaaggaaaaaccacggcattattcacagaacccactgcttctacaaggtttgtttcctgatgtttctagctgctcctcctaagccctagacaatgtctgggacacagagacagttgctatggagatgggggttttcccacagggacagccaataataacctcttattcagagaggcttatgtgttacacattctgcatcagtatggcagattttagcagtgaaacacgtaaattgttcaaattgacgtcatagcacatcaaggctggcccctgtgtctaccactcatatagaactaagctcatccagctttaaatggccttatgtgtcaatctgtcttaaataccccatcccttttttcctccctagaacaaagggacgaatgaaacacccatatacacactttttgtctgtgtgtttttctctccatcttctgtcttcatttaaatggtaagctccttgaacttggggaattcacttttcacttccctcgctttcctacagtcccctggtggcaggcaagatagagcagagagagttaggcagcctccttcagctatcacatagcagctgtgaaccactgccagacaattcatctcttagagccatggatttctcctgtaaaaggggagttaaatgtagtacttcccaaagtgtagttaggaatgaatgataccatttatgcaaagtgcctttcagttagtaagacctcattcaatgctgtctcaaaatcattatttacagtcaaagcatttgttgattgacttgattggtagacagatttctcaggatatgttatttgcagaggcagaacaaaaaattatcaaacaacgtaaatgatggaagactaatagtctctcggccacctcaggggattgagggagatgtgggtaggggacaaaacccagcatctcttctaagctaggagccaagagcacatcttttctagtaatatgtcacaagttactctgtaaacgagatattatagtctctgttttgcagacgggaaaatgggaaaaggctagacagcaagctcatcacagcctgttttttatactttttggacactcatactgctaatcccagcctgccttgcataggtgtggccaaagggatgagagggaatgtgctctgtttggatccagtgcatcagacttgctacacacacctccccactctttccccttcagacagaaatcagagggtcccagaggccgagagtagggtttctcaaaccggagctgcatcacgatctctgaaggccatgtgaaagcccagatttctggaacccactccagactttctgattcagcaggtctggagtgaagctgaagaatcttcctgtctagcaagcttcccaggtgatggtgttggtccaggaccacagttggaaaacttctgttctagggcatggcagagccacaagatgaatactgggtctctgaatcaccatacggtgtaaagactcccactgagtttcatatctaaaaatttttcttacatatcagaaatttcaagatttatttattataactgctagcaggactctagaaaaggaaggctaaagaaaacattttctccatgtgaaaatgggtggctttatagaaaaggctctgaagggaaggaaggaaccctgggtttcatatccagacctcatcacctcaaatccttcagtaagcaccaatacaatttccattgactgcagtcataataccaagtgccaccttcaaattccactaaacataaaaaaagtggctataatccattactagaaaaactggcaaagaaaaaattccccatttaaccaaggcccctaattatgttaaaccttcaacactcaaattcaggcataatccttcctcctgattcccattgccattatcttgactctagagtaaacattgtgactgaaaggtattgcccacgtcctctgtgccaggcactatttaaggtctttgcacgtatcctggcacttaatcctaacatgtatttcctggaggtgttgcaatggtttctgctgacggcttgcagattaatcttctcaaaccaacactttgaacaagtcactctcataatcaaaacctcagggcctctttatggcctacagtgcaaagtctaaactactcagcatgatcttaaattctctccaaaatctcatacataactacttatcaattttaaaactcttactacagtctgcatctgtgactcccaaatattaacgtatatatcagaactccctagaaggctgctgaaaggcggattcccaggcaccactcaaatctcctgaatgaaaatatttggtgatagcccaggaatctgcatttttaatagactatattctagaacattttaagttaacaaacagcaaaaataaccagaaaatacagagatcttccatatatccctgtccccaaacatgcatagcctcccccattctcaatatcctcaactagcatggcacaattgttacaactgatgaacctacagtgacacatcattatcacttagaatctatagttcacattagggttcactcctgctgttgtgcattccacgggctttggcaaatgcataatgacatggatccaccataacagtaccatccagagtagatatattgatctaaaaatcctatgtcctctgcctattcatccctccatgctccctccccaccagctactgatgctctttttagtgtctccatgttctatctcttctagaatgtcatatagttggagtcatatagtatgtagctttttcagattggcttctttcacttagtaatatgcatttaaatttcccccatgtcatttaatggtgtgatagctcttttttgtttgtttgtttgtttgagatggagtctcactcagttggtcacccagcagcgcgatcttggctcactgcaacctctgcctcgtgggttcaagagattctcctgcctcagcttcccgagtaactgggagcatgtgtcatcacacctggctaaattttgtatttttagtagagacgaggtgtcaccatattgaccaggctggtctcaatctcctgatctcaagtaatctgcctgcctcggtctcccaaagtgctgggattacaggcatgagccaccgcgccggccagctcatttctttctagtgctaattagtagtacattgtctgaatatgcccacgtttatttatccactcatctactgaagaacatcttggttgcttccaatttttaactattataaataaagctgctataaacatccatgtgcaggtttttgtgtgaacatcagtattcagcttccttgggtaaatactgaggagcacaattgctggatcatatgctaagaatatgtttcgttttgtaagaaactgtcaaactgtcttccacagtggctgtaccattttgcattcccaccagtgagaaatgagagttcctgttgctccacatccatggcccatttgatgttgtcagtgttctggattatggccattctaagtgtgtagtggcattttatttttatttttatttggatttccctgatgcaatgtatgcatatattatcatgtggaacatcttttcatatacttatttgacatctgtatatcttctttggtgaggtgtctattaaagtgtttggtccattttttaaatgagttgtttgttttctttgtatatttggacaacagctttttatctaatatgtcttgtgcaaatcagacagtctgtgcttgtcttttcattctcttgacagtgtctttctcagagaagaaatgtttcattttaatgaagtccagcttatcaattctttttcatgggtaatgcctttggtgttgcattaaaaaatcattaccatacccaaagtcatctagattttctcctatgtttcctcctatagttttgtgtttcacatttaggtctgtgatccatttttagttaacttttgtgaagagcataaagtctgtgtctagattctacttatttatttatttttttgcatctggatctctggttgtttcagcaccatttgttgaaaagactatcttttctccattgtattgccttttctagaatctgcatttttaaccagctctctcagtgattttggtgtatttagtctaaagatccacacattgaaagacatgtttttttacatatcaagttgttgtcactcatgagcattgaaacaaccgagccccctattgccaattagacttcatatcagagagaaattaccgtgtagtttaaaccactgctgtgacagctagcattgtcttaactaaggaacaaatcttgtcttccccactagactgtgggcctctaaagacaagggcccagtctcagtagcccttatatatttctcacctcctcctgacctaccctctttctatgacaaccagactttgttcaagagctggtagagggcaggggctcataaatatttgttgaaataaaatttctgtctttttgcattcagccaacagccagatgggtgggggtagggcaaaaggatgcagatcccaatccagacatatctatattactagaaaatttacattttgatcaccagctccaaagtgattaattgttgagtagttttcaagtggcccattttctgtgggaacggctttctctaaccttcccgctttcttattaaacacctgcagcttccctaggatttctaagctttatgattttcctgaaaaaaaaaaaattaagcagactttattattcagctttgccaaagtaatcaaagaaaagtttaacttgatgctgcgattaaagctttggcaatgggcgttgacgtcgccagattgaaactagtggtggggaaaaggctgtttttctaaaaataccaaattaagaattctccagtttccaactacatgcaagagaatctccatacgcaggaagtcctagtcacaggcattttattgcagaaatgggtactttttgttttcctaacatgctcatctaaggctgtccttctaagaactgtgtgtaacagaaggcaaaacttgcaccacctccctccttttatctcttactctggacaggactttgatcctctttgcgcctcagtaccttcatatgtaaaataaggagtctggattcgaaaatctggtgtgcttcttgcttttataaataaagttttattggaagacatacccattcctttaagtattatctatggctactttttttgttctctaccaagtcagagctgagcagcagcaagagaggcccagcaagtctgaaatatctacaatatgtatttttacagaaatatttgccagaatggttttgttacagaatatttttatagaatatttctttacagaaacaatttgccaacccttagactgcaccgttttgattgtaaaaatttaaaagaaagttcactcattcatttattcatttatactgaatttgtgtatttgggatggggcccagggatgtttactttaacaagttccacaggagatttgtctgcagtctgcacattaaaatttgggaagtgccaatccagtcaattgtgttacagcaattcatgagcctcttagtgactaagaaaagacaaggaggagtgatgtggctccacattccagcaagcatgtattgtgccctgatgatgtggaaggctaactcttctaggcactgcagatacagaaaagacaacctggacaaccccactgctgtcatggagctcatgttatttccatgaaccccttgggagtctgggcatcgcaaggcctcaagcaagagccattgctccaggacttgggccagtgcctgccacagggtggtcaagggcaaagggcaagggctttgtcacttacattatctaaccacagcctgaaacccacatcattgtaaagtggctgaccagagggctaaatggccatgggccaaaatgaaagctgccatatattacattggtcagtgccaagaaaaagatgggcttcttctatgaactgctttgtcatattttatttatttatttaattttcaaaaacacctcttgaactctgcaacccagcttgtttccatagtagccttggctgccatgcatttcacttgtagtaacttcccttaacctacacggaccactgagacctccctgcccttcacccttccttttattattgtactaattaatgttgttgttttaccagtttgtggccttatcaaatctatttgggaaagtaaaacttgaaaaggaatataataaatgtactgtagtgatgacagtgaaagtattctgtaaatattaacacttccaccatctctccaccctccatagctctccacccccgggaagctgattgcctttccttttctggatgtggaaagaaggctgagtgattcactgcaccgtagtgagtcaaagatgaaaacatgcaaatccggccctgtgacgtctgctgtcagcaggcttgagattggaatgggcatggtctttgttatcatcttaacctggctgatccttttgtgtaccctgttagatggtagttcttctcatttagtatctaaagaaactgacctgacagagggctcagttcctggcctgaatggaagcagaaccgagacattttgactcttctgcctagaaagtggctacagacatgccttgcacatgtagactttgcttcctctctcttactacgtctaggtaactactttggacatgatgcttaacctctctgagcctcagtttttaaatctgtaaaatggagagaataacatgcaaaatgcctactgcagtgtctgggatgaagtagattaacagtaatgtgatagttctcagaccttccctaccctgccattggcagtattcattgggagctgctgggactccaagggcatggctgtctatggaggtgaggctggaatctgggctgtgatcaatgaactcacaattggttcatgggcccacatggccaaagctaccctttctgtagccactgtctagctagaagagtcggaatgcctgggctttgcttcagttcaggccaggaactgagccctctggcaggtcagtttctgtattagtccattttcatgctgttgataaagacatacccgagagtgggaagaaaaagaggtttaatggacttacagttccacatggctggggaggcctcacaatcatggtggaaggcaagaaggagcaaatcacatcttacatggatgggggcaggcaaagagagagagcttgtgcaggggaactcctcttttgaaagccatcagatctcatgagacttattcactatcaagggaacagcacaaaaacacccgtccccataattcaattaccttccactgggtccctcccatgacatgtgggaattgtgggagttaaaattcaagatgagatttgggtggggaaacagccaaaccatatattccaccctggccccttccaaatctcatgtcctcacatttcaaaaccaatcatgccttcccaacagtcccccaaagtcttaattcattttagcattaactcaaaagtacacagtctgaagtctcatctgaggcaaggcaagtcccttccacctataatcctgtaaaatcaaaagcaatttccaggcccacggtgcaagctgtaggtggatctaccattctggggtctggaggatggcggccttcttctcacaactccactaggtggtgccccagtaggaactctatgtgggggctctgaccccatattttccttctggagtgccctagcagaggttatccatgaggttacccaaccctgcagcaaacttctgcctggacatccaggtatttccaaacatcctctgaaatctaagtggaggtttacaaacctcaattcttgacttctgtgcacccacaggctcaacatcatgtggaagctgccaaggcatggggcttgcatcctctgaagccatggtctgagctgtaccttggccccttttagtcatggctggagtggctggaatgcagggcaccaagtccttaggctgcacacagcatggggaccctgggcccagcccatgaaaccattttttcttcctaggcctctgggcctgtgatgggaggggctgccgtgaagacctctgacatgcgttggagacattttccctattgtcttggggatcaacatttgactctttgttgcttatgcacatttctatagtgggcctgaatttctcctcagaaaatgggattttcttttctaatgtattgtcagggtgcaaattttccaaacttttatgctctgcttcccttataaaactgaatgtctttaacagcacccagttcaccttttgaatgctttgctgcttacaaatttcttctgccagatactctaaataaactctctcaagtttaaagttccgcaaatctctaggggtaaaatgctgctagtttctttgctaaaacataacaaaaatcacctttgctccagttcccaacaaattcctcatctccatctgagaccacctcaacctggatttcattgtccatatcattttcagcactttggtcaaagccattcaacaagtctctaggcagttccaaactttcccacattttcctgtcttctgagccctccaaactgttccaaactcttcctgttacccagttccaaagttgcttccacattttcaggtatcttttcagcagcaccccactctactggtgggctatcaatttactgtattagcccattttcacgttgctgataaagacataccagagactgggaagaaaaagaggtttaatggacttacagttccacatggctggggaggcctcacaatcatggtggaaggcaaggagaaggaagtcacatcttacatggatggcagcaggcaaaaagagagagcttatgcataggaactcctctttttaaaatcttcagatctcgtgagacttattcactatcacagagcagcacaagaaagacctgtccccatgataaaattacctcccactgggtccctcacacgacacgtgggaattgtgggagttacaattcaagatgagatttgggtggggacacagccaaaccatatcagtttctttatatgctaaatgagaatatgtactctctaacagggttcaactagcctgccacccctttctacagaatatagtgctcccctccttgagcctccactatatctgaaacttatttctatattgtccatgttatatttcattcattcatcaaacagtgattgcatctgatgtgacacatgccaggctagggtctagacatacctgtcttcaaggaacatgaccttcagtagcagagatatgtcaacacataaataagtgaaaattgtgaagttcccagtggggtgctgggaagtgggcagctattaatatttctttaagaggtgacttcaagctgagatctgaaggatgagaaggagccaaccttacagagtgtggggaggctgaggagtttcctgcacaggagccctgaggcccagaacagagcacaggactggtcaaagaaagcaaagaggtccaatcagctcgggtgaagggggagagggaagagcaggaggtcactcaccccatgcaggaggtcatctaccaaagcaaggtgatgggtttaattggtagtgaaaaagtgggaggggcgtggggaggtgtcagcagagggttttaagtaaagtcaggacataattttcattttaataggacccttttggaatggcatttgttgaggacagagtaagtatctaacttttgtttacctccccagagaatgcacaatggccaacagatagtagtcactcaataaatatctaggaaatgagggaactaataaagagaaaaaaggatatatagaaaaatgtggaaaaatgctttcaagttacaacacattataaatgtgaatgaataattgctattatttaaagattatttacatgccctttcaaatcaaatagaagcaaactcaatgaatttattgcatgatcccttgaagagaaaaagaaagctgtaaaatgacatagaaaggggttccaagcacaatccagtcatcattagcaacagcaaaaccccagcctttggaggctggaaggagtatgagggtcatttgccccaccctagaggcccaaaacgcacctcatgggatcatgggatttttatgagcaccagtgaaacctttttttttttttttagacagagtcttgctctgtcgcccaggctggagtgcagtggtgtgatcttggctcactgcaagctccgcctcccaggttcacaccattctcctgcctcagcctcccaagtagctgggactacaggcgcctgccaccaggcccggctaattttttgtatttttagtagaaacggggtttcactgtgttagccaggatggtctcgatttcctgacctcgtgatccgcccacctcggcctcccaaagtgctgggattacaggtgtgagccactgtgccagccagtgcaaccttctacatgtgcactcattcccaccggcctggagccctctgtggaatcacctgctgaacccaagtaattaaactaaaagactcctagtacaaactatgatttactgaccacttactaggggtcgctacacatcaagcacttgcacccaggaccttgggtctttgcacctcatctgatttgcacaatagtctcagtgactgatggggaccacagaataggcctttgattctaggactgctgtttcggcaaaggagccaaatcgtacaagaactcaatttttatttttataaaaatgaaaataatcctagcagctacatttattgtacccccaacgcaggttagaaatggttcttgacactttacgtggtttatctcaaggctcgtgcctactccaggaggtggacaccctttgtgggttttacagaagaggaaatgaaggtgctgaggtgtaagtaatgcaggagaattgcagaaagaggagtgacaggggagctgtcagcagaaccacagaaacatccagggcaggctctgttcctaaccagggaacttgctgtcacctggcttcccctccccagcccctgcaatgggctctgagactttctgcttagacattcagtggtgggagctcattacctgcccccacccccaacaaggcagcccattctaattccaggcagcgatgggtatttaaaactacttcctcatgttgactcacaatgtgtctcctctcacttccctgatgtatttttatcctactctgttctgcggctgcacctgcattgttttgaaatatcataacaatcctccatggtcagcaccatccaccccaagactgaatgccatgaagagtatgtgcctcaggaagaaccaggcagaagcaactgagtctccaccccaacaaccagagctaggcgactatggaaaatcattcgaccccttagaggtcatgtcctagtctgtacaatgggataatgccagtaataataacacctatttcagagcaatgctgtgaggccaagatgtcataataaatatggaatgctgaaacacattaataaatgctccttcaactttctcatcttcttggcacagaatgagcccaccacatcaaagtgacaaaaattatgattgaagaaacatgcaatgaaactggattaaagatggcaaaaacataataaacaataatttttaaaaaaaaaaaggaaaaagaaacttgattaaaacttattatgtgctagactatatacttaccacttttgtgttttctattctaagttgaaaatctacaaggtagatgccatcagcatcatttcacaaattaaaacaaaacaaaacaaaaactgggattcagagatgtcgaacaacctgcttaaagtcacacagcttttaagtagcacattcaaactcaggactcttgacccaaatccagtcctctttccactcccagtcttctctttcctccaacatctggccaagcccaggttattatcagtgtttgctcagccctggaataggcacagatcatgctgagcatcacagatagtgtggaggagctacacattcaagtttgcagagtaaatcctaaaaagccttagagaaggaactgcaaggatgccaaatcaatctgaaggaggcctcagtagacaaggaggcatggggaagaccggctggggagacagatttttgagcgtcttttcacaaaatctaaaaattactaaccttctacatgtcaaaagatatttttttgtcaacacatgcaagaacaccctgctaagaagcccaaatgagcagatggatgagttcgcagactcgcagatgctggagttggaaaagtccctgctggcagtccccaaaggacggcccagaaaccccaccctgccctagcccctcaccaggctgagttcaatacctttcagagagccttcaagcttctggccttagactgaatcttgctctctagaaaccaggttgttggaaggttttttcttctttttataatgatccccctgtctctgcttcctgctcctacctccctctccttagcttctcactgctttccatttggcattccacaagcatctcaccttcacccccacaggacagaagggatcatccttctgtgataggcaggaattcaaggctacagagctcagattcaaacaagtcaggaggacacaattacaccaaaatctgtccatcctcaaagaccatgagatttccacagtaccacattgcctctaactaactagagaatccccattttgtactctggaaatttacaacccagagatgtcatgtaaattggtttcacataggatggtaagaccaaagacaaaattagcatacaaaagtagaggcataaatctcaatatcatttctaatttgggttgcaatttagactgtgcttcctatggccaaaggaaaaaaaaagaagaaaaatgaaaagaaagaaacaagattaatcccacaatcagcattgtcctcaaggaaacatctaccagtgctgcgtcgacacatgcttcctggtattcctgtctgaaagagcagcttcctatgggctagtgatccttgggcagtaagaccaactctcaactttcccacgacagtttattttgatgtaagtggaaagggacccttgagtcagaccttctgaacacagttcgatgggactgaaagtccataagtaggactctggggtgttcccgcctaagttagtgataagaacaagatccaccttcttactactccaagtgtggcctgaagaccagcagcatcagcatccctggaggtgtggctagacatgcagaattgcagacctcctgggctaggaatgagaatctccattttaatgagaacaacagaaggttcctatgcacattcaactttaagaagtactgcactagggcagttgctctaattagcccctccttaagaattggagtgttcactaaaaatataaattccagcctccccaaaagctagatgcctggtccttaaccttgactgcacattagtatcagtagaggggcttcataaaaaagtgcacatccgtcaggggcggtgactcacgtctgtaatcccagcactttgggaggctgaggcaggcagatcacttgaggtcaggagttcaagaccagtctggccaacatgatgaaaccccgtctctactagaaataaaaaaaaaatcagctgggcttggtggtggatacctgtaatcccactactcaggaggctcaggcaggagaattgcttgaacccggaaggcggagtttgcagtgagccgagattgtgccactgcactccagcctgggtgacagagccagattccatctaaaaaaaaatgcagatgcttagatcctaaccgccagtgattctgatttattaaatatttgatctagggtgtgaactaggcttcaggattctaaaagtctcctaggtgattttaccgtgcagcatggttaagaagccctggaccagaggatcaacattatgtgtagctctgctaaacaacacatggtaagatgtcagtggacactactgtggtgagacttagtttagggtcagttagatctgggttcctactccatatgaattcagtgagaatctatggacgtgaagacaagatttcgaatgtttttaaagctctgcagtggactctacttgcaggttgaggatcactggttaaagcatactgcatagcacctggcacatagtaggtgacttatgaatggtatatattttttcttagaagccatgatcacacacatcaacagatacacacgcacacacacgtgtatatgtatacacatgattgtatgtctacatatatgcacacatacatatgcatgtaaacacaaacacacatctatgatcatatctgcatatctacatgcagacatcaacacatacttatgtgcacatatgtgcatatatatgcatacatatatgtgcgtgtatgtgtatatatgcgtgtgtgtgtgtgtgtgtatatatatatttgagatagttctgggcttctcaagggagatcctggatttgagaagctttgacaaattccataaagaattagcaattaggatatgagtactgatggagagtcaattgtttattcagcataatttactgagaactcaacttatgacagaccctcttccaagtgctggtgataacagcaatgaacaagaaaaatcaagtctttggtcccatggaacttacagtttgttggggggaaagacatgtaatgaacaataagcaaatactcaagatgatttcagagagaaaaattcaataaagaagatgtcccaggctgccatgattgaagggggttagctactttaacttgggtggttatattagtccattcttgcgctgctataaaaaatatacaaggtagggtaacttataagaaaagaggtttaattagctgatggttctgcaagctgtacaagcatggtgctggcatctgctcagcttctggggaggccttagggagcttttactcacggcagaaagcgaagcagcaggagcaggcatctcacatggcaggagaaagagagagatagagtgggtgcagagatgtgcctcattttacaacaatcagatctcttgagaactcactcactatagcgggaacagcaacaagccatgacggatctgcctccatgacccgaacacctcccatcaggccccacctccaacaatgagattacatcttggcatgagatttagaggggacatccaaactctatcagtggtcacaggagaccttttggtggagatgacatttaagctgagagatgagggacaaaggagccagccatgagaagatatacagaaagcatattccaggcagagggagcagctggtgcaaaaatcagaaggtggaaatgagttaatcatgttcaaggacgaatgtgatttcattcctctttttgtttgcgatgtagttgcatttgtcacgtagttggcagagaacatggtaggaactgagcatagagagctacactggggcttgttccacagttaagtgtcacacagttttgaacacgggagaaagaagtgacgcaattcctttattttccgaaaaaagcttggattccaggaagaccagaacaaagcaatcatcagggttattgttcagcttggggtgggaggagaaagctgagggtgaggagctctcatttattaggcaccacctgtcttcagtggcaggcagatgtgacttcatttaatagtccacatcagccctgtggataagatatcattaactctcctggaccaatttggaaacagagattaaggctgagcaccttgtttggcactatacgactaataccatgtgcccttcctttaggaaagctctgtctcctgaaaacacagttaactgggaacttacaggcaaacctcaggcatgtggtggcactccccaagaggtgctctggcacctcaaaagcacctgcccttcctcctttgctaccttatgacaagaaggcagcactgaactccatagaaaattatatagacacaaaaacatacacacatatattatatatatacttggaatatatatacacatacacatggagtatgtatatatggaatatatgtatacatggaatatgcatatatatggaatctgtgtgtgtgtgtgtgtatatgtgtgtgtatatatatatatatatgaaatgaatatggacctacttcattccatctccacctccatctccatcctagtacaggtttccacatggacaactataacaatctccgacctagcccctccacattcgctcaactcctgattgcatgcccaccggcacccccacaccccaaccaccaccatgtttactgcagcctgggagaactttacaaagtgaggttcatgtagaccttcagatgctcaaaaccctgcagtggctttcactgcctacggggtggagccccaggtcctgtcaaagatcaaggtgctccctgagcacttctcttacctctcatctcactgctctcactgatggtcttgcaactctggaaacttcaacgtgacctctcttccctgggtcttcacacacattcttccctctgtatcaatcaccttcctcacattcttcatctatctcactccaactcctccttcatgtggtggcttcaatgtacttgcaccatgattttgctaactatactggcccatcacatatgctcctaaagcatcctatacccaaagcaccctgtaagactcaacagggatccctgctctatcaacaccatgagataaagaactggttttatcttccagactccagcagagtttcaaaacactatctgcctaagtgaattacactatgacctcctgaatagtatggcatgagatgatcctctgagagtttctcttccagtcttgtatcctattctcaagtaggttaaaaagagccatgtccttctcctgaattttaacaggtgagaaacttcagtccaaccttcctttgctcggctaaagaatcacagggggagagtagcccaccatattgttcccagtcccatctgtcccccttgctaagttttgggagactgaacacaattttgattttcgtacactctccagcatctcctaggctccctctttgtctcttctttcttcccacagtgcttatccccccttgctctgctcccgccccctggaaccatctttttgtgtttgcattttccctcctgctcctccgtgagaaggatcccatttctaagactcatgctttgccagggctgcttggcatagggctgccttctccccaagatgcctgccagaccagcttaggcacaaaggcaggtgccaccagccctccctttccctcagcatcagttgtcaagagctctgcttccatgaagctaccaaaatagaattgtgctctgacctctgcttagcagggttgccctcctgatggggaaacctgcatgttacatgccagaagcctggcccaatgaccactagggtgctcagaggccacagggtcccaacaaagtgtggtgagaaaaaagccggcaggagagagccaggatacgagagagtgaaggaaggagctcagtgaggaagcagagagaagcctgggcagagaaaagaaaggaagacagtggctgggagggaatcacagatgggaaaccgaacatacagagggaatgaggcagaaaggagatgaggatctctctctctctctctcgtgtgtgtgtgtgtgtgtgtgtgtgtgtttggtggaagatatctatagaaattcttgttgagtatctgctccattgctcctaaatatctcatcaggactttcctgagccgccattattatttagttcccattttccagaggagtaaatggaggctcagagaggcaaaaaaaaaatttatctttggttctccagcatatagtccagtatcagggcataaagtagactctattcagcaaagtattgcatgaaaaaggaatacattaatagatttagcatgtattattacaaattctctccttttaacattatattttcctgtatttctctcaacaggaaacacactcaaaggaaagaccagcatactcaagtgaacaaatgtgatgtatttgtttccatatgttctgcattttgctggcagagattccagtgctgggtggaaggtcctcttcctggtctcatttgcatcatcagcaatggaggtcagcatgaccagcaggctgctgcctccatgaacatcttagtagattcctgatcccccttgtcatcggtaccctatgccaggttagacaatgggaaaaggtatcagtgacacatcatgtggggtttgaacatgctctaaaaatacggagaagtatacgcatgtagaaggtaattgtttttgctgttacacacttagttctataaaataaaagctgggaatttctgacatcatctttcataaactggttcctgatagcaccaagaaaacatggtcacaaggattacaagtctagcaagatcaggattggaaccccaatctttttatttctattcattcaattgaaacaaatatttgtcaggcatctacttttgtgtctgacagattctgtgtttggccctaggtataaagatggaactcctgtctttagaaggctagagccagatgaggaaccatacatcaaacaagggcaaacaaagaagcacacattgaattacatgctatgaaggaaagaagcgagatgccacaaggagatccactctgctgttaataatatacatatgtaactaacctgcacattgtgcacatgtgccctaaaacttaaagtataataaaaaaaaataatagggcttgagagtgtctttctaagaaattgaccctggggcatgaggaggcagattccagatgaagaggagcaaattgttattcctggtccagtgaccaggggtaaatataccttgtactattaagttatacctcagaaagaagaaactcaagaaaacaccagattaattttgattcaataatgaccatttgttaaaacccactatgtgtcagtatctgtctcaggtaacacagctaggaagtgccaaggtggtatttaaattaagatctgtctgtttgtgaaactctatagattttttttttatctactctttggatatgagtgtcccatggagaggaggaaaggggagcaactgtcagccttcagttgctcgggttaccagcccaaaacaagtctgaaacacagcaacctgcatatggagaattttctagagagattttataagtatctttccaaggaaaagaagttcaggtcatatttactagccttaggattagacacttaaaattagacacctagggtggtttagatttttcctcgccaaaactcatgtcaaaatttaattgccaatgtgacaatgttaggagctggtgccgttaaggggtgactaggtcattaacatggattaatgtctttctcataagactaaattagttctggcagaaatgaattaattcccatgagggtgagcatgcctctcctattttgctctctttgcatgcacttgcttgctcttcaacttttctgccttgctattaagtagcataagtgcttcaccaaatgcagctgcctcatcttagacttcccaacctctagaactatgagtcaaaataaacctcgtttctgtataaattattcagtcataggtatttttttggtagcaacataaaatgtactgaggcagaaaattggtactgatgagtgggatgacacctgaaaatgtggaagtggctttggaactgggtaatgggtcggggctgaacaaacttgggaatagcaggctggaaaaaagcctgtgttgcatgaatggagtattaagggtgattctggtgagagcacagaagacgagaaggttacagaaagtctggatctttttagaggttggttaagtggtcatgactagaaagctcatagaaatatggacagtaaaggccatttttatgagatatcagatggaaaatgaggaatatcttactgggaacttgttgtatagccacaaagaacttggatgcactgtgtccatgccctagggctttgtagaaggccaaacttaggagcaatggaatagcatatctggcagaaatttttaagtagcaaagtgctcaggcagatgtatggttacttataactgtttacagtgagctgctagaatacagagaagcagagtgaaaagatttgaaaaatccacagcctgagcacatggtagagaatgaagaacgtcttcaggaggaaatcaagggtgtggcccagagactgtttgccaagaagattaacatggttagaagggagctaggtaatactcatcaaaactatgggagaaagatgccaaggcatttcagagatcaaggttgtccctcccatcacatgcccagaagcctaagagggcagaatggttttctgggattgacccagggtgttcccaactggctgactgcccaggctacctagggactctgctccttaaattccagcactgggccccttggtcactccagtcaaagttccagtggccccaggtgtggctcttcctatcactctggaatgcaaattgcagaccttggtagtgcccatgtggtgctaattctgcaggtgtgcagaatgtaagagttatggaagcatggctttctctacctagatttcaagggatgttacagaaagcctgtgaacccaggcaaaaatttgcttcatgggtggagccataaagagcctccaccagttatacccaatggaaatgtaaggttggggccactgtcagggccccagaatacagccactagcagcctgcaatgcctgcctaagaaagccacagacaccaggatgtaactctacccagagacagcagccacgtggactgcacccagcaaagctgtagaggaggagttacctgaggccttgggagcccagccccattccagtgtgctcaggaggcaacacatagagtgaaagattatttgaggcctttaagatttaatgtccttccctctgtgtttcagatttgctttgggctggtaactcatttcttcctccctatctgttcctttggagtgagaatgtttaccctatacctgttctgccattgtattttagaagtagacaacttgtttttaattttacaggctcacaggtggaaggagcttgccttgagtctcagatgagactttggactttagacttttgagttggtgctagaatgaattaagacttttgaggctactgggatggatgacttttgcacgtgagaaggacacgaattttgggggtccaagggaggactgctatggtttagatgtaatttgtcactgtcaaaacttatgttgaaatttaattgccactgtgacaatgttgggaggtagttcttttaagagatggttaggtcattaagatgaattaatggctttttcataagactggattagttttcacaggaatggattagttcccatcccacccatgagagtgggttgttatgaggagaggttacctctcccattttgctcactttacattagcttgctcatccttccacttttccaccaactgatgaagtagcactaggcccttgtcagatatagcagcccagtcttgaacttgccagcctccagaattacaagccaaaataaacctcttttcagtctcaggtactctgttatagaagcataaaaaccaactaaggcagatgtttagattaaaaaatactttagatacaataacctgatctttctcctctaactttgtaatggaaacatttcaccatgttattgagattttatagaattattttacattgccgtgtagcagttcaaagactggctgagaatgatcacatacacaaataagatgcctttaaggggcagtgtaatttaaatgtaggaatataaaagggttgggtataaaaccagagagagtggttaaaactgaaaccaagctgaatatgaggcccaactaaagacattcaagttgaatttgttttaaatttgacaatccagaaattttactcatagatatgtactctccaagttgaaaacaggtatttaaacaaagtttgtacacaaatattcacaaaagtactattggcaatagccaaaagttgaaaacaacccaaatatccatgagtggatgaactgatatacaaaatgtagtctctccagataatggaatattactcagctatgaaaaggaatgcactactgatattttattccttgctacaatgtggatcaaccttgaaatttggtggatcattatgctaagtgacaaccaagacataaaatatgtctggtttgtatgtatgattttatctatatgaaatatctggaatagaaaaattcatagagacagaaagttgattagggattaccagggactggggaaaaatgagatgggtaataactgcttaacaggtacagggcttctatttgggtgtcagaaatattttgtaactagatagaggtgatggttgcacaacattatgcatgtagtgccactgaaatgtacactataaaatggtgaattttatgttattaaaaaaaccctcattttaaaaaaattgacaaagtcatatttctggctttggtcctgggttgccaccttgtgagctctagaaaccatgattttgttcactatttccttcttcttgtatgcataagttattttttgctttccacattataaacatggctgcaatgaacatctttatgcatgacatctttccatattttgtgttactcctttaggatagattcttgaaggcagcattctcagtgtaaaatatatggatatgtttatggtttttaatacatattgcaaagttattccctaataaaattggattaatttagccccccacaaacactacatgagaggtcttaatcacctcattctcatcagcattcccatgttactctttataaattgcttgtatggtacaggacactatgaggcatctcataattttgcctttgatcttgtaaaagtcatttctcaatattggcttcctttaggaacttcttctatataaacatgagatgctctgctgcttttggactacctgttcttcactaactccataagtcaccctcatcacatttgcccatgctgtgccagctgtttaaaatgcctctccttccccctctcggagctacaaattcatcaaggctgagactgtcatatttctctatagctttctgactctctggcattgtattgtttccacttctctactcccaaagccatttgtccctacctctttcatagggcagtgcattgtatgggtgtttttttttctcttacatgtctattttgttctctggatcttgagatccttcaatacagaactaatacttacaaaactaaaagctgaactgaccctactagcattgtccctgacccactcttccactggactcatctgtctaccgatgtgtccaggacatctcaacagcatggcaacatggtctgaatactcaagagccattcacagtgaaggaagagtggtattatttatgctatcagatggcaaggccttgtcaatgagacatgattatactacatgtgatacaagtgaaaaggtaggagttccaagtggcagaactatggttggtgttcaagaaattgaagtggatttcaaagtgattctggaagcaaaaatgtcaactgagctgcaaagacattgaatataagaggtaggttaaaaaatgcatcactaagacatgttctcaattcaaggttatgtggaaagtacatagctgggtcctcattcaacaagaatacccctcaaaaaggctggagggatagaaagaagctttgagcatcattgtatggcatgccaatttaaaatgtatggattttaatggttagcacttctcatacatcatttatatgatcaataatttcagtataaagtttcctatggctgctgtaacaagttacccaaagttggtgacctaaaatcagtatccttgtgctgaaaagagttgccagcagagccagctccctatggaagtctaggggagaatccttccttgtctcttccagcttctggtagctgctggcattctttggtttgtggttgtatcattccaaactctgcactgttttctcattgcctttttctcttctatctgtgtgtcaaattcctcaatgtctctcacctacaaggatacataagattatatttagagcccaccaggataatctgagataatcctcccatctcaagatccttaactagggtaacattcacatgttccatgggtaaagacatggattttgtttggtggggaggggaagagaggggattattcattctattacaaatatataaatgaaaatattctcagtcagtttgctgtaaagctccaagataagtagtgcatttatattgtttctctgcctcttttttatattacagacttcccaaaggccagaatgtgaccttctgagtctcttatccaacctgtgactgcatccttggtagcaagaagaaaaaaatcccaaaatcttcaaatagagctaagtcccagtgacacaattctacttgctgtctcttttgtagactcttccctgcattctcagaaggagcttcaacctccacatctgtagaaaaatggttttgggtacagcagactttaattcatttagctgatatccactaatgtagaggccaacacaaaagctcatccatgaaaattatctcatgtcctttcatatcaaatctgaaatcctaataaagagcagaacattcacaactaatactcctgacatggaaagcctgcccactactttgattagtcactaagttcaaacagttaaattatatctcatgtcttgtattccttgaggtctagccaaagactaaaatctagtagacaatggaggagatggtaggggatgagacaagagaagaaggtggaggccattccaggtagaagctgcttatatgtattggtaaggatgttgtgcttcatctcaagaacaacgaaactcactgaacgttggtttggagagagggttagggaaaagggtgagacaagaccctaactgtattttcacatggattactttggttgcagcgtggagtttcaaatgaatgaagcaagaatggttggtcaggggactgcactaatcctgacacaaaattatgttggcttgaactaaggggtggcattggagatggagaagtaaagacatcaggaaatatatgaagatagagacaagagggcttggaggatgtggagggtgagaaataggtttcgtggatgttttaaatttctggtaggaaaggatggaagtgccaccatgctgagttagaaaacaccggaacaggatgagatttttgaggaaagatgacattacctaaacagcaataacaataaggcaagtggatattcaggcagggagcagacacactactgtgagaaatcagtacctggaagaatactcgagtcctgcagatgggtgagatttcctaggcaccgtgttctgtctggaagggacaggcaccctcagatgataagggaccaacagttagagaggaagaaaaccaggagatacagtgccatggaagctaaaagaagacgagatttcaagaagtgctgaatactgttgaggtatcaagtacaattgcgactggaaactgtccactggatttaatgccatgaattgaggatctcagcaaaaatcatttttgtacagtaagccagactagggtgggaggaaagggagacagcaaattgagacaatagttttggggattcacagaatccagtaatgcatataaagcactcagcacagtgttaacacctagtggctgaacaataaatgttaatttccttgccttcctcattttaaacaccaattgactttcccttttggatactgacagagatgaatgcaaatgtttcttttcatggctttgcaaaagtaccaataaaagtgattttctatcaccaagatacagcctgctgatgtgaaatatacccaggcctgcttattattgttgttgttctccaggacattgccgatgtcaaatcatgtaaatctatattatcataaaggcaattaattaattgtatatctaaaagtgcttaatttttatgcctctgctagacttcttggacatatttctgaaccacatgcaaccacgcttagctcagacaataatattcccaatgtttatccattattgtactcaagattcatgttatctattttacttatgataaaatccacatgagatttcacttagaaaaaataagggcttttgctattcacacataaccagatgcagagaagcttttgagaccccagagccaaggcctccaaattgttggggtgatccattcatttatgccatctataactgcgtattaggaaccagatgagaaccttatgggacaaaataactttaaaaacagcaacattaagcctgtcttggaatataaaatgtaaaaagattacttggcctccataagttgcagataacagaagagaaataacaaaggaaatatcctgcagactgacacagagcaggagctctccataaggagatttttaataacttctgtctccaaaacagcccaccccacctttatcctatctgaatgccagaaattgttcattgcccacacatttaagagttggaatctctttttcacatattgagttataattcccaaatgatagcttcactgacctattactacttgaagtgatacatgctaaaataatcaaatatataaaaggcagaaaaagcttgagtctcactggggtgaagagctccttgcagatggctggacctcaagtgtcttgatttccccactctctatagtagggtattaataactgataacagtggttgaatgtttacctatgcatcaagaagtgttcttgagatttatatgcaccacctatgtaattctcatccaatcttaggagtatgaggtaaacattattcatccccactgtgcaaatgaggaaaaagaggttcagagagatgaagttccatggtaataatttgaagagctagaatccaaactcatggaatctgaccacagagattaagcacattacaaatgtttgtgggtggatatatggaaggaagtagcgtataagtggagatatggttgaataaatgcatggatggagagacagcaggatggagaccaacagaggaatgaatgggtggatggagagttggatacatggatattcatctgtcttaggttcagtaaaaaacacaaacttccaagggcactcgtgtggtgttatgatatataattggttttcatccatggttcctggctcctaactcccatagtccttgttataatattggggcactttgggcctcaggaaacagaatctctctctgaccttcttcatgtccttctttcacctgcccagtgccagactctaatctgattgtggatcagaagaccctaatccagagagattcctgccccatacctagaggaaggaatgctaaacagagaggccaagaaaagtttgaatggacaagccttgctggtgtagattatgcgctttttgtccaatcacatttccacagggttgtcaatcatgcctaagtaatgaagcctccatagaaaacccaagagaactgtgttcagggagcttccagacagctgatcatgtgaagatttctggagggtggcggtgcatccagggagggcatggaagctccacaccccttcccctagacctcaccttacccatctcttcatctatatcctttgtaatatccatataataaactgtaaatgtgtttcctggagttctgtgagctattctagcaaatcaatcgaactcaaagagggggtcatgggaaccccaactggcaactgcttggtcagaagttctagaggtctgaacttgagactagtgtctgacgggaggcagtttgaggactgagcccccaacctatgggacctgacactatctccaggtagatggtgtcagaattgatttgggggacacccagctggtgtctgctgcctggtgtacagtgaaaaacccccatacctttggtcacagatgtcttcttctgtgttaatgattgttgtgctatcagagcagaggaaaaacactttaagagagtttttccctacacgactagaaatgatgattgaaagctgactcttgttctttaatccagtttcacgtgagaatgagtcatcagtccctgcatgctatgcttcttattatgtgatgctgtcagactataggggaggcaggtcttcagactgagatgcaggggatgagagggaaggtgttgggtggggaggcgtgtcatatctctttgggtcttgattactgaagagtcaggcatgacacgtgaaatagtgtccagaaactgggtgataagttgttatctggaaatggcagcaagcaaatcacacaggcaagggtcttgctcatgtatcttgggattgagccagggagtcctgaaaaggactagaactctcctccatcaaccatgttactgaaattagattcctcataggttctgagattactcctctaatgttctctctcagggttcactaagggttttttgtgtgtgtgtggttttttttttttttttttgagacggagtctcgctttgtcacccaggctggagtgcagtggcgtgatctcagctcactgcaacctccgcctcccgggttcacgccattctcctgcttcagcctcccaagtagctgggaccacaggtgcccacaaccacacccggctaatttttttgtatttttagtagagacagggtttcaccgtgttagccaggatggtctccatctcctgacctcgtgatccaccggcctcggcctcccaaagtgctgggattacaggcgtgagccaccgtacctggcccactaaggtatttttgaaagacagtgtttaccccagtgatgatggagtgaatcagaggcaggggactgggggtgttgcagacattgttatgaggagcagggcttcccctgggaccaccttaaggagaaaaggagaatcaaagagagaaagaaaatctgaggctagagttaggaagaacagaatcaaggcttcttggtcctataggtcctcttcagtgggaaattctcattctggggctaaacctgggagattttgagatttactttctttacccagggacacaactttcataagttcttgtggaacgtttggtgagatactctgtattttgtaagctgcagatgtgtagacttaaggctgaccacattgcatcaagctggtcacactggcagctgctcacccagagtgatgcccaccccataggagtacagatcagataaactgctagcaaaaggaatacttatcatgttgagcaactatcctaggtcaagtattttacagagatcctctctactacttaaagttattgggcatttggcatatgcagaacattgaaactggacccctcccttacaccttatacaaaaattaactcaagatggattaaagtcttaagtgtaaaacccaaaactacaaaaaccctagaagaaaatctaggcaatacaattcaggacataggcacaggcaaaggtttcatgacgaaaacatcaaaagtgcaacaaaggcaaaaattgacacatgggatctaaactaaagagcttctgcacagcaaaagaaactatcatcagagtgaacagacagcctactgtataggagacaatttttgcaatctgtccatctgacaaaggtctaatatacagaatctacaaggaacttaaacaaatttacaagaaaataaaacaaccccattaaaaagtgggcaaaggacataaacagacacttctcaaaagaagacatttatgtggccaagaaacatgaaaaaatgctcaacatcactgataattagagaaatgcaaatcaaaccacaatgagataacatatcacaccagtcagaatggtgatgattaaaaagtcaagaaacaacagatgctggcaaggctgtggagaaatagaaatgcttttacactgttggtgggaaagttaattagttcaaccagtgtggaagaccatgtggcaattcctcaaagacctagaagcagaaataccatttgacccagcaatcccattaccgggcgtatacccaaaggaatataaatcattctattataaagatacatgcatgtgtatgttcattgcagcactattcacaatagcaaagacatggaataagcccaaatgcccagcaatgacagattggataaagaaaatgtggtacatatacaccatggaatatgatgcagccatgaaaaggaacaagatcatgccctttgcagggacatagatggagctggaagccattatccttagcaaactaacacaggaacagaaaaccaaacactgcatgttctcacttataagtgggagctgaacagtgagaacacatggacacagggaggggaacaacatgcatcggggcctgttgtgggggtgggaagggagagcatcaggataaatagctaatgcacacggggcttaatacctaggtgatgggttggtaggtgcagcaaaccaccatggcacacatttacctatgtaacaaacttacatgttgtgcacatgaatcccagaacataaaattaaatttaaaaaataataaagttattgggcacttggaatgtggctagtcatctgaggaagtgaattttaaattttatttgcctactttaatatgttccaatttgaatgccacatgtggccattgcgtaccatattgggcagtgcagaacagaacacttccatcatcacagaaaattctcttggacagtgctgccttagggcggcttttcagcgaggtcctgtaaaccctgttttgactgaagaagaaactaaagctgagatgtcaaatcatttgcccagcatgacaaaaagtgagggtagcaaagccaggatttgagctttggtctttctgactccaaagcctctttttattttattttattattattatactttaacttttagggtacatgtgcacaatgtgcaggtttgttacatatgtatacatgtgccatgttggtgtgctgcacccattaactcgtctttagcgttaggtatatctcctaatgctatccctccccactccccccaccccacaacagtccccagagtgtgatgttccccttcctgtgtccatgtgttcccattgttcaattcccacctatgagtgagaatatgcggtgtttggttttttgtccttgtgatagtttgctgagaatgatggtttccagtttcatccatgtccctaaaaaggacatgaactcttcatttttcatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatcactgaggaatcgccacactgacttccacaatggttgaactagtttacagtcccaccaacagtgtaaaagtgttcctatttctccacatcctctccagcatctgttgtttcctgactttttaatgatcaccattctaactggtgtgagatggtatctcattgtggttttgatttgcatttctctgatggccagtgatgatgagcattttttgtgtctgttttttggctgcataaatgtcttcttttgagaagtgtctgttcatatccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggaaaagtctctttttatttcatgacctattctatttaaaactctgatttcatgaacagtgtgctaatcaataattttccctgttcaagaaggtttaatgtggcttttcctagagcctttcccactacagcacaaataaaaactaaccctatgtcataaatgtactctaaattattttaaatgtatatataaatatgaatgaatcaataatggtagtgcagtttacattacaataagacataaccctctctgtggctgaatgtgatgaagggtcatttctgcctcgttcacatgacaagtccactgtggatctgagcagggctctgctggagaaggctacatggccaactctcctttcgcagccacccagactccccggctcctaaagctgctaaccggaactcatgtatcagttccattcccattcattagtcaaagcaagtcacagtgcatcttaaaggagaggaaataagtggtgaaagcactgatatcttctacaagcaactcattatcttggcatgtgtcagtttcttttaaaagtgtgttttaaattacatgaaatctttctttggttgttcagattctaaaatcacaaatattgatgcttttgttcccttaagaggctttgtccggcacccagactgcagagtgttctggcctttgtgttagagaagaggaggatgaaacagtatgtttcctgtctacagggggatgctggctagtagaggacacatgaagaaatcaaccatcccagtttgcctgggactcagaagtttcccagaacatgagactcttgagtgttaaaagtagaattcctgggcaaactccctctgcattcatggggtatgagatttgatgaacatcctacacaaataaacagaccactatactcctgtttgagagaattatgatggggagcaagagatgttttgaaaacacagagacgggccatctaactggagaaggtagggtgggggtccttaatcagggtgtggggatggaggttgctggaggggaagtatgtaccaggcaaaaggaacttcacacacaaatgtgtggtggccagagagaatgtgcctcattcagagaactgtgaatgcttaattatgcctggtgtctagaatttaacatgaagatggggtgggggagccttaatataccgattttagaatgtctgtaagataagtttatgatttacacatgtactcggccgggcacagtggctcatgcctgcaatcccagcactttgggaggccaaggcaggcgatcacctgaggtcaggagtttgagaccagcctggccaacatggtgaaaacccatctctactaaaaaagtacaaaaatttgctgggcatggtggcgggcacctgtaatcccagctactcggaaggctgaggcagagaatcctttgaactcaggaggtggaggttgcagtgagccgagatggcaccattgcactccagtctgggcgacaagagtgaaaccccatctcagaaacaaacaaaaagaattactcacttaaaaaaaattactcacttttaatttaattaaaattattttcaggtggaaatacattcatatgacacagagtttaacagggtctagagtagtctgtctcttattctgctatttagataactgttcctattcccataggcaaccaaggtttttagtttcttttttttttcttggtttataagtaaatgcatttttaaaaatttttaatttttgtgagcacatagtacatatatatatatatatatatatggtacatgagaagatattttgatatgggcatgcaatgatgcaatgcataatagtggtggtttttagtttcttacatattcttccagacatactctgagcagatacaagaaaatatgcacattttccccccaaaaattgtttcccacactaatgctactggattacacactctcctacatttggctttcttcacttaaaaacctaatgtggaggtgttttcagagcatttgtattcatatgaaagctggatccttgagcaattctgacaaacatccagggttgagacccacgggggatgtttgctatttcatctgtgtatcccctgtgcctggcaacattcatggcaaattctgatggaccagaccaagggaataaatgaacaaataaataaagtgagagaagggaaaatgaatttcaaaaagtgataagaatgcaaaagggggaaggaaggacccgattaatatttaatcctttggaggcatcttgccccaaattaaatgacatgccctggttttggaaaatatcacacaattagggaggtgccagtctgcttcagcctgtagatcccattgcctcttccataatcagatatgcaacttttctgagggcggtattttcctgcccttctgaaaaatgaagcaatttaaattctgtttataaggtcacagacttgcgctcaatgccaggcaatgacagaaatggtttcctgctggcagaaaccaagttggcttctaaagaggccatgtgctcctcttctctgctctcttagaactccctggacatctttctatttcagcacctctggtgggagattgacagtatctatttatgtgtctgattccctgactagaggaagtccctgactgaggacaaggattaggtctcattcatctttgtctccaataacatgcctgcaacacagcaaacacagtcaataaactgaggcctactgcaatgacaggtgaattgaaagaatgtgcctattaagggaaagaaaggacaagacaagataagaatggaccatggatcattctgtcatgggaggtgacaccatttttttttgcattttccctcctgcaagggaaagccctttgctgccgtttcatgtgcagaatgttggaagtgttggcctcccatatgacaggagtgccctgcacagggacaagaatacatgaacttgtttcatggtttctatttttattcctggtaggaagggctatttctgtttcaactctgaggggctgctgaaggaaggtacattgcagttttcgttggctgtcagaatgtggcacattttaaaaaccagaacctgctgagaggtaccccaaaaacctttcagggttttgagatggcagcgggaagtccagaactgtgggacacatcagtgtgtggcaccaggactctgtacccatagcatcagaaggagggtgtgtctcatgccctagcaggtgaggaatagctatgttttccaaaactacctgggcaagttagccccacgcaacatgcactaaaacagaacctttgggttttaacccaataaaagatgttttaaactgtatctcaggtcctggccatataaagggactccacctgcccaactctggcaggttaattcttttccatgaccccttgtgggctcatctgtagagtatcagtaccaccgatcactgggcatgatgtgagaattagggcagatgatgaatgagcagtttgtcatgccgaaagcaattacgagggttcactagcatcaagatggtgataattattattattaacttgatgccataacaagggattaagccagccaatgaagaaagagaatatcatccgtttagtcattttccaggtgccttctggctggctagtttccactgaatcccaagcccatcacccactctttaagcctaccccacgattcatcactcttcccttgccttaggccttttattttctgttctgtggcaggtaaacacagatttccttctcaagaatcagcgaatgtgctctatttctgatgcataaactctgaataacttctccacacttccagattcttcacacctcgctctggctcacccatccgactgtacgcccatctcatcatatcccactcctatcaggtcagcactcacctgttggctatgaaatgaaccctgtccactccagccaccatggccaccctccctgcctgtcataccttctttattatttacctagacacccacctggtcaataaagtcctactcaatcccatttccttatggagtctttcctgactgttgcagtccttactgtgcactttactctgaaatcgtaaataataacaggtccataattaaacaactaattaaagaagcatttactgaccatctactaagtggcaacaagggtgaagtgagaatgatggtgactaaatgggaatactgaaccaaggtcttgctgggtgattgatgggatcaggaaggtaaggaagatgaaggaacctaagatgatcccccagattctgccctgagaattggatggggtgctgccactcactgagatggggatacagaaatgggatcagactggtgggatggggatgcgagacagttgcaagcagggcacattgagactgagactgctgtgatgcacttggagagaggtgtccaacagaaagttggctctgtgaattttgtagtcctggagctcaagagctctctgtctaatgaaggaagcccacaaataagcccagaaattataatagcaagcagtaaatactacagacaaagtggaaacaaccaaaggagaccaaaggaaggacaaatgcctggggatattgggaagcttctaaaggaagtggcactcgagtggggctggaagaccagtccaggtttaacatgtgaatgggtagaaagagcacacccagatgaagcaacagcatgtgcaaatataccaagtggggacgaggatgggctagtccacaagtggcaagtgggtcacagtggctgaagagtagagaacgtgaaggaatccatggcaatgaagctggagcagatgaaagacctgccagtaatgacctctggaccatatctgacacaaagtagtttaagacactagatattttacactcgaatccagatttccctcttctactgaaagaaaaaggagggccagagctttcattttcatggtgacaatggtcaggcagagcagtggctactgccatcgaacagtcaggtctttcttgttggccacaactctcaaaacaacactttactcttgatatgatccacctcgcccctgttggcatttgcagtttgagccactgctggaactggaagacaatgccaaggaatctggacttatttccaagggcaacacaggcctgctgagggcaaggatggtccggctggacaacataatgaagacatgtggataaggtcatttcttttgagttccttctcctgaaagggttgaccccaaactaggcctgaatagaggccatcagaatgttctctggtcttgaaaagcagtttcctggcactcgatttttttctctctcctgccctgttaacaatgctgtatcctagatgttgagtcataatggctctacctaattttactaggaaatccacccatcccaagacctctcagcatggtggtcctttggcccacaggtgatttggatgtctagagatgtatgtgtctgtccaggaggcagctggctgttttataagctgctcaggagaacctattgaattgtatcacaatcttcaggcacttctgatccaccaccctcctggggagcatgctgggaaatgcatgactgctgagggaagaaagactcaagtcaaagggtagtaggcttaaaatactcccagccagagctattgatcatgcaagaacaggaaagggaaggagcccaagagggcagcaggctggcccaaattttctctcagcagagatcttgctgatctatagaatttaaacctataaaggcaatgaaggagattggcaccaacaggcccatgctacagcattactatttaggtgcttatggaacccattaaaacgatgataaagcactcatttgcaaatctttttctttgtacctactatgtgtctcccacagtgactcagttcctgtcctcaaagacctcacggtctatttaaaaatgtatacaactaaatgaatcactacaacacaatgtgtaaagtgcatccattacatatttaccaaatgttacgacattcacaactatggttgggtattatggaggcttcatggagaaagggagagtttggccgaattttgaaggatgagtaggaatttggccaagaggctgagaagaaggatgtctaggcagagggagcacttgtgatcagataaagaaaatgtgatatatatatatatggtgtgtgtgtatatatatatggtgtgtatatatatatatatatatatatatggtgtatatatatatatatatttatggtgtgtgtgtatatatatatacacacacacagccacaccacacacacacatatatatacaccacatatatgtacatgccacacatatgtgtatatatgtatatatcagcctcccataaaatattgcataaaatattacatgtgtgtatagatatacacacatatatacatatgtacacacagaaaatattatatgtgtatatatacacacatatatatacacatataatattttacatattatatgtaacattctttttatgtctgagtaatatgcagccataaacacacacaccataaaatattactcagccataaaaagaatgaaatcctgccttttgcagcaacatggatggaactggaggccattatcttaagtgaaataacttaaaaacagaaagtcaaatactgcatattctctcttgtaaatgggaaataaacctgtacacatggacacagagaatggaataatagacagtggagactctgaaaggtgggagggtggaagggaggtgaagaatgagaaatcacctattgggtacgatgtacactattggggtgatggttacataaaagtctagaattcaccactatgtaatacatccatgtaatgaaactgtacttgtaccccctaaatctacagaaatgtttaaaaatgccataaaataaaatgtggtatagccttaaaaaaatgaagctgcacacgtttggggccagtgagaactgggtccttgttctggctccaccaataataaccattgtaattggtgtccatggtcatcttaacttctccagggctcagttttctcatgtctgaaatgcagatagtaagagcagccctatagagttatttagagcaacactgtccaatacagtaaccctaaccacctgtggctacttaagtataaattaattaaagttaagtaaaattttaaggtccaattccttattcacaatattcatagtacaaatgttcagtggccacatgtcccaagtaggaccatattggacagtgcagcttataaaacattttcatcattgcagaagtttccattcgacagtactgatttagaggatgagacttttggctgtaaaagtcaccttgcatattgtttagtatataaacaatgtttaatagcataattatacctattattaattataataattataatttgtaaaggcctagagtcataattctcaaagtgtgaaatgaatgaaggaaagaaggagacacagataacaaagaattaatatcgattgggaaatgaggcaattagggagtaactgaaggaaaggaggaaggaagggagaaaggcaggcaggccaataagtgtgctggttcttctgcatttgttccccagagccatttctctctttcctgctctgctcagtgcctgggaggctgatctctgcagaccacttcatctaagctccctgtctggctggcttctgatagagtttggttaatggaagtgagaaataaaacagtcaccaatttgcaaaataaagtatgacctgcaaaagggataaactgatccagccatgacatgtaacacaaattagctcaaaacattcttaaataccagctcattcagtcccacatgttcccagctaatactacaaattgatgtaaccataactctgtatgaacttttatgctccacagataagaccactgactgtcctagaaaattgcttcattcataaattctgaccaatccctgtctagacaatgcatattaaaaccatcttaggactaaccccacaatcttacaagtaccttccctaactccccttttttgagacattcttgagattttgttgcaggactactcttccttgcttatcatatttaataaatccagcttagtaagataaccagtgttccctggtggtggttgcttcaacaggaggcaaccacaggagccaggagagcaggaagtagggtgaggcattgctttccatgcctcactctgtttcagtactgactctggctgtagctgtacctgcccaacccccaacagtagcttctgcttgggggccccttctttatgagctccaacaacatatcttcctcctcttgtcccttcaacttgggggcagtaatagagtttgaaattgctagcttctgccgcttcaatattcctcatttgttcccttatccttgcccattttctacacaacttcccctcattaaagagttttttggggggttttttgtttgtttttgtttgttttgttttgttttgttttaatgtgtgggcaaactgagtttctgaatgacagatagtgcaacttattatttattgtcaagcagtgtgctaagctcccttccctgggcatcttcttagacacacgcatgacaggcactcaaccccaatttacagatgcagaaacctaattcatcaggttaggcaactcgcccaaggccatgtcaatccatgtttagtgtgggaacatagacctttcaaattcagatatctgtgtgctttctactactctggactgaactcaaacgtgggcatttgaaaaatggttctctccttctctcaaatgagtgttctgttagctcctggaggttgttctcagtgtttatgtttttgctttcttctctctctcccaatcctggtaacattctgactttgcattaagcttttacaacttcccctcaggaactaacgtatcttctttactccctctaagaaaaacttggccaaaaaatcatctactgtccttgcagatctctgatcatccatctctggcttcagccttggaagatgccaatgtcctgaaacccagcatcaaagagaccagatgatgacttttaaggagggtggggtgccacccggaaacctcaaatggatcttcctatccaattcacaaatctgtttcccagcagtgtgtgcataggtgtagcacagctaaattgcatcagtatatgcacatctaaatttatacaaaaggggacaacactataggaagcaggcaagctagcaagagtcagtaagagttggaagttagtgtaaaggatagcaaaatcttcctcgaaggatgtagcggtaaacttagaaagatcaatatttaggggagaatctcttgagtaatagtccttaattatgcaaacacacaaatcatttctgggggaaaagtaatggaatattccctagcttaacaaaggcagactcttgacagcatttttttatatcttaagttgagaggtggtggaggaatccacataaggagtttttggggattccagatgggaacagaccaagacagaatacaaagtgactcagaagctgtgggagtcttggctagtgacattaatttaatacctgggccacagagtttgggggtgaaagctggtcccatcattacttatagctgaggctgattcagccacctagctatggaattctttaccacaaatgactgagcatataaagctgaaatcaaagagatgaaaacttggagcctgagtttgtggtaccttgggagcaagtgttagaatctgggccaaaagtagcttcagcgcaggggaaataagcagccactgaactgtgcaggacctgtgttccacagtgacaccatgtggcagtgagacaagagtggactaagtacactttccaattttcttcaaaggagcattaaaagcaagactggctcctgttttgcactacatacgccccttaggtttgtggctgattcaagagggagctagtggtcaccccagtgataagtcataaactggaaaagtagaggtaaagtaagctacaacaactacactgagaaacgtggggcttagttcttgggttctaacttgctgtgtgtgacttaggccgaatcacttcatttctcttggctttatcatttcatctttaaaaagagcctttctagattcaagacttcccagaggaccatgagatccataacaatagagacaaagttttgttcactgcagtatccccagagcccagtggacagcacaaagtactcactcataagtgtttgtttaattgaatcagattaatgatctcaggcatgaactattccccaacaagcttagccttgaggcaaatgcaaaagaaaaaacagatttgggccaggatattggtcactaaaggagtcacagtagtgctgagttcatggaagatggatgataaatgttcatcccattcatatcagaagattagaaaggttatatgagtcggggagttgcacagctccccacacttccatagggttctctttatgttccctggtgacagaaatgtgtccaccagcttcttttccttttggaccagctgtctcatcctctggtccccggaggatggcaacccttgcctcctgtcccagaaacaagcactaaagcttcctggggcttctctgagagttttcagtgtcaggcccagcagggagctgcaggcagggagaaagaacaaaaaagtaaatgatatctcctatctcacggggctcacggcagaagccttcccaggtttgaggttgaataaaaacagagctgggctatgaggttccacctgactttgagtctaggtccctctcctcctccatgggctcctgagtccaccggctttcttctctatcagtagctccaactgcaaccctgccttcccgaagcctgaacaagtgagaaagagagagcagataaggaagccaggcagaatctacagtgacaagtaccattagagagggatggatggagggcagggggagcccagagaagaagataacaaactcagcctggaggggaaaggcttgacaagggacctgcatctggaggcaatagaagcattgaggagccaagaagccatatcagtgggaagtacaacagcaaaaagaaaagccatgttctcagagttatttatcatgcttcacatgaggggcacacgtaagggaaatcagacactgtgattcaatggctgcatgcgtttgtttttctaattattattattaccatcaaggggagccataataaccacaaagggtaagacttgtcaagcgctgacactggggcagccgctgtgattgacctggtttatttgctcatgtaattctcacaataaccccatgacagaagaatgttatcatccccactttaacaatggagatactgaggatcagaggggttaagtaaactgcttgagctcccacagctagaaagtggcagaactagaatttcagaccaagtctatctgactccagagtctaaattgttgctatttgtgaaggttaatattgagggtcagcttgattggattgaaggatgaaaattattgttcctggttgtgtctgtgagggtgttgccaaaggagattaacatttgagtcagtggactgggagagacagacccaccctcaatctgggtgggcaccatctaatcatttgctagctcccctagaataaaagcaggcagaagagcatgaaaagactagactggtttagacttctgacctgtatctttctcccatgccggatgcttcctgcccttgaacatcagacgccaagttcttcagctttgggacttggactggctttgtgtgagtcaatactccttaatatatactccttaataatgtcccctttatatttacctctatctgattagttctgtccctctagagaaccgtaatacactattattatctcctgctgctcattaattcattattccacaaatatttattaagcacctactgcatgccaggggctattctctgccttattatgctgatttattgacatttgagttagaggcaaatttccagggtcacagctactgtatggagcattatgcacactggaagatatatgtgagctaatgaatggctcaactccctttcaggaccggcaccccaaacaccctggactacatccatgagtgtgcccccagaaaatgaggcacctcccagcatcgctgacaagcgagctgcaacaccaaatagcaaggaccacacactagaaatcccctcaccacatgtcagctaaaagaatgaactagtaactgcatgaccaggatttcaccaacacagaactgggttgaagaagccgacaaagacaggacaaatccccatccctttaatcacaaaatcttacaaactggtcccctctgtgagagtttgaatcccagctatctcagagagaactctgagctgtgaaatactaaacttggaagggccctaaacatctttgagactttcccaaatgtcagttggtcagataccccgtcaccatctttgctttgtttaggcatgacttgtactattaattactttaggtattgttttaaatcaactttcttttccacttcaatccaattacagcataagagaaggagactttatatcatgacctttaataggaaagccagaccttctcatataaataggttaccataggaatagatctactggcctcagaatgtgactgagttcaaagcaatttaatatatctccgtgtaccccatattcaagggagcacactgaccagctgagtgggaatgagccctgctcagatccctgggtggatgctggtttactgagactggccgtgcagacccaggatgctttcactgctgttttactgcttggtagctgcctgtgtgaatagctgtgcaacctcgggtccatctccatgtaacataaagatcccccagctcccttttccattgcaggtttctctctctctctgagcatgaatctattgaccacagcttcttaagactcctctcactccagtctccacgaggagtgcaggagtgcggggcaaagcgccccactgggaggacctgggcaagggtaacctacaggaggagaggtggggtgggcagcagaggacgagttccactgcctgggctggtcttccacttctgtgactgactgagatgatgctgccctccctgtaaaatgagccgtcaaagagcacaggtgcttctcaatgtgggcctgggcaccacaggtggcaccacaggtgactggacgccttcacagctgaacatcttaaatatgtttaagttaaactcatcactccacccctagaacatctggaatcctaaaagtggtatgtgagctgagtggtctctgtttttaaaagggttaaaagagaatttgccaaactatatccgaataaatcttggaatggattctttgaaaaattctgcgtggtttattaaagtgatgggtttgaggaaaaatactggtgaccactgggaagcagcagatgttcactataaacaaatggtatcagagtcaccttacgacttttttttttcttttttttttttgagatggagtctagctctgtcgccaggctggagttcagtggcacgatttcggctcactgcaacctctcctgggttcaagcgattatcttgtcacagcctccccagtagctgggattacaggcaagtgctgccacacccagctaattttctattagagacggagttttaccacgttggccaggatggtctcgatctcctgacctcaggattctcccacctcgccttatgactatttttaacaaggcaagcctggtagattaaagtgatttgtttattctgacaacgtttattgaacagctacaataggtcagagagtttgttgggtgctccacataagccatttcatatcatttgctttggtagggcatgacagcaaaaagataccaccaaatcatttagaaactgagaaaagagattgtcccgtttactaatttattgtaaaagtaagcaaacagaattggaggacagatgtgtaaaccgtccttaaggaacagaaaggtcaaaatgatttagcagctccctgtcctgtgtccttccacttctcattaaaatgccaccaaggacacacacaggaagaagccaaaatctcctaacttacaaacaccctgaaaaccaaaagtgataagccaattattaccagaattagggagaaattttcattgactgtatttgaagaattcacatatgtgaagtgcttagagcagtgtctggcacacagaaatgccaattgttaattattattaacttaaagtcaaaggaactgaactgaggaaaaaaattggtcacctctgaagacactgtcctatgaaagagaggccctaccaggcagagaggtgctgagcagatgtagttgagctgaataatgtcccccaaatttgtctattcagatcctcagaatgtgaccttatttggaaagagggtctttttagatgtaattagttaaagaggaattatactggagttgcgtgggaactaaatccagtgactgatatcgttataaacagaagaggagaggagacacagaaactcagaagaagtccatgtgaagatgggggcagagatggagtgatgcatctacacaccagggaatgtcgaaaactgctggcagccaccagcagcaaggaagagtcaggagaggacttttcccaagagccttcagaaggagcgtggctctgctgacactttgatttcagacttcttgtctccagagctgtgagagaatacatttctgttgttttaagtcactcaggttgtggtgctttgttatggcagactcagaagaggtatctgtccctctactgcactggcagaggcccagggtctgcattcactggtaaaatgtgccatatttctgctttttggtgctgctttatgaatcagcagatactgttttcagtcatttccaatcttttcagctccagggaaaagtcaaaacagagaacagctatgacagactatgtctgggggatgcagctaccacaggcagaaccttgccttgggggtgaagacagaaacaatatggggggcttcaagtgcagggggttgaggtctttcatgtgctccaccactggatcaatagaatggtgatatggtttggctctgtgtccacactcagatattatctagaattgtaatccccataattcccatgtgtcaagggagagacctggtaggaggtgactggatcatgggggcggtttcccccatgttgttcttgtgatagtgagtgagttctcacaagatctgatggttttgtaaatgtttgacagttcctccttcacactctcgctctccctcacctgctgccatgtaagacatgcctgcttccccttctgccatgattgtaagtttcctgaggtctctccagccatgtggaactgtgagtcaattaaacttcttttctttgtaaattacctagactcaggcagttctttatagcagtgtgagaatggactaatacaaatggacttcttagaaatggaagctcccaccaccattcatcaaaactgcacaaaaccattgtctgtgaggctctgggacctgagctcagcattatgcacatcaaccttccagccggacgtctgagagaaagctgtgtctattaaggtggcagtgagcaaggccaacagcaatccacgtaaccctgcctgttggcaaatgctggcctagaaagacactccctgtttacagaaaaattaaggggagaataaagaatattgtggtatgagtggaacagaacattatcttgaagtcttaaagagaatacctatgaaaagaatgtgctacagaagcctgaagaatagtttagaaaaacagaaaaggcttttgttttgcaacaggatagagaacctggtctctgtgaaacagaaataaagagttacatgaagacaattcacaaggaaaggagaactgggtatgataaaaggcaaatatctacatttataacatgaatgcaaatttttttttaatgttaccatatggattgtggaaagatattttagaagactaacccacaatgacttaaatagagatttttcaggaatgctacaagggtttagagtcagcaaatcacttaattatttgtatcaataagacatttgatcaaagtcattatctattcttgaaaaaaatctagtaaactgaaaatggaaggttattttgctgacatgaggaaatatcttacttctgagctatgagatgggatccaattaatgttattgacaagataagtacctatattatcattacagtaattcaatattatccttttgaaaaatatagtcagaataattagaaccagaaataagagttctggcttttgcaaaagcaaagaaaaatatatcattgttttcaataatatgactgtctacctccagtaacacaggtaacatttactgaatcgtcaacaggcccatgcactggttaacacttaataagttcccagccaaatctccacagtaaccttatgagataggtgctatgattaaacacttaatgaacagataaggaaagttaagaatagagaggataattttgctcagaataatacaatagtaagcacagagtcaggtaagttggctttaagatccatttctgaatgggtacttccaagcaaatcaactgaaaattgaacaaaacaaacagcaactcaaccaagccaaaccaagcattataactagtaagacaaggctgtgaagtggctggatataaaaataaatactcccaatgcaaaacatttcctaaatgtaaacacttaggaaagataaaattttaaaaatttctatttttattaacaaaccaacaacaacaataactccagcaaccatatgatgagggaataaaagtcccgacattaagtcgtcaggtctagaggaagacagacaaaggaaaactatgcttcaagaaaaaaagactaactgtgaagattttgtgaatgtcccagttaattttaggcttcatataattcctaacaaaacccaaagattttggtgaagacatggggaaactattctaaaatacaactgaatatatcaaaagttcagaaaaacagagtaataagaggggccttgccctaaaataaaatggcagttattaagtatctttaataacaaaaacaataaggtcaaaaatggttatctatgtaacaggaattattgagtagaggcaataaagtagaatacatggaaacaggtcttaagaatataaaatttagtttatggtgaaggtagcagcactaatgggtgaaggaataagaatgatccaataaatgttttccaatataattagcaaaagtaggcgttttctctaatccaaataccaaaaaacactaagagtcctaatagaggttatgatgtttgagagaagtcttaaaatatgagcaggattatatcagatgaactagcaaggtaatattcacaataggcgggaaaaaatatgcaacgcatgctgtgatagaaaaacaacaacaaccatattcagacattcgcaagaaattggttagatggtgtgacagggaatgtcaagaaagaagaccataaaggtaaattggacctagttatgaactttagattctatctcacaagggatggagaaccaaccgctgaataattttaagcagatgagtagcatgttctgcttagtgttttaggaagatcacttagctggcaatgtggaagagaagtgggagaaatgagaaattgaatatatttaggaggctgatataatggaattatgcaacagggcaagaagaatgtggggaaaacgaggggaaggaatggagtcgagagctgcttaggtggtagaaagaagtagactaatggcaaactggtaaaagtggagtgtgagaaaaaaggtgagggtgaggtgtgagaagaggtcagtgtgatagtgaagaggaggggaaagtcttgatttctgcctggggggccgtagggtcactactggagatgaattcggggagcagaagggataatggttaggatatgttttatgggtcacgtagctgaaggagctgagctatgaccttggctcggggaagggaggagtgtaaaagctcatactcccagggtttgatttgtccaatgactactttaaaagaaaagtttaagtgttttttttccaccccctccccaactttcgggttgagatatagggtctcttctataagtagtttcttcaaattgaaagataacttatttcccatgacatcccagtttctgtttgtttttccttctgcaagggcaatccacattctttattttccttgtgtctgaaatatttctaataaattagctaacttatccctgaagtcatatccttcactttaataagaataaaatgaggccactctatgtattattaaacttcatttcaggctgaaattgaattataaactagccatagttcctctcatgtatcacaagttattgccctatgattcatgcttctgaatggttttcaatcttttagaggcagtagggaaactgtcttaaaatagcctgaatatagcgcaatgaatatttttgagaagtctgtaattttggaaacttttatagaaacatttttactaacaacgaccctggaaaagggaatctgcggtaggcttttaacgtgtgagttactgttgtttccttgcttatttttttttcctgaattactggtattttaaaagactacatttgtccccagataagccatcgtgattaaatgggacccttttatccaaaccctaagatctcagtggtgcactgtggcataagctctcttggcatcattctgtcctgaaggattacatttacatgttcaacttgcctcctctccgctgaagagttcctatcttctccccttctgagtcactctgtcacaaattactcaccacctcacagagtgaggtgttaggaagaataaagtccctaaagccagatagacccggttagaatactggctctgccaattccttagttctgtgacttggggcaagatcctgaggtccccaagcttctgatttctcattagtaaagcaggaaaaacaggagttccttcaacactggccactgtgtggctcagtttgtgatcctggagaagtactagcacagcatctagcccagagtgattgtgaaattctgcacacatctgcacatatgcatgggatcattgagcccaagatcaagtgctgctgcagaccagctgtgcagatttgggcaagacatccaccctctctgaagagatcaccagttgttttcctcagttcagttcctttcactttaagttaataataattaacaattggcagttctacgaaccagacactgctgtaagcacttcacatatgtgaattcttcaaatatagtcaatgaaaatttcttcctaattctggcaataatggacttatcacttttggttttcagcatgtttatgagttaggaaattttggctttttctcatgtcgttggtggtattttaatgagaagtagaaggactctggacaggggctgctggaaagaaactatgttaatctttctgttccttaaggacaatttacacatctgtcctccaattctgtttgcttacatttacaataaattagtaaccagaggacaatctcttttttcagttcccaaattatttagtggtatctttttgctatcatgccctaccaaagcaattgatatgaaatggtttatgtggagcacccagcaaactctctgacctattgtaactgtttaataaaggtttatggaataaacaaatcactttaatctaccaggcttgttgtgttaaaaatagttgtaaggtgactctgaccccatttgtttatagtgaacctctactactccccagtggtcacctatatttttcttaaaacatgcctaaaaaccatcaattttcatgcagaatttttcaaggaatccattccaagatttatttggatatagttttgcaaattcacttttaactctttttaaaaacaaagaccactagctcacatactacttttaggattccaaatgttctagtgggtagagtgatgagtttgacttaaacatatttaagatgttcagctgtgaaggcgtccagtcacctgtggtgctacctgtggtgtccagtcccacgttgagaagcatctgtgctctttgatggctcattttacagggagggcagcatcatctcggtcagtcacagaagtggaagaccagcccaggcagtggaactcgtcctctgctgcccaccccacctctcctcttgtaggtcatccttcccaggtcctccctctggtgacccccgtgaagtgctttgccccgaactcctgccctccttgtggagattggagtgagaggagctttaaggagccatggtcaatagattcatgctcagagagagtgatatctgcaatggaaaggggagctgggggaactttatattaaatggagacgggcctgaggttgcacagctattcacacagatcagtggctaataaatacaatgggcagctaccaagcagtaaaacagcagtgaaagcatcctgggtctgcacagccagtcccagtaaagcagcatccacccaggcatctgagcagggctcattcccactcagctggtcagtgtcctcccttgaatatggggtacatggagatttattaaattgctttgaactcagtcacattctgaggccagtagatctatgggtatggtaacctatttatgagggagtctggctttcctattaaaggtcatgatataaagtctcttttccttatgctataattggattgaagtggaaaagaaaattgatttaatacataaagtaattaatagtacaggttgtgcctaaacaaagcaaagatggtgatggggtatctgaccaactgacatttgggaaagtctcaaagatgtctagggcccttccaagtttagtatttcgcagctcagagttgtctctgaaacagctgggattcaaactctcacagagggaatctgtttgtaagactttgtgattaaagggatgggaatttgtactgtctttgtcagcttcttcagcccagctctgtgtttgcaaagggcttgtcatgcagttactagttcattcttttagctgtcatgtggtgaggggatttcttgtgtgtagtccttgctatttggtgttgcagctcgcttgtcagcgatgctgggaggtgcctcattttctggggcacactcatggatgtagtttagtgtgtttggggtgccggtcctgaaaaggagttaccatcataccaaaatgctaaaaggaagggaacggatgtgatgtgttcactcactgaacaatttgctgagtgccaactctatgggaaacactgcgttaggcactatgggagcatcagtcgaccctgaatccattttcctcaggaatttttacctctaaagatgtctagatcccatgaccttggagaagtaccttgaattggctagagaccaactggaatgttagtgcaggaagctgcccaaggttggagacttaaaaagtactgaattctgaagactaagggggaaggtttcaggaagactgtgctagagcagggtagaactataaccccaaaaatgttggctccagagaatttaaaaagtgggataaagcaaggcaatacagaacttgggaaaagtaagtgaaagggcatgtctgggggaaaggagggcatgttaagggagtgatctcatttctccatggatcccagtgttaggaaatatacaaacaacaatcacttctgtgcatcaaattgcacagataaaatattttgggggcaaactgaggctcagagagattgagtagcttgtttaagctcagatcactcatctgacccaatgggaatttgaccctaggtttgtctaattttttgtattcccacagtgatgcctgtttgtcaacaggctcacttcaccctctataggactctctgaaggcaaggtctgtgggcttattcttcttgtcttccagcactggcaggctcaatacttatttgttaagtgaagtgaaataataaatcaacacgcaggcgcctttagaacaagcctatgatcagaacagagaccaaaggcagatttctcaattatctgagacaggctgcccaagactctgcagaccccgaggttgggctgaccctcgtccgatggccccgggaataaaagagtcatcgagctgccacgacgaagcagccgcactgccagatgatgtgatggatgatggccacaagtccctctggactcttgcatgctcccccgcccatctataatccttggatcactgacgcagcatgatgtaatgggctttccatcgctctaatagtctggcctgtcagtgtggatttatctcaacatgtacagggacatggggcctgaagcctattcaggactatatgatggaagagctttaacaaaatgaagtgtctactatggcagacctcaatctaaccttctcagctccccagatgaactccctcccaatccccacagcacctatggtggctagccttggacaaacttagctcccttcttgaactacctggtgaatgaatgaatgaaataaaaaatgaataaatgctagatatgaattccaataaacccatagattttatttccaataaatagatggtacacacatctgtcaatttggaaagtagttctttgggaaactggtatgtggttggatttgtacagttcccagtttctagaggattttcatgtattttaaccagtaattaagactgtgggctctggaggccaaatgtgaagactagaatatcaggcttataatttaccagatatgtgaccttgcacaagctactaaactctcagacctcagtttatccatctgtgaaatggggttgacacaagaaataacagagataacacagataaacagcatgatcttcaccttcttatctgaattctggccttctatggagatggtctttcttgcctgttttgccgatgaagcaactgaagctcagggggattatgttatttgccaaaggtcacagtgtcaccaaaacccaggacagctagctcaccacagtccatcagccagagccacttccaatctgaaatgttcccaaattctttgtaattcaggtaattcttcctgtccctattaccccattcaattctgagggctataaacagctcccactctactcagaggagaagctggaacttgatctcctggaaggaaatctaatacatactgacagccccacttgctcagagccagagcccctgaaattacatttaacaccaagcagaaaagggaaggaagggcaggcttaacgaatccaaggctgctgttatttataacagaagagaaaacaaatgaatgctggtgcctgatcatgtttgccacttctcagcacctctgtccaaccagcagaagccctctattcacgtgcaacagtgagaacttccttttcacccacagtccttagggtttttcagctctagctgcccactggaatcacctgggtgcctttaaaaaacacataagtatgcagaggtacatgaaaactacccatagagagttcatattcaaatggtctaagacaggacctggtcttcattgctttctgaaagctcccaggtgatttgaatgcacagcccaggctgagaccacagctgtaggttgtggttattgagtagttgattggtttggaacatagagtcatctcatgttgtagaaattccatttcagatgaattcagtcacagaaactcatgatgcccaatcataaggtgttgtttcccaaaccaatccctcacccacttccagttcttgccaggttcttagtgccctactaaaatctggataaagccctccattttgcctgcataaaacctagccttggcacagccatctcaccctgctaaaactaggccatgacacaaccatattgtagaagcccttggtggatcacgaacactattttctcctccaacctccaacctgacacggaatacatacctgaaacacgcttcctccctctgcttcctcattgaggtcctccatgcctgtgccaccatggccctcctgcttctgtttgctctcccttcccacacagacacacaaggatgcttctcagaagtagccaagcatactgggtcatttcctggttggctctgagtcatacgggataaaatgcaaacttctcagcaaagcacttcacattttcacctagtttcctaaccacatttttctggggttactccatgtgatttacaccctagccaaactcatctatgttgcatttccagaacacaccattcactaccacacccctgtgctttggcccaggctgttcttttcaccaaatatgccctctacaccagtgcacctggtgaaatctgacttgttctttaagatctctgacacctcagggcccacctccccacctgtactggccgggccctgggcagagtctcttccagcattactgttcacagtcccccctactgcccaatggaggaggaggtgctatttttatgcccacatgagaagtgtttttttaaagcacattttcttgaaaatgacttggatgtggcctgaggacaaggtgtggcagaagaaggagagcggagaaaagaagtgaaagaagaggggcggagagagataagacggttaagtcatatgacgggtagtgggagcaaggggctaacaaagagactttagcttgcaattcttcggtggcatcttcaacgaataacagagaggccaattaaccagtttgaattgtttgctgtttagtgcttgctttgcttctctcatctctgctaattccctaaactctcagcaaaggtgactctatatgcaaatgccccagagagtcatttggaaagaaatcaatgcaaggggcttggaggacatccctgctggctcagagcagagtgatgaacaggaacagcaggtgaggcagaactgagatgcagaatttactggggcaggaaactcagagcccagtgacatggagaagcccatctcctctccaccccacacctcctgagctgtaaggacatgggcagaattgaaaaatagccctctggtattccccgcatgtgtgcatatgtggaatagagggaggtaggtcctaccttttatttaaatctcaaagatagagtgaccccaacaggtacttggctgatctgccagagcatgagtaccacacaagccaggctttcagacaggcgaaactgggcaggcagacgaatgtgcctctatactcacttgctcagctcaaatatgtttgcatgggaatcttggggcagaaagctttgtcctcatccctcagatgtcggctcaagactatacaggcttttaagcctccaaataaccaaggaaaaacaatcaagtcatgaaggcctttgaacacagttggtgatgacccatctgagaatagagagctccaaaataattacatttccccatgcagcccacagaaaagtgccaagtgcaccacttgcaaggttactgcgttggtgctgagtcgagcagtttgggccctttgtttcagagagcagtgcttatgtctgcaagataccaagtactcccagcagtgatccagctggacgtgcttccctgcccatcacggatccgggaagcttcctccaccccaaggaagcagggaaggcagttcacatttttaggagaccctatgccaagcactgaggcccgcactctttattaacagctcagtgccctctgtcttcttcctccaaggccaaatcttgattatgatcacttaaagatgagcagaggatgaggaagagatctcctgacctcaggataggggactttagccccatgggtccaatccaaggggcttgcaggccagatccaaccaatccagcctgccacctgcatttgcaaagttttactggaagacggccatgccattcatttacacattttctgtggctgagttcatgccacaacggcagcactgtgtagctgtgatacaggttatatgcggcccacaaagcccaaaatatttacttattctttggtcgcttacagaaaaagtttactgacctttgacatgacttgacatgtcccaaattgtattgttttcccccaaaacctgctcctagcctgttttagaaaatggccgtaggtgctaaaaccacgattgggcttattgctcgtttccatcctctctctgacttcccatttccattaaattaatgtgtcaactgattctgtaccaaaatctgtatttctactatctgtcaccttttttcatagccctgctgtagtggagttgagttctgtccccattctcaggtaagccatcaagacaactgtgggtctcggccttgcgcacctcaattccactgcccctctcctgcagaagtagtcttaaaaaaaacatatctgattttgtcatttcctccttacgatacttaatatgctttcatcacctacaaaaggaagcacgcgttctgaccttggcaatcaagaccctccagtctgacccttgacgatctcttcagcctcctctcccatggctacttctacatcagcagtgtagggttcagaaattccacactgcttacggtttctctgaagccatcatactgtttcatccctccatatcttagttcttcatgctgttccctcagtctgtaattccctctggataatttcaatctgaaatatccttcaagccattcaataccatgttcaaatgtcaactcaatcccaggaagacttccctgatgtcctgtcccgtcagcatggtcagttcacctattctcctcctttagcttatacatgcttcagtttttgtgcctttacttcattctaatgtccttccttggatcctctcttctcagcaaaactatagaattattgagaccagggaccctatttatatgcctctgcatccctaatctctaagcacaacatctaaaactcagtagatatttgttaattgaattaagtgaagaaatgtgtgaataaacaaatgggcgaatgcagacacagtcattatccccacattgccatctaagaaaactctttccactctcaccctttctttaccccagtaacttgtctctaaaaaagaaccagaagaaaaggggagtggacacagtttaatatgaggactaaggctaatgaccaagcagaatttccttttccattaagcaaccatttgttgagcacatactatgtgccaagcatgtaccaaattatttacatataattatctgaaaccatcgcatggagaggggtaaggacaatgagtagatcagccccatttttataggctaaggctagatagtgacttcccagggtctcccagtgagctagtgatggctccaaaggtaggacccagctctgctggctccagagcccggcggttgccatcataatgtgctgccttcctgagctttcctgcaactcagctccactgagttctacttgttatttaattttgtgtgaagcaaagttagaggctcgccagcctgaaaacaacccagaataattttgtattcgctgtcctagttagttttttttttttttctttttaagaaaaaataaatcagggcagcttgttccctggcctcattcccactgtttctaggattgccacacaacacagcttggtaggagccctggagtgggcagagctgacgcccacatggtgataggctggctttctcgagccttgtcctggggtcctggcggtgtggatggggaaagacagttagtcagtcaataaaaggaaagaaaaccacctaatcatgagagctgcagatggacttcataaaatgttggactcacgggatgcaggagagagaagtgtgttgggggtcaagagagctgggttccgtccagggtctaatataggcttggggcatttgtcaagacctttccatttctgagccttgatccacacctgagaaaagagacgactggctggtgtcatgggctgaactttgtctctctaaaattaatacgttgaagtcctaacccctaggacctcagaatgtgactgtatctggagatagggtttctaaagacgtcattaagttaaaatgagttcattagggtgacctgctccaatatgactggtggtcttataagaagatatttgaacacagacataaacagaggaaagaaaatgtgaagacacagggagaagacagccatctacaaggcaaggacagaggtcccagaaaaaccaccctgttgacaccttgatcttggacttctagccttcagaactgcgggaaaatacattcccgttgttgaaatcacccagtctgtagtactttgttttgacagccctagtgaactaatgcagctggatgcatcagacatccagcttctgctccaagctatgtcacccaagtggatgtgtctaattctgggatctcaactggagagaacaggatcatgagaggccaaaaaaggtagtcaaatacagaactgaaactatttaggtctgagaagagaaaactctgaaagaacaaactttccttcgtatgtcgaatgtaaaagggacaatatttgttgggctttgtgggaggcaagtggccaccctcaatggctactgccattgagagagatatgttgtctcagcatgaggcttggatgtgcattactttgaacttcctgtctttgggggcattgaagcaaaaacccaaagacaatgtggtgaaggtgatgctgagggctcccactgtgtcatggtggaaggaggaagtggcatgagtgcagaaggtggcgtgacatacaaaaccacttcacaaaactttctcaataaggagacaggctaccaaataaaggcataggattcctgtgcctggaagtcatcgggcagggttccaaggccaccaatagcaggtggagattctgactcttggtcaaagcctggaacttcatccatcagacaaatcttttgagtgtccattgtgtgttaggcacagtgcaagagaaggaaagatccagtccctgcccccaggcagttaatactcactccctcatccacagctacagtttgaatgtgtctccaccaaagttcatattgaaatttaagccctaatgcaacagtattaagggatgattgagtcacaaaaggtaccaccgtcatgaatgggattaatatcctgataaaagagctctaggctgaagggaactatcttttgatctcttccctccccactgccaggcaagacacagtgctcctctccagaggactcaacagcaaggcaccatcttgaaagaagagctaagccttcataaagcaccaatcctacccatgacttgtcttgggcttccagcctctagaaccatgagaaataaagttatgttctttataaacaacccagtcccaggtattttgttatagtagcacagagggactgagatactcattcatttattcattcatttactcatttgccttatcaaagagactacctcgaccatctcacctaatacagcaactctcagtcctctttccctgtttcattttccaccctaacacctacagcctccggccatattctatatttactgctcatgtgttaacctccttcactgaaataaaagtaccaagacaaaggaagcttgactgtttttttcattgctataccctcgagcctaaaaagtcaataaatagttggttctgtctatgtgcaaggcatggaggcaggtgctgaaaaatcagaggtgaatttgacaaatttgttccctgttttatggcctttaacacatgcaggatctcatgtgtgagaagaaacatgccaaccaaagaaaactgagaaaacagaaagaggtaataggtactgagggaagcactctaagatcagacactctaaaaccttttttgccttatttctttgaattcccatagtgtctctatgaagttaggtgctatcattatccctactgtacagatgaagaaaccgaggctcagagagatcaagtaacccgccccaaaccacatggtaacagggtttgatcccagatctgtaggtatcagagtatggcccttaagtctggatacccagggaccctgtcctggctctggcttttggggttccactagaactctcattcagctgtgcccatctgcataggggaaggaatctgcaagaccaaggggatgtgcctacctggagcccatgtgccccctgctgtcccacaactgagcacccaggaccctgcaattccctgcctgacaccccaagtacctgctgggctccatgggcctcatcctgttctctgctcctagaaaatcccaggccctgtatgagcatgaagaggcctaaggggaaacccagagggctgttttgtggaggatgaaaggagcttaaatgtgtgggctgggggtccacagcaggcatgtgcatgaagccccccatggtgtgggaagggaaggggcagtctggggtacagaggaccccacctgtacttgtactacagctccccactcacagaaattaggggcaggcctctctgtgggatctaggacctggggccttaatctccagactctatcccacaaccactatgtcccctctaccccagagccagcatgggggcatgggtgatgagcaggatgcctgctctctgcagtcacacaggatggctgggctgtgccatgttcacctgaaccagtgagggaaggtactgaatccagatggcttggaggaggagcccacatgatcaaggcaaacacccaggaataggaaagtgacataaggcacgggcttcccatcagctggccctcaggactcattgtctgcacactcccctacacacctcaccccactcagtctaaccaggttccctgctgcaggggacaacaacacccccagtgtcatagtcatgctgcctaagagtggggatagaggggcaaatcgactgaggctatataagggagaaccaaatccttcaccttcggcaggccaggccagcctcataattagagagacaagatggtgaggtggctataggtgtgtgctcagggaatgatcccctgagttccacctgacactgactctggacagctgggtgaacacgcccaagttacttgagctggcgcaagtgatttaaagtctcctgcaccccaatttccttatctgtagaacacagaaaattatactctccacctcaagtcttgtggtgacaactagagagttaatatatccaaatctacaatgagtatatagaacagtgcctagtacagagtaatgttcagtaaataccattttttacaatactccgtatctcttctcttcccctcaactcgagcacctcctttgtctttgggtattatagtttctggttcctaaaagtatccactctaccactctttctcatttttacctgctccttcctaggccacatcctctctcctgaattactgcaacacttcctaacaagtcacatgcctcacattgtatctccccaaagtattctcaggcccaggccacagagacctcctgataatgtaaatctgctgtcacatctctacccgcccattcagttactgagctctttactatcacgttcagcaggtacgcgctgagtgcctactaagtgccaggcattctctgaacactggaggaggaggattgagcaccagtaaacaagaacattgcccttatggaatttctcatggaggaaggcagacaatacacaaataagcaagaaagtagcaggtaacgccgggagatctgcagagcatgaaaatagggcaacaggcaggacctttgtaagccctaagatgtctccatgtaattgagaaaatggcacgccttcctcctgggtgaggcacccccaagtgctgttcagcccccactcacctcctccaccagccccaccatgtgctgcaacccaggtaacgaggtgctgtaacagaaaacacttaaatgctagaatcctccagtgctgaatttgcagctccaaccaagtcctggacggatttctaattctgtatatatagcaaaacgtctgctagtagaaaaggatactggattctgagattctcttgaaataaaccttcattgccatcaaaggcgacacatgtctttctggatttcagaggccatgcacaccttctcagctcccatcacaacatacgacagtggtcggtgtagctctggtccttcccacatcccaaggcacccccagatagctctaactaaccatgccaagcctctgcgagaaaaccttctgtggcattgtattaccaagaggctggcactcggtccctcccagatctgctcttgttatctctctagctttgacacagtgttccccaaactctagaggacaaacaaagcagcttgattatccaggcctaagaagacaaggaaccgctctcatcctcaggactaccccacatggttgtgcaaggtgtgccctcgcaactcatgaattaggccccctggagttgttcagtgcacaccctgtgcagctgtgtatggcagacctgggtagttagctgaatggtggcccccaaaatataggtctacaccctggagcctgtgaacgagatcttatttggaaaagggtctttgcagatatattaaagttaaggatcttcagatgaagagatcatctggattatctaggtgagccctaaatccaatgacaagcatccttgtaagagacatccagagcagaggtacatagaggcaaaggcaaagtgaagatggagtggagactgcagtgatatggccacaagcccaggaatgctggggcaggcacaagaacccaaacgaggcaaggaatggattgtcccatagagctcccagagtggacaagaccctgctggatttgggacttctggccaccagaactgtgagaaaataaatttctgttgctttcagacaccagattaatggtacttcattatggccatctcagggaatgaataatgcctgcaccaggtcttagtttaaatgccatttgctcgaggaaaacctccaggggatctatctctctcctgcagctgtgctgagtgctcccactatggggctctcaggcacatcaccttcctctcgacaccagcccttttgccatttgggggactctagtctgtgactttgccctccactcctgggcttgtctcagaagtgggagatggacatgtcagcaaaaactcacccgtgtcctccaaatgcaaggggttctttttcaaaatcttgagaccccaaaggcaaaacattaggagctgggaagtaagtgagagttccctagtccctgattttctgcagccagaaacatgtgtggacactttataaggcttatataagatgatggtgatacacacttgcagctggaggaagatgcagcagctgtcaggccacctcagccctggtggttttcccaggccacactgggcagtctgtcagttgttgtgtcccagaattgagagccccaggagtcagtggcaactgccgggtctgatggacataactttcctgccctacatcttctccatgatcagcacatcatagtgataaaggcagcgtccactggggtggcttctgataagccacgaacctgaatgttcccatttgtcccatttttcctggcttccagtccccttgggtggctggatgctgtgcccagcaggggaacaggagaagcactattgctaacactcatggagcaccttctaggaaccaggcactgtcctgtgccctttaccaggagaactccatctaacctcaggacaaccctgtggtaacagctctctctgtacactgcagatgaggaatttgaaagtctaggtggagagtttcccaaagtcacagagctcgtaataaaggccctgagattcaacctcaggctctctgcttccgaaactcatgctcttaacttagaaagccagagttagcctcagtcagggtctcagcctccaggaggatcacccttgagggctgactcagtctcacctgcagaggacccagctgagactcaggggtgccctcatatggccacccgtggggcctctggtttggaagaaatggcatcccatggttaacatctggcctcttactctagcaaacagactagggaaagtcatagcctgggcagctgtggctgctgcttcctcccctccctgtcccctcccctcttctcttctgatttctcctcttcctcctcctcctgctccttgttctctcaaaaaatatctattgagcacccaccgtactgaaggacctgtgtccactgggaatttagcattgtaaaggagacacagcatagtataatgggatataaataagtaaacaggaaaaatgaaataaatattatacccattgctgctgcaggagaggaagagatttccttgatgggctactttgtttatggcactgagaatctgtctcacaaaggctgaagatgaagagtgactggagaactccgaagcagtccagaagtctcaagagatctgagtcatcagggcatgccagtcagaagttctgtggtagacagtggttggcagtctctaagatgctctgatcatgcttgcctcctgacagtcacacccttgtgcaatcccctccccttgaatgtggtctggatttagtgacttgcttataatgcatagagtaggacagagtgatgggatgtcacttctgattaggatataaaaagactttgatgtccttcttgggggcctccttgcatgctctctctcactcttgccagcagggaacccagcagccatgccatgaggcagcccatggagaggtgcctgtggggagggaccagagcctacccaaaaccacgagtgagcctggaagcagactgttcctccccactctagctctcagatgagactacagccccagcaatagctccggagaaacacataagagactttgagccagaggtacccagataagccatgctcccatcagaggctggccagaaatgcattaggcattattctcctgcagaaggcacccactgcacacagtaggacagttctgacatccaaactgtgccacctctaccccgagcactagttctatcttccaggaacacacagagatgatgaatcaattcctttgccatatgatagtctttcaggtgtgggaagttggtgacctaacagtgggttcccctattctcagttttcttcactcctagccacacttttctaactggttctcaaatccttctctgtccttgtgtttccccacaacacaatatcccaattatgttcccataatgtcaagccaattgagctgtcttgtttctggctagcaaagctttgctcaagatgtgccctccacatggaattcccttcctctttcttgtctggcccaacttaccacgactgttccaagaatcctttctggagcctgccccctcagtctagctggacacctccctggtgcagaacctgtccttcctgctgcactcacctctcttcattgcatcgctgtgccatcatgatgtgtttgtgggtttgctcctgtaactgtgagcaccttgagttctgggaaggacccatggttcatctttgaatccacaacacttgttcagagtgagaggatggatgaatggattggatggatggatggatggatggatggatggatggatggatggaagatgaacaaaggaagagaggggcatcctccttagtagacagggttccattggcattcatcctcagtgctatccttctgggtatgtgcactttgtaaggaagcttctgtgcccttcaagataaagcctggacaattcctcatggcctaaagcagagcaagccttaccaacccctctaagtcctgcaggtacaagtgtcatgacttcagtggtaagaaagttcagagagagagagagagcaagcgaagagaaaacaagagagaaaatgagcctaggttaaaatatttaaaacatttccatacttcctggacttataaatatttcattagtaagatgctgtcccacataaatgcaaactcaggggaaagggtcttaggaaagctgggagtcagcattttaaggaagccgatttccctttataaacataataccttctcactgtaatgtggaaaacagaaatacaaagaagaaagaaaaattgatgtattacttaaagtcccatcactcaaaaccaaccatttttagtattttataaatttttgacctatggattttgtatatttggggtggttgcatgatactacatattctcttgtgtgcctggattttcttattttccctaaacatagtaatgtaaactttgtcctatgttactgtgaactctttatgaaacaaatttttttttttttttgagactgagtcttgctctgtcaccaaggctggagtgcagtggtgtgatttcggctcactgcagcctccggttcccgagttcaagtgattcccctgcctcaggctttggaacagctgggattacaggtgcccaccaccatgcccagctaatttctgtactttagtagagacagggtttcaccatgttggccaggctcgtctcgaactcttgacctcaagtgaccctcccgcctcagcctcccaaagcatgtgagccaccacacccagccatgaaacaagttttaacaggactacataatattccatccaggacatgtaccagctgggaagtcatcaaggcctctgtgatacagtggcagagacaggtgtagttgatttaaatcttcccatattgttgggcatttaggttgcttccaattttcttactatcagaaaaatgtcaaagttgtggccgggtgtggtgactcacacctgtaatctcggaggcggaggcaggcagatcacttgaggtcaggagttcgagaccagcctgaccaacatggtgaaaccttgtctctactaaaaatacaaaaattagccaggtgtggtggcatacacctgtaatcccagctactcagggggctgaggcaggagaatcacctggaccaaggaagactctgtctcaaaaaaacaaaaatagaaaaaagaaaaatgtcacagttaacttatttgtctaacctcaaattctttccttaagtaagttcctcagaaatacaaataattggcaaagaagacaacctttctatggctttttatacttattttcagttgctttctaaaaggactgtacctaaatgatctccccacagtgggatttgagtgcttgtctcccatgccatccccatctgggggccatgtcataatgcttccagatgagaatacctcagagataactgatcctggcaaggaggcaggtgaaacccaaaactcattgatacattcaagagcgtttcttgtagggaagtttcgctccttgatcttcagcccagacaagaccctcttccctggacactgaggctatttaacggcccctcctcttgaatcccactgcctgacttcagaccccatcctttctggcttgggtcatacaacagcccccacacttctgacttctctctgtcccatttattttattccccctctttcagccaaagtggtctttctaaaatcaaaaatctaaaaacaagtcatcttagacatttttcttccttccttccttccttccttccttccttccttgttttcttttcttttcttttttcttctttttttgaaggagtcttgctgtgttgccaggctggagtgcagtggtgtgatctcagctcactgcaacctccacctcccgggttcaagtgattctcctgcctcagcctcccaagtagctaggactacaggtgcgtgccaccatgcccagctaatttttgtatttttagtagagatggggtttcaccacggtggccagcctggtctcaatctcttgtcatcatgatccgcctgcctcagcatcccaaagtgctgggattacaggtgtgagtcaccgcgcccagcccatcttagacatttttcaatgactgcccattatcttgcacccaagtctttccatgatggtccccaacttctctccagtctcactgtctactctgcaactctatccccctcactttgtaataagtattcactaggtgctggtgacaggccaaagagtgtgataaccgcccagctactcaccctgggggttcttggtctgacagaggaattagagggtgacggtacagggtgacagagcccagcaaaggttggggatgtcaggtctcctttcttttcattcaaagctttcattccttacaactgaaaaaaggcaatttcaaaagagaatccaaattcaaaatcagagaaaccattcaagagttttgtgaaacgatccaagagttagtgattttcagaaaagcctgtatcaggctatggggtatgctgtcgggggaaggggtggaagaagcaaagttggggaaaagaatctacttcctccttgttctgtgtcacctctttttgtaggttcctttttcctcctctccactagtggttccatttatttacctgaaggactcctgcacctgcctgtgatgtctaacatgataaacaccaggaggcccttgtgctggagccttttcttccttccctctgcagctccaagagactaatttgtagagaagaggatccttctccagcagaactcaagtgtagaagggagctgagctggctttttagcagcagtgggaaattaatctgtgttctcaccatcacagtcccacacctgagctgccgtcctgttttcttgcctctcccacctgactgtgcattcccatagggcagggtctagggctgggcactttgggacctaccccaaccaatgccagcagggtttccagaagcaagtcacaggggtctcccctgcaccattggcatggcctccagctgtgcctccacctccacatctgtggaaacctcatgggtcagtgggccacacaccatctaacaccttccaagtcagagatccactttcaaatggtggctctatcccacatccaaacacaaggcccactgtagtgacttaatctcttagggtttctgcgtcctcttctgtagaaagtacctgcatgatgggggaggcagggttggaggataatattcatggagctccagacaaacagtaggtgaccacaaagagtaaaaggcacagcggtgttataaggcccataagatgaataacggggatctgaagccagggagcctgcctttgggatccacgtgcctaaacattgcaccaaccacctcctctctgtctagccaagtccccctgccccttgcagtgtcatatagttcttcccagtagtagtttatagtgctcactccctctccctcctcataattattctgtatgttgggcacccatcatcttataatgccccagtgcctattgaatcttttttggatcagagacatccaatacaactcatagctctctcactctaaaatgatcataggcacaggcaataattcacaggccctcttataggattgttcaggttgtgcactgcataagggtacctagccaatgggcctctacaggaatctagaatccagcccacattccattcaggagacttgagtccttgagaggaaagccaggaggaagaagtccattttggtaacaggtatgcccagagaggaggtcctttgtgcattttttccttctaaaaatgttgggtgccacctttgtctaatttgtataaaggtcccttattgcctaaagttggtcatgacacttacatataattccagaggagtggatgccccagaaacctgtccatggaacatcctggggcataaaggtttctcaagtcaagaactgtaaggctgagcatggcggctcatgcctgtaatcccagcactttggcagtccaaggcaggaggatcgcattgcttgagcccagaagtttgagaccagcatgagcaataaagtgagagcaataaacccagtctctataaaaattttaaaagttagccaggcatggtggtgtgtgcctgtagtgccagctactcagggggctgaggcaggagaattgcttgagcccaaggaggtcgaggttgcaataagccatgattgtgatcgtatcactgtactccagcctgggcgacagagcaagaccttgtcaaaacaaaaacaaaaacaaacaaacaaacaaacaaaactttagggtcagcacccaccacatgaatatatgaatgaagaagggctggtaccaacaggtcacatgttgattaacggtttgggactcatacagacatggcattcacaggtataaaagactcctcagaccccccagacctgccgaccttgcagtttggaaatcaccatgcacacaccattgctacaggaaaatgcatttgccctcaatgtgaggataaaaatcaatgtgcctaggcccatgcctggcatataataaatattcaatgcatattgccccaaaaaccttttgtgggttgattcggtgccataagactgaactttgaagtctggcagtatagaaatgagctttgcaaaccacttgccaagagaggaacatcataaatgcacatgatattcttatcatctaaatatttttccaaatcaattcaacatagtaaagataggaaccatcttggggctacatagggatgggctgggtaagagggaaaacttatgggcaaatctcagatggtcgaaggtttggagaaacaaatggcttctataatttcctttctttttggatttattgagtgccttcggtgtgctgggcagagtatactgggaagcactttgtagatatccattttaattctcacaatggccctgtgagagtatcagcatgcctaggaggaccttggaggtgaggaggcttaggcatggcccaaggtcacacattagtgtgtaaaggcagaactgaaattaaacacccaggtctgacttcccagtggtcctcctgcacaagggagtagctgggatcccagacccaggagtccaaccattgggatttaaatcccagctttgccatttcctacctgtgtgagcttggataagctccatgtcctctctgagggataataaaatgggggtgattgtggtactgacctcagagggtcacaggataagtaattattactatatgatagcacttagaagagtgtctgacacatatgtgctgttcatttcaatatcatcactgttgttttgatcatggctctttggaagctggtggtttgaccgtggtgttcagagggaagccgagggtgtgagaacactcagtagcgtcaccctcaaatggcgcccgccagtccagaattcccatctgtgctctcaggaacacaccggttgtttgttagcaaatgacctttcttgctgaggggatgctgacacagaaaaaattaagctgcttctggcagaaaataggcaggaaactggtcttcccagtaagcaatggttcagaaagaagggatgttgagacctcatggatatgtgaactccaagacctccatcacctcctcagtgagccttctcttaatggggcttgtacaacgtgggtcagggggagagggaggtcagctagcttggtcttgtgaaacctcaggagaaaccagtgttgagaatgaagagagaccacagggcaaaaccattaaagttgcatgcatactgaaaacttcctcttcccgcattacaaaagttcttgggataagatggcatgggaattggaattgagggtcctgggctccagctcttgttctaccattaatcaggcagctgtgtggcctcaggtcaatctattcccctctctaggcctgaggcacctcctctgaacaaagtgggggctggaacagagccaggagcagggcccttccagataagaagcaatgagttttgttaaaaataagaatctatgttgtatatcatttttaacttcttctgttcattaatccgttactcatttattcattcattccaccaactcgaactgggcaatctagaggaccccctcacccttcaaaaatctaaattatacaagtttgtcctctgccaattccaaatgcctaggaatgctttgctctttaccaccatgtaccatggtcagcttcttcactggtttctttaaaaaaaaacaaaatgcactcacactaaacattttatgagtttggatccttaagatggggcaggggtgaaaccccatttctactaaaaatattttaaaaattagctgggcatggtggcggatgcctgtaatcccagctgaggcatgagtattgcttgaaccaaggaggcagaggttggaatgagccgagatctcacctggagagggcttatatgacaagcaaacagcccctgtatcctgcctgcactctgtttatgcctcccagtgctttgccatcactatgaagtccacatttttctgacagtattagaaagattagcttcccccattccccaaagcctggaatcctggcgacacccagaccctgggaacagagatggggtagcttttattggaagatttataaacccaaacctatgaggacatccagcaacacaaaggccttctctgtaaagaaatttactcttctgagtgcgggcaacaaacataaaaaaaaaaaaagctcatcaaaaagttagataaggagtttcatccatgcagctgaagtcatcactggtcattagagaaatgcaaatcaaaaccacaatgagataccatctcacgccagttagaatggcaattattaaaaagtcaggaaacaacagatgctggcgaggctgtggagaaataggaatgcttttacactgttggtaggagtgtaaattagttcaaccattatggaagacagtatggcgattcctcaaggatctggaaccagaaatactatttgacccagccatcccattactggttgtatgcccaaaggattataaatcattctactataaggacgcatgcacacatatgtttattgcaggactatttacaatagcaaagacttggaaccaacccgaatgcctgtcaataatagaatggataaagaaaatgtggcacgtatacaccatggaatactatgcagccagaaaaaagaatgagttcatttccttcgcagggacatggatgaagctggaagccatcattcgcagcaaactaacacaagaacagaaaaccaaacaccgcatgttctcactcataagtgggagttgaacaatgagaacacatggacacaaggaggggaacatcacacaccagggcctattggggggtggtgggggatggaggcaaggggaggatgcgttaggacaaatagctaatgcaagtggggcttaacacctagatgatgggttgataggtacagaaaaccaccatgacgcatgtatacctatgtaacaaacctggacgttctgcacctgtatcccagaacttaaagtaaaataaaataaaaaaagaaattcattcttcttaaagagcagcctagattttaagtagtaaaaagtagtttccttcattgcacctatattgagcacgtactgagagctaggaactgagctggatccctcaaggagttctctgatatagttgtcactagctacatgtgatcattcatctaaattcaaatgaattgcagctaaatcacatttaaagtttggttcctcagtcacagtaaagacatttcaagtgctcaatagtcacatgtggttggtggctacaatattggatagtagagatatggagtatttccatcatcaaagaaagttctaccggacagttctggtctaacaggagcaaagagaggaacagaaaactatgccagccagaagccaaagcgtcaaacactgaggaagaggtctcctcttgagttcagcattagtgcgtgactacctcgcaggcaggagtcattcacaaacctcagtggaagaggtatctactggagagctgtcatgttcaatctgtttcaaccttcaagttagataaggagtttcatccatgcagctgaaggcacgttttctccgtctcaagaggttccagtcaaatgtcccctctttctgggccttctcctcttcacttctgagctcttcatcttgctcactcctgccacacccatggacattctaccttgcatcacaatcatatgcatgtaggtcttatggcccttccatctgtgagtgccttctcgtcccttggttcctagcagtgcaatttgataactgaacgaatgaatgaatcagtgaaaaataagtgaataactgaataaacaaagaaacaatgaaaacatgcacaactgtccattccactgtgggcttaatccagacctggtttctctgtcataaacctatccaatcactggtgaacttgaagaggttaagggtctgtgtcagctaccagcttattatctctctaatcttagaaacctgtggaaaaaagagacattcagagcatatccacctctaatcaacctgataactgcctatacaaaactctcaggcatccatgcagtttttacctggcaaaaataattcatgagtcattgtattttctctaataaaggggataattttgcatgcacagaaacatccccatttgtccacacagctctttcttcctattcctcctcttttcagacttggaaaagtgttctttctgcttgttaagcaaaactctctccatgtgtccttggcagtaacctcttagttccactgggtattgatccatcaatcattgccctgtccccttcccaattcatgtccactgttgctcatggtcagttttctgtaaatgtggacggaggatgatgatctcttaccatctctctaacactccctaaactcatttgattgcctctagctcaaacccaaaccatgaccctctctctttctttcaccatatctcctttaaaaggcaccatgtcttcacctccccctccccctgaaatccaactctgtccccatccattgatttcttttttcttttttctttttttttaaggcgcgtcatccccattctcattacccaaaccaccatcaaatttccccaattctcgccttctcaggtgcggtgccagagtagaaagggcaataagtaaggtaaaggtggccaacaggcagcccacgggcaaaatttggcctatggatgtgttttgttgggttgacaaggtatgatagaaatggagaaagttaacagaaaaaatccagattctccctcttgtgaaaaataagatctgataaattatcatccctactcagcgtcagctagcagaagcagtagttgctctctttagagaaactagagtttgccaccagtttcctgcaagcctcactacttcctattgtcttgccctagtcatgcctttcatttgaaatacttgctaatccctgtaggcatttgagtctgtaagtgctggactacagtttcaaatttataatattttacaataaatgtgtttcaatagttctgaagtatgtatagtcataaacatctaaacatcactgaataaattgggcatagattatgtgtagttcttcatcatgagatatggcttgtattctcccccatcacctactgcactataaacacattttcttacacatgtggtttttgtttttacaggcatgtcaaagaaagcatagggccacttcttcagggctaacgtattgggcattgtgagctttcctgcaagctgatgcctctgtccaagtacactgaatccacagcacacagcgcttcaatccaaccctgctgtaacactgaacatagtgtaaggactgctgggactgctcacctcttcattcttgaagcatctgctactctcgtggtgaatcacagtgttcaatggatttgcttgctcactccatttcatccatgcactcaccatgtcacttattcattctttattacagttttattgagagtacactgtgttccagaccctgtgccaggcacatggaagacacatctttgtttatacccttcccatggtgtctacatgacactgcctgtattatatttatctgtgttcatatcttgcacaagaggttgaaaccagtgcccaggcctaatctttctgtgtcccaagcaccaagctggggaaatacccaaggaagcctccataagtgcttatgaaaattgaatttgacgtgtatacccaaagctggcagaggctggagaagacagaatcttgctaaactcacaggagtcaaccccaaggctctagctgtctcatcaaaggccatctgggctgaggcatcatggtcagttcagcaaggcagaaggagggccaccaccaaggtgctgctggtggcttctttagggaccttccaatgagaggtttgttttccagctactcctaccacccaagagatactcgctccctgatttcccaagctggaggtggcatgcttgtggagacctccacctggtgtcctgggtggctttgcttgtggctcttccagtttctatagtgtgcagtcttcagttccatattttctttgccaccctgaaatgaagggcgtatctgtgccaaatctgctcaacgaagaagacaggaaatgaaatgagatttgaagccaagttactactcctttttccaattttaagactgtggctgaacagatgaaagatattcagataagtggcacatgttctttgtgtttaaatagagcttgttgctgggcaataattggcctctgcatgcaggtgcctttggtgagaaatccaggcttctttggagggatgatctgagtaagtgcacaagcatattatgggagatatctaaggaggaaaagggattctcccataatacacggtgatctcatctgattatatccaggttgcaaggaaatctccacaacttacagagtattatagggtcagtaccctattctctactaacataaatgtataaacagcccttacatttactacacatttaacatctttcccagtgattttataaatgcatcatattcaaagacattgccaaatctaaatctgtgcatgtgtctactgggaggctatctaccaggtgccatttgaggaaactgcacaccttccttcccctttgcctccacttattagacctgaataagacagacatttagtgagtttgttctaagtgctgagcactgttctgagaacttgctatgtattaactctgactcctcaagaaaaacctatgaagttgtgtaattatgatctccactgtgcagatgaggaaactgaggcctggaggagtaaagaaacatggccagagtcacacactcatcacggtggaatcagaatttgtatcttcagcacctaggcaaagaaaatagggcaagtagctttgtttatattcctgggagagatcacaacataggctacaggttcagggtatagaaagctggtggggacagttgggtgaaggcaacaggtaaggtcgaggccagtgcagaaggagtaatggagactggagaggaaccagttggtggagttacctagagaggagggggctgggtgctttgcgtggggcaacttacgagcagcagtttccagaagcttgggagaagggagagagaaggtgtcaaaagacaaaggatgtgaagtaacccaaaggagaggacaaagagctgagatagagtgaccagtctctcaaggtcaactttcagctccatgtgatcaatggtacagtttcactagagcatgcccccctgtaatttgctgatccaggggcatagattggtggccctaacttgctgagggattttaagtgaatccttgctcctctggggccctcaggacactagaatttatgactctgatgaaatttagaataatattgattcacaagtcagaaattaagatcggtgatctggttaagtcatggagcagctacattcatcacctactttctctcacgtatgaaatggaaccacccacacccatcctgccttccttagatctgccttaggatttaaaaagtgcaatgaaggtgaaatacatttggaaccttgaaaagagtacataaaactgaggcagagtgatggtccaggaacgtactcaagcaactggtaggtagtgagagcctactccgtgcaaggcctgcatgaggcactggggatgcagtgaacaagatgagcttcaaccatgatagtaacaccagatcaggaagacagccaccacacaaataattcctggagtacagttgtaataaacagtatgaaagaacaatcccatatacagtgagagcacatactttggaggaaggcaacatctggtttgaatactgtcttgataatttccaactggggaatgtttttctgcccattgtttaaagcactctcagtctcattacccctatctctgaaatgcaagtcttggagggtggtggggaatacgatgattatcacagagctgtgcacataataagagctcagtaaatagttcttgtatgtcatgtagaagactacagctacattaacaatgatgatgagataatgaggatgatgactgataatgatgatgataatgatgaaatggtgatgatggtgaggaggatggaatggtgatgatgatgatgatgacttaatggtaataacgtgatgatgatgatgatgatgatggtgatgatgatggaatggtgataatgtgatgagtattatgatgggatggtgatgatgacaatgatgatgatggtgatgatgatgaaaaggtcatgatggtgatggtgatgatggaatggtcataatggtggtgacaagatgacgatgatgatgatggtgataataatggtatggtgacaatcatggtgattgaggatgctgatggcagtgatgctatgtcagggcatgaccatcacttttccctttcttctcttcccagagggctcatatgagctaatctacaagtgggtctggaactttaagccacatatgggtaccctgcttgggctgtcaggttccaaaaaaggcagattggcatttccacactggttttctctggctacatttcttctgcctctgctcatgcaagtgccacttcactctgagaaaatgccagcctctttgaggtgagctggagcctagagaggcggaggcgggagcatttccaaaggtcgggatgactcagcagtcctctgaaaagcctctggtgatagggaggtgatgctgtcagaacaaggaaatactagaaccctctccaccactctccatcacagctaaaagcttgccttgccatttctttgccctcttctgcaagtctaatgagggaatatagatgcttactatatttgagctgcaactaatgcttcaactctggaaactctgagcaaactccttcatgtttgcctggacaaatctcccaggagtcccaggctggaaggtaaactggtaccccaaagccacagggtctcctaccagacttgtttaacctgcaggacagagtctgggaggggagaagaggaggtctcacctcacagctgttccctctagtgtgcactcctcagaggacttgctgatggtagagctgccccaaatacaaaacggctgttttgtgggaagggaagctggcaaagcttctggagacactagggagggagaatatagtatagactaggctaaagtggagggcagcagtccagggccctgatgttgtttcgacggcgttgaatggaactccttctaggtgaagatgctggtagttttgccatcaccctccattgtcttgtgtgggcggattcacgcaggtaggatacctgcctggcccctgtagatgtctgagtctgtacccctgggctggatatttttaaggataccttctgcccctggagtctgtagttctcagaaataagttatggtaaacaaatcacccaagaatgaatagccattgattctaatcctgactttgccaatggaattcctgccaagtccctggccctctctttactcatcaagtatttcaatggcctggaaagtacccattcttacctttccaggcatgatgatgcgatggcaatgatgacagtgatgatgatggtgatgatcttataacactgcatttgcttactttgctctttgctaatgctcccattcttggaatacaatagtgaacaacacggttgtgttctttgaccttgtggaattatttgctagcgggggagggagtaaaaaagggtatatataaatacttaagacaatacacaatggcaaatggtgacaaatgctgtgaggtgaaaggacaggcccctcagagcaaagggcagcagcaacctaacttacataattcatcaaagaagatcttgttttaaataactactctttaaactgagataaaaaatattagataaaagttatccaggtaaaaagaggaaaaccggccgggcgcagtggctcacgcctgtaatcccagcattttgggaggccgaggcgggcagatcacgaggtcaggaaatcgagaccatcctggctaacacagtgaaaccccgtctctactaaaaatacaaacaattagccgggcctggtggtgggcgcctgtagtcccagctacttgggaggctgaggcaggagaatggcgtgaacctgggaggcggagcttgcagtgagccaagaacacgccactgcacttcagcctgggcgacagagcgagagactccatctaaaaaaaaaaaaaaaaaaaaaaaaggaaaacccactattccagataaggggagcagaccttgaggatgctccaaggcagggaagagttggacagttctctgagtctctattgcatttcctacattgtaatttataattgaaattcttcattatgaagactgtgatctgctcctacaagttaactctaagtcccaccctaggagaagtgaattactatttgcagctgctaatgaaaaaaaaaatgctgccaggatcataagccaggatatgaactgccctaatttggaatcagcaccttcagaggtggttacttagcccttaaaatatctgtgtaaatttgcaacagacggtttgctggacttggataagggctgttagagataatttttcatgggtgaaataaatagtatttacattagaatctgacaagccctgcaactgagggtttctctgctgcatgggaaatccagtggggcactgtccaacagaactttctgtgatgggagaagcatcctacatctgtgcaccactatggtgtcactggccacctcaggctgtagaacacttgtaatgtgcataaactaaaattttaattgtattccatttaaattagtttcaatgcaagcagcagcatgtggctagtggctaccatattccacaggtgcagaggctggcggatccaccttctctcctcttcacagagggctctgtcatctgattccacactaaccaggcagtcctgcttcaaaagatcatcgtgttcacctgaaagtgactccttcttgactttctaggctagtaaatcgtttgcaatactgttcattcctttgccttgcttttcacatatgtggtagtgaatgtccgcattttggcagaatttagtcataaacttgctttcactgtaacataccatgtgcacacaagattctggggaggaaacagatagtctcccacctgtaccctcggggcccacctatcactagctatgagaagctattaatattcaccaaaataatctgactctttcagaaaagccaagttgaactgagtctgtttccaacagccttggtttcctcacctgtaaaagcaagaggctgagctagatggtcctggagagcccttccacacttccgccctgggagcttgtcacagtaatgcagattgtcagagctggaagagactcatccaggtccctgatgctcagggaggtgaagtggcctacccaaggtcacacagcaagtcaacgcctcaggcagcatgtgtggctaagtaccctggtttctattccactttaatggggagactgtgaagacagatttactttacactaaactagtatctaacgagcgacttccaaatggaatggaacaacccacaaaatcagaagcacagatgagagatacgctgcatttttccttactttacagatgacggggggaagaacagaaagagaagagagaaagaagtctgctgtacttggtgactcatcactgacaaagcggacttccctgttccttcaatctggacttgtcacgtgacttgcttttgactaataaaatattataagatgttagcagatgtgatgcaagaaggggcttgggatatgcatacgcatttgggtttcccctcttacacctccaccaagccctgaaagaacatgccctaattactccacatatggaacagattcagcccaggagacctgcagagcagacctgcaggtagaagaaaagccatccagccaagcccagccttgtttaagcagctatattcttcctgaaagcatgtgagcaagcccagccaggatcagcagaaccacccaagccaacctgcagatctaggagaataaaaggttgttttgagccactgacaattggggacagcttgttacacagcatttttgtgacaacagctgactgatgtactcagaggtgaaatgacacgctgaaggctacaccactagtaagagcgtagctggaattcttactctgcatcaagcgagatcatgcttcatggatggggaaacatgtaatgaatcatttaaatggagcctcttttgacagtgaaaaggagcagtgaacattactttggacctgtgaaatgatactgaagtgtaaggtgcctccccactcccaaatggcacacttagtgaggtgaacacaaacattgttggcagtccggatacatcttgcagacactgaagagttcagaacgtgtaatatctgcacaggttgacacacagacccaatcaccccattgcaaacaagttccttccaagagaaaatgtccgggtttcagattcatggtggggaggggctaggagcttcagccctggagatgctggctatactttgctctaactcgccctagctggtgccactgccaaatgtttcagcttccctttgttctagtcttcctaacatcccagggacagaagggtttacaggtaagatcccgaagtccaccgaggccaagctacctgttgtaatcacctagccaatgagcacccagatggcactgattccaaagcaggggccactgcatctgctcatcccagtaagggtgggcactacaacatcctaccaaggatcctgccaaccaggcaagcggggctctttcctgggagcacctcagagtgcaccacagagcaaagaagggactgcattttccatctccttttccttgttcttcccttcctgacaaacagtctagggcatctagggtggtcagtcagcattcctcacgcacgtgagtcttagacaaacactacctggtattggtttaggcagccatggaggaaatgttaccaaaccctcaccccaagtgcccatgcaattctaccagccttctcttctggaattctaagtcctatttttctttattagaacttaaaattgaaaactcaagagagaggaatttttttttaacgaagcaaatctattcgtgtggctaatgacaggaagctcaggggttggcctcaaactccaggtagcgacgcttcacccacctgacctactcgcaccccaccactaataactaggggcctggcctccctcaccaccccttcccttccccacacctccactctcacacatttctgcttcccccacagtgacagatcccattaatacaacttgaatatctgccaagcactaagcattctctaggttacagtaacacaaatgatcccatttatgtccaatcctcaatccccaaggctgggatggattattcccattgttcagatgaggaaagtgagactcacagacataaattgccaaatatcatcgagcttagccagtgttagatccagggctgaactggtttgtgtgtgacctcaaagaccattccccttcttcctttctgaaatttactcaatcaaaaactacatccctggggatactgtggtgaacaaatccaaatggaaagcaatctcctccacccctgccccaactctctaatttctacgaaagtcaacctcactcagagactgacgggctcaccccttagtgagcccattgaagcccacggaggaggcccactaccagagaccccagaatccttcaaatataggtgttccctcctccacagtggctgtggggctggaagtaggccctcccagtggatgaccatgagggtcacctgctacagctcaggctgtacagctcagggcacagggcagggagctttgcccttcccgtgggtggcactgtgaccacttggaagcaggtgactgtccttaggctgtggcttgagaagcatcccactcactgaaccagaagcagcctccttgactcagttttgcttctttccctgagaggcactggctatagggataagacaatcactttgggttccaacagatgtgaatttaaattctggacctgccagctgacagtgggcaaatcgcttctgctctctaagactcagtttcttcagttccatctggggtgacttcaaattacccccaccgcacccctctcagcagggaaggaagtcagcaggcttagagtcggcattatagctcacaagtgtgcagaacataccatttgccaagccatggtttgggctcgttttatgaattaactcaattaatcctaataaaaatcccatgcattgtgagggtggcactgttttcaacccacgtttagacgaggaagctcagagagattatgtaacttacccaaagttacagagaagaaagcagctgatctgcattttacatccaagcagtgctgtaagacagtggttctcaccaggggcggggtgttaggagcagaaataggggacaaagggatgatcttgaccccccaaggagcattcagcgatgcctggaaatggttttggttgtcacaggtgggtggggtgctgcgatcgtctagtgtgcaaggatgctgctaaacattctacaatgcacaggaacaagactcctacaacaaagactcacctggccagaaatgtcaacaatgctaatgctggaaaactctggcgagttcaggaacacagagcaggactcgcttaggaaactcactgccccgagctgctgtgagggctaaatcagaggttgcctgtgggcaccctggcaccacagtgcttgcagggaggtgttccttagctctgggggtgacagatcggaccgcaaggtggcacaagtaagtgatagcaacagttatgccaaagggctcatccttttcctttgattttatttttcattttttatggagattacgctattttaacactgttgtggcaaaaatactcagtgactcatgtgtcatgattttcatagctgatttcatgagtttttgacagttgatggtggttcctatagttagggttattttctgtctttgggacagtgtggggaaaagaggttggtgctcaaggcacactgccctgaccccagttccacactgggcatgatgtcccaggaaggctggtttggattcatggaagggatggcatgagagtgaagcacacaaagtaggattttaatcccagcactttgggaggtcgaggcgggtggatcacgaggtcaggagtttgagaccagcctgcccaacatggcgaaacactgtctctactgaaaatacaaaaaatgagccaggcatggtggtgggcgcctgtaatcctagctactcaggaggctgaggcaggagaatcgctggaacctgggaggcagcggttgcagtgagccgagatcgcgccactgtactccagcctgggcaacaagagtgaaactccacagcccccgacccccagccctccgccaaaaaaagtaggattttaactggcagacctgggaggaggcagagggtggaaagaagggaagggaaaggaagggaaggaaggggaagggaggggaatttcaggcagaaggactgtcagaaaaaaaatattgatcgacaactaaggacaaccattgggcacatggaaacggtcaaaactgggaagttgaacaaatgtctgttcaaactttggctctttcactgaagagggactttgtgcaaacctgctaatcacttacggtctcattttctcaactgtaatttgattaaacaatacttgctttcaaaaatgttggttttttctttgggcagctgaagcaggcggatcatctgaggtcaggagttcgaaaccagcctggccaacatagtgaaaccctgtctctactaaaaatacaaaaattagctgggcgtggtggcgcacggctgtaatctcagctactcaggaggctgaggcaggagaatcgcttgagcctgggaggtggatgttgcagtgagccgagatcatgccactgcactccagcctaggtgacagagtgagattctgcctcaaaacaaacaaacaaacaagcaaacaaacaaaaactttggatttttgtagcaacaagatgaggtcataggcaagagagaacactgtaagctctaaaacggctgcagatgaaggttaactagagccttgtttgtggtcatgagtgtgtgttccctacttgtctactaaaaagggaaagaagccctgagccaggtactgtggggaacacacagagcaggaatatagcacctggctcagcactttgaccaaacaggagcttgaatagcgaaccttctgtgaaatgtaggagcttgtctgatttccctcctagtgcccaccttgggctgaccactcacagaacccccatgtgtttgaagaaaagctaagacagatatctgcaggagaggcagctggctcctgtgtgctctcatgggatggaattcaccattagtcaatcatttattttcagggtctccacccccataggtagactcacattaactaaactgatacatacatacactagcatgctaaatgattgctatatagtgagaacaacggccaacgatatcagacaatacatccataggccagtttatccctgcagatcacctgtaattagaaattggcttggtaagaaaggaatcaaaacagggggcattagttatattatctgagtgtttcatggccctgaacttctagccagcctgacattttcatctccatttcaaggatacagagccactaagaccaggcaggtcgtattctggggtcagcacaccctctcccctgaacaatgctcagaggacacttcccacctgcttctcagactccccatatccatacttccatggtgagccaatgctacttctgatgggcaagttattgcctctaagatgttcctaccttccgtgagatgacagcttggtcttgctctggactgagagccattctgccatatagatcttggatctcctcctctggaggctgaattcctggccagtctcatttcctgtactgctgggcttgtggagtcagtggggcacccccaataatccctggtagcctctgctctttacagtcctcagtatacagccactggttctggggatgggtttgagggacatgggttcaacatcccagcagccttcctagatcatcaccctggcattgtctctgcgactgccctaaggatatagccccagaaagcagtcagcaacaggaccagttctataacagtcctcatatcagcaaaaaacctctagggaaagagagaaatgttccttgttctttatgctagttgactaagagcttatctatttatgaaaatgtcacaaagcacctctagaccagattgaggtcaggatttaggatgctttcctttaccttaatgcagagctgtaggctcaatgtgcataaattactggtataaaaacacctcaaggctatttgttaatcagtggtgagcaaggatcacatatctagtagggcctaagatgccctaagatgctgtccagggcctctgtgcctcccctccactccagcaccatcacagccaccctgatgactgaaggagtcctccagtccaagagaagctgtccctccgttatctgtccagggagaggcccctgacccaagctgagccaatcagaatagttcactctctgtcacagtgattggtccagggattgacatgtaaccctgagtctgccaatcaggaccctttcctggaaattgatgagagtttaagaggaagagcccaaaacaatcagaaggtgagtttcagtctggtagcaatcgtgtttccatgccctcagggaagctggtctaaaaaaataaagctggcaagcaaagagaaaaagggatgagaaggggaatgctggtgggatctgagtgttcccctggtttcttttgaacctgcccatcacatggtctgctgacatgagctcatatagtcccctttgtgcctagtcttcggaaaacacagactttatcacttaacaaccacggagtctaggcttactggacctctgagatatattcacctaccagagtccctcaactacctgatcctgaatttgccttcagaaactccaaagattgcatggattctccaatggtccttttactcggggagagtcaaataacaaaaggcaaatgtcatcttgatgccaagaagtcaggtaaacatggctttgaggccaggctcacctgagtgtggatgcggttcatgaaggtgataagtcagataagcatgctacttctctgagcctcagttttctcatctataaaaatggtgaaaatcacagggccattggtggatctcctgagactctcagcacagagccaggcactgagtggaggctccatgaatattagttccttgttattcagaaagtagcagaagacacaccactgctcgcaggctgctcaccttcagccatcacggaagaaatataagtgttcattcaaagtcaagtttctacaagaaaaatgtgctgggaagagagctggactggggcaggacagcagggactgattgaaaagataagatagcagcagtgtgacagctttgatgcccactactctacgaagcaggaatgatgtttttaagactacacattcaagtatcttcctactttgaggctctgggccctctggatatgagagctgtcaggtagacctcaagcctccacagagtggctggatgtgtgtccactctgcagactcatctttcccctcaggaataacacacactctagtcttggaaacagaatatcaggaagctcttgagatcaggaggaagccccatttcctgatgtataattatcggcaacaaagctggcatctacgagaccccatctaactgttgtgctatttcttaattgctttacaacccagagggaaagggactgtgattaatgcccttctcaaaaactccagcacctggcacttagtggatgctaaataaatattcattgagttgattttgttgagtgatggcccaggaatgggatggtcaatctggaaagtagtgagatccccatcaaagagacaaaaaacagagagtgacgactacatgacagaaaggctacagaggcaatttcaatatgagttgtgaattggattagatgtcttttaaaatatgtgccagacttgaggttttacagtcacgtggctcaggagagactatagtaaatctaaaactattttattaacaacaacaacaacaacaacaacaacaaaaactaagggccttggaattctggaagttgagtcacttgcccagggaggaccaaaaacatcttgaagatgatcatccctttctaaatgagccagagaataccatgctactcacccagtcagaccatgtggcattagattcatttgacataaaacaaaaataatgcccctatcttagcttgggcttccccaaaagcagaacccaagaaaagggctgggagtggttcctttggaaggtaattcagcgaagcaagagtgaagaagtgagccggtagaggaagacaggcagagaagtgcgtcaatgtgagggtgtgctgtggagaacaggggctcgattctcctgagaccacatgagatactgaaaaatcttccataattgtctgcacgaaaggcaaaagactggcacatttatccatgtctcctcagacaatgattgtgctggcaccagggtcgctctctgccctgcacttgtggaatgagtttgcctgcacacagtgatgtgaggtcagtctgcaagtctgagctgccccagccagtcctagccaaaaggagatatgggatgagcgcaggagacatgggcaccacaggcagctgcagccctaaactcatcactccatgtcgtccagatctccaaagtcacagccctgtgtgccagtctccaagctgttgcttctgtgatcttcctgagactgtcttccttgctcaaaacccacaggactacaagacaagtctaaaacccttctccatgggatcccccactccactggtccatctcaacctatggctgctcctcctccaatcagaaccttccccttgcactccaatgagtcacctgccattccttactcatgtccttccctaaaggcctttgtgctctggcgcaaagagctctgtctggaacaccatttagtttcattcccatccatcaaactccatcccgtcctcgacagcccagctgaaacatttcttccagggaatttgctcccttgtgagtatacttactgagttgcattgtaatttgtgtaagtgttggtgtcctcacaaaaaaggagcttctttaaggtcagggataaagttgtaatctaacttcagggccatccataaaggagatattcagtgaaaggtggctgagtaaatgaatggatgactccagaaaacttctcccttcaaggcctcagcttcttccactttagaatgaagaagtgggaggagctgaattagagtttcctgcagcattttctgagaagtcctagcactgccagatgcctctaaagaacatattctgaggcctaatgggtttgagagatgctttagaccccctctgggagtcactgtggctctacagagaattcctttagtctctgtttaagtcaacaatgcccagatccattcagccacagaatatctagaggaagaagtcaaccaaagaaggctcattgggtaatgttagctgagacatgactttggctccttccaactcaagaattctataatcatcatcaaactctgatgaagctgaacattacaaatatatgcgtttgattcagaaaaaaaataatatcccagagctctccaaaggtgaggaggcacgaagcttgccaccatgactggggctgttcaaaaagaatggatggtccccagcacttcacgtggaattcaaatatgggcaatatcagggggtcttcatttggggtccacagacatgcttgtgggatgagtatgaacccctgagattatacatgaatttgtgtggatgtacactgtcgctgaataaggactcaatactttcaatgcattctcaaaagggactgtgagtacctaatggccaaggatccctggcctacataagggttcagaagggtagtgcataagaaacgaaacacaaccaaaccccatcagctcgaggatgagggaatacaacaagtcttggaaccatccctctccattgctggaattctgcctccaatactctcactaaagaattatctgcattaacactcattatgcttgttacctcttcaccttggccccatacttgacctctccatatcctcatttccttatctgtctattgggaacagtacagtataattgggagggtcaaatacagtgatgaagcatcacataacttgacagtttaacggtagtggggtacccaaccaaatcacctgccatttaaaaaacaggaaaatcctcactcagtttaaatctaagagggagaaatgtttcatgtttgattcagatcaggggtgtcttgctgtagtctacattttatatctaaacacttgccaatttcccagcattgttggtgcatggattggcatgaggctccttgctccttctctctcataggcttatcattcctgaagccctaccagggtgctcactgtgtcctgctgggtgctccagggaaggggtctgtttcctcttaagctcctctgcttgggtcaagccatcagggacaccttcactgcaccatgttacgatgcctcttggacacggctagatttctgcatcagaaagagggctgggtaccaattgaatctgcttacacactccagaaagagagtccttggggcaaatccagctgtggattgtgtgacaaggtgaaagttcagttagtgcttcctaattgtgtgattggttattagagaaactagtaatgatgacattagcataacaaataatttgatggagtttacaaagcacctttgtattcattcaattaattttgttttccaggcacacccaggtcaaggcacttgcctggcaggtgaataagatccctttcccaggaagcccaggcccatgcactgccacatctgccaacttttctcctggctctcacccactacttcctgctagtgtttcctcagcttctgacttcatctgcatctccatgcctgcactggccccttggatctgatacagatttagtttctcaggcttgaactgggcaccccacttcccctgatgccatctacccttgacttctggttctcacttctcccagttacaactatccaatatggcctcagattttaggactctacagcacagctaggtcaatgaccaaactcccttgcttggggtgtcaaccacaaaatgacaactcttgccacagcctgcaaatctctagcagtccagcccctcagagcctccctgtctctcctccccattgcttctgttggtcccactgggctggcttcccagctgttcttgaagtcagccaagcaactctgtctagatatctgcagagccccttcttctatgcccccttcaccctatctctcatccctctttattttgcttcctcgcacttatctgcacttgacctaagagatttggcttgtttgttgatgacccatctcctctcaccagaatgtgagcctcatgggggccgaggcttcattttctcccctgctattgcccagcacaggaacagagccaggcacataggaggggttcaggaacctctggtggaatgagtgaaggaatgcactttcaacctcccagaggctcttgaaggaggcgccacctccagcccagcccttgatctaagccccttctggcagagacctcagactcacgacaagagctgctagctgtgcttccaggcccctctgacatctctggtccctcctctttcctccagtctcccttggacatcacctcatttacttccttcttagtaatgttcacggtccatacctcccttgtgtattccttggttttctcctttcctgtctgttttgatcttcagaatataagtgtcacgaaggtataaacttgatatcttttggatgcttggggtccaggccagtgcttggcacacagcagttttttataaaaatggaggaaagaagacagggagggactgtgacctggcttcagcatcactgcccaggcccttcagggccatgcttccaccaggctactgcttggctcttcattatggcctcagtccagaatgccactttttgagtgctcttatctctctggtttccattccaccctctcatctaataaccaatgcaagcttcccaaattccagcttgttttacagataagggggctgaggtacatatcaatgaggttactgagctaaggcaacagtgaacaaactggtatgcgagactccaaagtccagacccctgaccactttccaatagcctctctgaagccaagtagtttgtttataagtggagctgcacagagaacactgcaagcaaagaacaactctgactcatctgatgcttctgcggcacgaacctcctcagctcctcactccaaggttcccttagcaaaactctccccaaatggccatacctggtagctccaaggcagagatcttttatgtctaatatgttctttaatgtactgaccttttaaaattaatagaatattttttatcatctgaatttctcagagtgaggacttgcggttcattgttgttttaattatgccttagaatagcaacctcgtttatcaggctgcaagattactgtttgtgagaaatcttcctcataaagtaaaaggatctaaacagaacactcaaaaagaaaagaaaaataaaatgaaaaggttaaaagaaatgtaaaagggtcaacattaatagcaaccaaagaaaagaaaatgaaataaacttcctttctcaccaatacatttagaaaaatcaaaagaacagaaaaacaaaattcttaattattgattaagaaagaatacaccagtaactgtattttggaaattaacccagataagatatttttaaacttttaaactgtccattcgtatgtgtaaaacaaagtcaaagatacacgccaagcaaagaccttcagtattatttataatgaagtaatagtggaagacaataacttctttaatctacatctaggggaaggaatagtataaagccattaacattatattaacacaattatgttagcaaatattaaataataatagtaaaacgcttatgttttgtgtaattgtgaaatgagtagtattttgaattataggatgtaacttgaacaaagaaaaaaacatgcacgagagctcctaaaatgttgatagtgctttatattctttctgcatgtggcttgacgattttctttagcaatcttttttctattatttattttacaatatttcaaaagagaccagtattaatttcatcctggaaaaaataaacatacttaaaaaaaactcaaaatgtaacctttctacatcttagtttagatctaccaaaagattccaaacatggggtgttatttttctaagaacgtcacatttttacctgtggaaattctttaattcttactatttatccaaattcaaagcgtgccttaaggacctgccaaagtgccacattgccaagtcatttgcaaacatctactgagcatcaaccttccagttccagcagaaactgagaggaacaaacaaaaaccatgcccttgagatgctcaggtcagttgggggcaattggtgcttaaataaacaaacaagaaatgaggacatgctgggacaaatgttctagcaggggtttttgtgcttgctcctgagtaagcctcagaaggctctgctgaacgggaagtcaccaaggtactttgacaccagaaagtggaacatttgagccaggctatgaaggggacacaggattaaccaggcaaacagggggaagcatgagaaagcagaaatcaaatgagtgcaaagacaagcaggcttgaagggcatgtggtctttagaggcaaggaagagtcacagctggtaggaaagcagatgtattgagctgggaaatgacaagaggccagaggatttgtgaccatgtgaataagtcttgtaatggggcgagggcggcgtgggttgtaaacagggagcaacacagtgtacatctgagttcctaaggctagagggaaggagaggcaagaggtagtaagtcccatcaggtgaagatttgaaaagtgaagggggagttaccaaaacctggacactgactggcacctagtagactcaatgggtactgccaacaagacagacaaagtcacgggaagggggctaagaaaccagatgcagaagcaagcagttcactcaatcaaaccagccacttgtaggagagctaacaagatgtgtagagcatctctgattactaagttcaaatttctgaagatgtaacactagttcagaaggatattggtagataaaacgcgaaaccacaaaaggcgtcatttggaaaatgagtttggaaaaggctagattatgatgctggacttctcagagcctctaataagttaaataaattatccaaaagatgggtaagtgtttcccaaattatctggtcattgaacacttaattccataatttattaaggtcccttggaatgcactttggaaaatgctaccgggccaggtggtgtggcaaaggaggaaggggagagggtgtcaaaagtgggccttatacagatttattaatatatttacataaagaagacccaagagcacctataaggaaacacatcaaggaaggctcatacatgcgggcagcccctgtgttcctcaagtctacatctccaaaggcactggctggcccaagcagtgatctgattctgtagtacgctgtcaccatccaccctggatgccatcttttagcccacagacttagcctagggcctgacagtggctcccacgtgctcacgtcattcactcttgtttttatgaaccaagttccattggaactcctgcatcccacagctcctgcttcttctgcttgtcttactttctttctctctttcatactttctgagtgtcagctttgtgacaggaactggtgaattttaagccaggctgttctagtttatccctaactgaccctgtatttaaaactacaatctctcaacaaatctaaactcagatgcaattatctgtctttttttaaaaagttcatgtgtaccattgaagtttgtgttctgttcttggctagcagcagcataatttacctcttcatttgtgaccctgatatttgcaggaaaatattgtccccaaatgccattagtttcaactcctcaatccatcttccttgacacttagtcaatgattctctggctctaattcatcacatcgaacataaggcaaaaattgaattaaaatatttcagggcagatagaatacaaattaggacacaggatgtggttagcattgtgaaaggcaacactggagaagatataatttgaaacatttaaactgtgaattactttcagtgggggtagggagtggagaccaccccaatctagggctccaagtgttggcaatacatctatataacaaatagcttactgctctgggctgatgatcccacattatgtggaattgcctaagccttttccattgaatctgcctttcactgagaaaatgttccccatcatgccacgggaggtcacttctgtttatcatctcaaggttcaggaaataaaatggtgagagcctaggctggagggagtgtcactgctgcttttttgtacattccagaaggcaagatacaggtgtgtctggctcacaattataggctcaggacctaggacagttcctaacatatagtaggcaattttatacagtatttaacaaatgggtttagtaaatggatggacggacggacggacggacggacggatggatggatggatggatggatggacgatgaatggatgggtggctggttggatggatggatgggtggatggatgggtgagtcagtatgtacttatgcaaatactattacttatactactaatcatataataacaaacattgataaatttcctaagtatttttggggtatatttaatttaaccctttcaacaacattgtgaagtaggtactattattacctttctccttttacagacaaactaagcagggagtgctaactttatcagaatcatagagctaggaagtggttgtctcctattgtccaccttcatctggtgacagagaatagcaacaggaaagtgaaaaaggccactcaagcagccaagatactggtttttgttttacattttgcctgtgctgttgtttgtttattcaatttcacaccatttaatattcattcctttttacacccagagtcaagcatgaagactagccacagtgagagcataaaaaatcacgttgaacaaattaatgaacaaaggttaaacctactttatgctgggctctgcactaggtgcaaaggagctaacatttattgggtgccaactttgtgttagatgcctccaacttgtgtgagaggcgtgttagacgccttatgtgggtgaactaatttaattcttacaataaacccaggcatttttcctacgttttacccataaggaaagacaatgagcgtgggtgcctgtgcatgttttttctatcataccatctgcttccagttgcttcacaatgtagcaccttggctggaggggatgaggactgaggatgtgaactcccagggttttcaggccggctctgacattttgcagctgtgtgcaaccttagataaattagttcacctctatgtgcctccatttcctcagctgtaaaatagatgtaatgataataattgtacatgcctcaaagtttgttgtcaagtaaatgaatgctgataataaatgtaaacagaatctggaacaaaataagtatttgatgtgtgactctacttgtatagtttaaaaagtaccactatggcttggcgcagtggctcacacctgtaatcctagcattttgggaggctgagacaggagaattgcttgaggccaggagtttgagactagcctaggcaacatggcgaaaccctgtctctaccaaaaatacaaaaattagctgggtgtggtagagcatgcctgtaagtcccagctactcaggaggctgaggagggaggatggtttgagcccatgaggtggaagttacagtgagccaaaatggcaccactgcactccagcccggttgacagagccagaccctataaagtaccactatatttatattgagataaactatatagagaaatacagacagaattgacacctttatcttgctgaggcttctgaagagcccgttagtctctcccatttatttagggctcttgttgtttaccttcagagtatttttaagttctcttcatatagctcttgcacatttttagttaagtttatccttaggtattttatattttctattacttggtaaacagttttaccattactatggtaaattgtatatcgatttctatatatgacttttttgccttgcccccttattgagtctctcttagtagtacattttacttgatttaagttttccaggcattaattatgttatctgaaaacagcaataattttacctcttctttcctaatcttcttgcttccaattcctttctcttgcataataacattggctagtacctctagttcaattttaaataatagtgttgatggtagatgctcttacctttcaacctccttttttacttgaattcccctcctttttactctgagttcttccattgttttctcagtaagcatgatgctggcttttgaattaaggtaaatatattttaccaagtaaaattaagtatcaattataatttaactaagaaaatcttcaagaaatctatattgaattttgccaaatgccttttcagcatctatcaagatgatcatatgcttgttctctttatatcaatttactgaggtgaaaaatgttatagatctcctaatgttacataccagaacaaattccatttgatcatggaatattcttttaatgtattgctggactctctttgctaatattttatttagaatgtttgcttaatttcataagtgagattggactgtaattttctattttggggacctcttcattgagttttgggatcaatattataattgcttcataaaaaaaactttggaagtttttcttatttttcgatctgagctgcacatcttaaaaaatgagcaagaattagccaggggaggaggctggaggataaaagaaggagacattacattaaaggcacaaatgaaagaaacaaacatcagtatatgcggagaactctgattctgaggctgcttcacacaaggcctgagcccttctcctctccttcaaccctgaatgtctgtttggaggtagctgtatacaattgttttctcttgcatattgatccacaatgatttcccacatcagtatttttttttccttcttcaataagattatgagaccttccttttgtttatcccagagaagttcttggattaaactccagaagcacatgggtgtataaagagctaggccatggtatctcactaataaattaagtcattcacactcattaagtcattcagtcacttattcttccaacattatttaaacctgagggcaagatctggaaaaataagaggcgggctttgctttcaagatcttagagtctagcataaaagaataatactagtactgttgtaatctgcatgacaaattaagctactaggtggactttgctttttcaatacaaaacagttttccctacaaatgtttcttcaacctctagtgcctgccaccaaaatctcaaagatacaatcagacaataagaagcacttctgggataagctagaggcagcagcacttgctgagtttcacaagtccttctggtagacctagtgctgtgggtcagcttgtactttctgctaatatctttctcccagatcaattctcagaattaaatatgctcatgagtcactgtgccccatccagaatgacatggctcccaggatctctacttctcccagacatatttgagaatcagaactcccagagagttagagaatatgaccgggcatgcagtaggtgattattgaaaacttactcactgacaaatattttgacattcagctacttaaatcctgcaccatcatgatgcaggaatatactgcaccatctagaaagggaaacaataccaccttcttcaaggaggtatcacaaggcaacagcacctcctttcacaggagatatgtgagaactaagtacagtaagttctcagttcttggaaaccaagactttatgtgaaatgatgtataacaaaatcgttttccttataaacatcacagtaaaacaacattattcattttttgagggccagctgtctattgtttttccaagaacctattgagggcgttaagtgaggacttgctataataggagtgacagaatcaacatgaattgaggacctcctctgtatacacactgtgtgtgctacgtaatgcctcatgtctttttcacaacaatcttatttgatattaataatataaatagtcgtgcacagtggctcactctgtaatcccagcacttgaggaagctaaggcaggaggatcacttgagtccaggagtttgagaccagcctgggaaacacaggaagaccctgtctcaacaaaaataaaaataaacagctgggtgtggtagcacatgcttgtagtcccagctactcaggaggctgaagtgggaggatcacttgggccccgggggtcaaggctgcactgagctgtgattgtgccactgcactccagcctgagagactgaaagagaccctgtctcaaaaaaaaagaaaagaaaagaaaaatattttaaaaagaaatgttaaaaaataaaaaatagcactacctactttttacaacaaatgttttagtttacactagttttagagtaactgaaaacttgagaagatagtacagggagcgctcatatatccacaaccagtttctgtattgttgacatcttacattaccatggtacatttgcacagctgtattaactacagtcacattttttcagatttcaccagtttttcctttactgacccttttttctgatccgggatcccattcaggattccatatgatgtttagttatgttcattaggcttctctagactatgacagttttttaactttgcttgtttttgatgaccctgacagttttgagagataccagtcaggtattttgtagaatgtctctcaatttgggtttgtacggtgttctttcttctcatgattagactgggttatgggttttggggaggtaaagtggcattctcattacatcatatcaagagtacatactattaatgtgactatcactgttgatgttgaccttgttcacctggctggggttgtgtttcttaggtttctgtatatgaagcgacttttatcattccttctttacatactgtactaattagcagaaagtcacaacgtgcagctcatacttaaggggtggggagttatgttctacttccttgagagggagtttctccataaattgtttgaaattcttctgcactggagatttgtctagaagcaacgatgccccagtagcaatgagcatacccaccccattgtccaataaaagaaaccagggttccttagagtaatgtctgattttagggctgggtcagggagtataaaaatgaggctggagtatctcatggtactacaaagtaaggaggtgctcaaacagcacacacacacacacacacacacacacacaatcacacaatggggggttgtcaaagagacacaggagccaacagaaatagttcccaatgatgaggaactgtggttcagcaagattcagttactcgtccatgagcactcagcaaatggtggtagagccaggacttaaacccaggttctgatcctggaaacaagttcttataagcatcgtccacacacctggcattataagctccttgagacaatgtgttcagggtgtttaggaagacatggagtatgacaaggcttgcaataaatatctgctattaaattatcaccagtactatccccactcacagtgaggctctttatccacactttcctcactctagggctttcccatgctgctgtattccctctgctgacaatgccctttcacctgttctctcttgctggaattccactcatcttttaagacttggtggaaacctctgctgtctcctagcctggctgactcttatattgtgactctcagcactctatctaggcacctcctctgcctattcatggtttccaacggctgttacctccagtttgtcaagttcaaagagggcagggacaatgaccacacacaggaagcactcaataaatatccactgaatgcctgcatgaataaacagcgaatttgtatttgtgatcctcttggtgcccagcacaatgtttgagcaacagcaggtgctcaatgcgtgcctgctaaatggatgaatgaatgaatgaatgaatgagcaattgaaacttcttgcagaaagctgaccccacagcaggaacaggtatgattaagggtatcctgtaatgtcctcctgatgctttgatgcttgcctgggggtgagtcctcagcaccactggccagctggtgtggggacagggcagcatctgtgagctgccagccttctccttctggcagtctctctgtttgtgccattagagccccgtattttcctcagggcctcaagcagctccaatcaattgggaagaggagagcaagacgttcaagccaaattcagctgcagagcaacgggggaactcgttacacagttggtgtaggtgggaatcacgcactccaggctgagaagaccctggggagcagagcccatagcgaggaatgcccttcttactggtactattggaaataataatttgttaataaaaatattaacaataattggttaataacaacaggcagtatttctcaaatgctaaataatgtgccaggctctgtgcaaagtgcttctcatgcctaacctggcttactacttaccagtacccagtgaagtcagtcatcatctccattttacagatcaggaaactgaggcatagaaagttacactgtccaagagcaagcaatttgcaaagcaggggccagaactcctaagtctaagcccttaaaccactactctagggttctgtgcactccccattttgcaaatccttgggaatatccctcgtttcctggacaccctctctgatcactcccagatacatttgttgttgactcccaggcacaaaaagattggtgtggacacaaatcttctcacaaccttgccttatctaccctctcctccatcttcaatctgactctccttgaggtcaggaactgaggttttcttatctccctcagtgggacatggggcacttagtaagcacgtttgttgattggttgtttcacagggctctggtagtttgttgggcctatgtcttcctctggagtctttagccaccatgtggcattacaatatgatctactggaaatgatactgaatcccaaagcaggtacttaataattgctctaaatgggactaagagtctgcctactgcggttgtcaactttatacatgggcagtcagggaagacttcccaaaggaggagatgtctgacctgcgtcatcaaggatgagatggaaatgactggcaagtaaataaatacaacctatggctaccttcaatatgctggtccccacagaagagcaggatttgtgaaagaaatccctctctgagatcttgctctgttataagtggggacaagtatcttcagaggcagggaaggcgatccttgtctttgtgccaagctaggacaaccaggcaaaaaccaacaccactctccacgaagaaggtaaagctttatccctttaagagtcaagaagcacaggctgcatcctcccaagcactagctccaacatgaacagtcaataattccaaagtaaatatcagcagaggaggcctcatgtttcttcaatctccctccgcacacagcaaacacattatgccactgccctttggtgagcacccttccttaggctgcggcctgtgattgaatcctgagagctactccaggggggatttgtagcaatttaagataccgttttgcacagggtaggtacaaagtctcggtcaagccttgcagtaaagagcagccagtctttcaggaccatttagccccaggccttacccatcactgccagctcctgtcccagccctatccttccccatgctgtctccttgcttcctcttgcagccccatctccagcaggggaacatccgcagccctttaatggcttcctctgggcttctaacatcatgattctatttcttagtggttctgtcccaaaattctgagttccctttcttgcttaccccactggtcagctccatagggcttttctttccaaggctgcagcttcatggatggctccaaaatcagactgtctctgacactgtcttatttctgatactcactagctaaatgttcttgggcaatttcctccacctcttcaaacctcaagcttctcatctgtaaaatggacaccttattaatactactcccccagggctgttctgagatgggagtgaagacagaaaagtgcttagaggccgggcgcagtggctcacacctgtaatcccagcactttgggaggccgaggctggtggatcacttgaggtcaggagttcaagaccagcctgaccaacatggtgaaaccccatctctactaaaaatacaaaaagttagccgggagtggtggcatgcacctgtaatcccaactgctcaggaggctgagacaggagaatcgcttgaacccaggaggcagtggtttcagtgagccaagatcgtgccattgcaccacttcagcctgggccacagagtgagactttgtctcaaaaaaaaaaaaacaaaaaaaaaaacgcttagagcagagcccagcagggtaggcctcaggtaagcatccatcactctccttagcatcagctcatgggccggttgtgaatattagaggcagaaaggcatgcaaactgcagagctcggctcctgggggaaagttccctgtgaacgttagcatggttagtaaggagcaggtagaggaaagaaagaaccaaagaaagaacagaaacacgaccagagataatagaatctcacagaattgccatggcctcagtccctggttgggattctgattcgctaatggaccaccaggctcatcccatctccctgcgctttcccagccccatgcaggcctttttcaccagggggctcctcttaaggcaagtcatactagcactcagggcctccagcgtcagacatgggcattgaaaagtcagccacctgcggtctgaacacacagagagggagaccagagagagagccctggagacctacacctggggtaagtcacttaacctctctgggactccatatatttattaatatcattgggcaataataaaacacctaacacgcagacccactgtgaaaattacatgaggagatgggccttaaaacgctaccagatattaatatgacatactaagaatcatataataagatgctgggaatgacgtttatcaagtgctttttctctgccaggacaagatctaagagcttgacatgtacttctttgtctaattctcacctacctacatttaactacttgcatatactatctccatttgactcagaggaaactgaggcacagagggattaagtcaatgccccaggtcacctagctaaccagcgtaagaacaaagtgaaagtccagagcccccaagacccaatgtcaattctgcccctgcttgctgactgcattgaaagaaattaacaggtctttgctcttctctcccactggacaaagcttagcacctgacagatacaggtgcccagtgagctctgccgaacgactacaaggagacagctgccctgaagatgagtcctccctgcccagctccccaggttggttccacccaaggataagctcatcactcctgcacactttttccagagcccctgcaggccacggcaaccccctcagtggagagtcatgttgccagatcagcatccaccaccctccccgaggtgggtaccagcgtctgagtctacccccacccccagggtgcatgttctcccgggtgccatcagagaccaccccacagggcagccagaggggaggacgaaagccccaggcagctctcatggaccagagcctcaaactccctcctgtcaaggaggccacttgtcaccggagaaaactgcaagggcccaggagtcagacagacctggattggaacactggccatgacccgacttgctccatgttgtcagggaagccacttgacctctctgaccctgtttcctcccttataaaatgcaaaacctaccagcccctttctcatggtgatgttgtaaagacaagataaaggacaaatgccagctccagcaccaggcacctcaggaaatggtgactcacttctagaacagagagcagagaaacttcatcgagggatgtcttgcctgaggctttcccttaggtcactatcctcctccactccccgacccacttctatcctacctcctactgcaggggccttggcccagtactgccccccgctggcacttgcggcacacacccctcccggaaagctaacgttttcaaaaaacttttatttcaggttcacaggtacacgtacaggtttgttacataagtaaactcgtgttacgggagtttgttgtacagattatttcatcacccaggtactaagtttagtacccaatactaatttttttctgctcttctctctcctcccagcctccaccctcaagtaggccccagcgtctgttattcccctctgtgcatccacgttttctcatcatttagctccaacttctaactcagaaaacgtggtatctggttttctgttcctgggttagtttgctgagtatgatggcctccagctccatccatcttcctgcaaaagacatgatctcattcttttttatggctgcatagtattccatcgtgtatatgtaccacattttctttatctaatctgtcattgatgggcatttaggttgatctcatgtctttgctattgtgaatagggctgcagtgaacattcatgtgtacatgtctttgtggtagaatgatttttattcctctgggtatatacccagtaatgggattgctgggtcaaatggtagttccatttttagctctttgagaagaaagctaaccttgaatctagtgtttttttcaaacttaaattttataagaaatcccaaagaactttcatttatatggatcatattcaccaacattcactgcattacaaactaaaactaagatattttaaacacatttttatttaaatataaaaatattaaacttattacctgtttgcataaataacatatatttatgaaaaaatcactgcattttccaaaacaggtaatcactactgaaaagaatggcactgtttttgccttttgggaaatctctcgagtgtctggtttaataggagacagctgagctcacatctctgcttcagcattcaatctgtcttgatctcactcattctgcagccgctgagaaactccactgtacacccctgtgagaatgcgactgaaaagggcacatgaaatcttagtatcatgaaaatagctttgacttctcagacttcctgaactgtctcagaggtcctggggtatggagaaagggcaaaccacactttaagaatagctgctttaagtggttctgttccctgctgatctgttccctagaacattgcctccctctcctaggctctccctgcaagaatgcacggaaacaattcccacccatgtgtctttgctgggttacactctctctccaatgccatctcggcctcttctcctggcccactccttttcacctctggaaattcacaacaggtatcactttccttagaaattctcccctgacccctatcacccccatgccaggtaaatgctcacctatgctcaccttacgctctcttcgcatgtcattcgtcatgctagcattcaccactctggagtcaattattcaggttagaaatctgggtctcatttactgactttcagctccttgagggcaggggggtgtcttattcactatgatgagttagcacgaagcccaggcgtatctcttgtcaggccctcatggaacatgcatgtggatgtttttctctaattgaacttgcctagcatgccagatttattttctctctacttaacttcatctgtccaaattcccatttccagtcattaccctaattcttcaattctaagaggcatgcttttttctccccacattattatatttctaaaatcagaatgtcttaagttgatgtgtacatttaacacttctgatatttctcttcttgaaaagttgtagttaaattgacggcctatcttccaatcagcagcattttacattataacgagtataattactctgttccaaatacggtgctggcagtccacaattgtgcatttaactaagtgcttccgtacagtcctcacattgttctcccaataactcacccagccctgggcacacagagcagtggtttcattaattgggagttttttggcagggagaaaggaatggaagaatttcaggcaacgaagcctacatgctgagaactgagagagaaaagtgccatccagcctcaagcgatttgagctagaaaatacattgcttttgtgcatatgactgtccagacacttaagaggttgatcccaatctctttgttttttgacacctgcaaattgtaactcacatttgcatatcttttgccacttggccagttgttttgatatctattagcatatttgatcttcccagccatcctatctgaaaatcagagcaggaattgttctcttcatttcattaagaaattagaggcctagagagataagtgacactgacttaaatcagaagaggaactggatccccaaagagcagagcactagtcctgtgctaatcccctccaccatgcaactgccatccactccaaataattggaaggagtgggtgaagggaaagaatgaggaagagactgagctatgaaaataaggacacaacgaaggagagagagaggaaaagggaattgcgatggttaatttcatgcgacagcttgattgggctaagggatgcccagacagctggtaaaacataatttctgggtgtgtctgtgaggatgtttccagaagagattaccacttgaatcagtagacttccctcaccaacatgggtaagcaccatccaatccactgagggcccaagtagaacaaaaaggcagaggaagggcaaatttgctctctctgctttggttagggcatccctcttctgcttttggctctggacactcctggttctcaggccttcatagctggactggagctaaaccactggcttccctgggtctccagcttgcagacagcagatcaagagacttctcagcctctaggatcacatgagccaatccctcataataaatgcctttctagatatctctgtatatcctcttggtcctgtctctccctgactactacagggactgatggttaaagagcaggaacaaaggaacacgagaggtaaggaaggggcaggaggatgaggctgggtcagggagtccgcaggcctcccaacccatcacagaacttgtcacactctactgaaattgctggcttgcttgtttctagctctggctgagactataaaacctacagggatggtttgtctgtcctgtttatgactctcatccatgtccaaggctaagcacagtgataggtaaatagtgggtgcttgataaatattagtggaattatcttcaaatatggtagtccttggagccagagtaatatcgggtcaataactttactctctctgattccgttttctcatccataaaataggtataacaaggtctttcttagaagattatgtcaataattaaatgaattcactccgtcaagagcatttggaactcaagaaacactggcattgttagactgcagcccataggataccaatgccattgccacaaatagggcccatccttggaaacacagtaatcaacatattctatggacttggaagaaggttctacaaggacagattattttatttgaaaaaatgacactttttttcaaaaaaaagtggaagatactgattatgaaagtcatacaaacacattttttaaaagtcagacaatatggccgggcatggtggctcacacctgaaatcccagcactttgggaggccacggtgggtggatcgttggaggtttggagtttgagatgagcctggccaacatggtgaaacctcgtccctactaaaaatacaaaaattagccaagcaaggtgggtttgcctgtagtccaagctactgggaggctgatgcacgagaaacacttgaacttgggaggcagaggttgcagtgagccaagatcatgccactgcactccagcctgggtgacagagcaagactctctctttaaaaaaaaaagaaagacaatactaaaaacattaaaaaggaggtaaatataatttatactccaatccgatggcaacaatcatattgctatagcaattatcatcttggtgttactttttccaggacacttttccatacattgccttaaataatggaactatattatatactaagacagatactcttgccttgccacttccaaaccattctcttacagtttgttcactaatagaatatttttgtttgttttccgaatggagggaccatgtgctttaaatgaggtcccttctgttcccaaaacatcgatcttgactaggccagaggaagtctcactcgttccattcttattgctgatgattgatttgtgagtggaagaataggcatgtggtcaattctgggcaataagacacaagggagtctggtggaagcagcaaaacacttctaggcttgcaaaagagacttccaataagaaatactttttcctgtttccaaacataattgcagaaggatgtgatattcagaagagtagcagccatcttttaaatatgagaggaactcacagttgacttcagaagaagcactgagaagccaatgggaaccataaagttattgaacgttgagttaaccaagccaggacttcttgttctataggatgataaacacccctcatacagaagtcccctgcattttggttggctgttacttgcagcccaaagcattctaaccatacagttactatttataaccgggtttatgtgttcactttttaccttctctacacatcaatgaacagaatcataataattaatgtctatgaaagacttcctatttgcaagtactttatcaggcacattacatggattgtctcatttttaatccttgtgacaaatttctgtagtcgaaatgattagctctatttttttttcagatgaggaagaaatcaaagatttggaaagagcaaatgatgtaacaacaaaatggaggggcaggaatgtgactcatgttgttcagttgagggtctaagtttcttctccacaatcacagcccttaggactcccctcatcatttacaatagctccaagcaccctattttctgtacataacatgcacagctaccctcccactgatgcccacatcccacaaggtgaggtctttttccctcttcccttcccaaacccttaccagttggccctacgtgtttggcatcttctaattatcctgattcctaaatatgcaaaataataatattccccaattgccttctgctgtaatttcatgtaacaggtcccctcaaatagaacgtccttaattttaattgcatattatgttccctttctcagggcagacagctatttattcatctagctaattgttcaggagacaaagacatggaatatatctcaccaaattaagtatttgctagttgctattactactggggctataatatatacccctgatttactttctagaagctcctgaggaaatcttggcatctttttttttttttttttacatttattttttggcttagcctacctatgattgtatgaaggccaacaaatcctggggtattattattagttgtgatgataatagtaattaccacaatgtatagatatacaaccatacgctttattcaatgaaagaagaaacacagtaaaaatggcttttattgaatacctattgtgtgctaagcattggcctgggtatgagaaaatattagcccattgcctcatttttgttcaagaacttcttaagagactaaaagcctcatgtttactgatgagaattgaagggtacagaagtgaaaccacttgtctgcacccggcacacagctgggcatcagaagagatgggttttgagcccaggccagtgaagaccaaagtgtaggttcttgtggggctaccacagagcacatagccccttccaacctcactaattacacgtgagaaagaggcaagcatctcaatggctactttatagatatggtcacctgcatagataggaagtgattttcccgaccttattggatcaaattattcatcagaagccggatgaagaagtgctaattatcatgcaaaacagcccccgagactaagaagcctgccttgcctgcttcccaagctgcccacttccagaaagggtggggctgttttgccacctgcacatgtctggatttccctctccatctcccatctcccacccttcacacccacacacccgtggctgcaggaatttcagccacattcaccagacttaccttctgttttttcccaccctccctccctccctcccagggagtcagtcccacagctgagtgagagaaaatgcccagagaaaaaccatcagttcatttaattaatattcacggaatagcctgcctgtattaggtgggtactgtgcatgcagagatgtgataaacacagctctgcagacctcccagccccagagaaagtcccagctcatcacgaccctatggccaagggagattgggcaggaactaataccttctttctacagaaaaagaaatgaaagcagaaaaaaaaaaaaaaaaaaaacaaccttggaagaggagaagggcatggtgcatctgaatagaggctccaggaacaaagaagggaggatagagcaaagggaaaatgggcagtcagcgctgccaagaaacctattaacctgaaagtaattactgagtgccactatgtgctaaggacattgcacacatatgctcgatccaccacaaggttggtccgttatccataattttagacagggaaattgaatctcagagaggttaggccactggctttagactgcacagctgaatagcggcagtgttaacattcaagcccagatcggtctgataccaaaactcattccctgtgtgagacagtccaacactagcccgaattggcattcatgaaagctccacagctgagatggcacactcagacaaatgtgccagacacttccatacactcaccaagtttcatggttttggattcattaatagcagagatttccactaagaaacgacagcccttcccaaacaagagctgtagagaattctaggtcttctaggattctagggaattctagggcttctgtagggaattctagaactgttatgctggaaacacaaggagaacactttccccaagagaaaaattccccattaaggtaactctcctaccagcctacaactagagctcgtttattcaacaaataacttattgagcacctactattgccaggcactgttctaggtgcttaagataatcagtgaacaaaagaagtgttgaccttgtggtgctgacattctagtgatggatgcagaaggagcaaaacacccccaaaccccagctacaaagcccagcagctcaaatgcacccagagagaccttccctttactttagcttagtcctctcccacaaccttgtacaccaggggatcagtaaggcctgggcagactttgtctcaggtcaaactgagcctcctggcagaaatgaacaggaaacatcttgaacatgtgggtagaccccttctgggctggtcagccaaatcccatctcaccaggagcctggaggcctgcctcgtcatggcatctgtccactgaactaaccaggcagagagcttgtccaaatcagattaaatggcaagcaatgcaggactgcctcccagggcaggctggccagaaggcatactgtaatacagttttaagtctttacagttcttttttctttaataacacctttattgaaaaataatttgcatgctgacatggtctggatatttgtcccttccaaatcttatgttgaaatgtgatccccggtgttggaagtggggtctggtagaaagtatttgggtcccggaggcagatccctcatgaatggcttggtgctgtcttcatagtaatgagtgagttcccactctatcagttcatgtgagagccggttgtttaaaataacgtgtatcctgctccttctctcttgctccatctctcaccatgcgacatgcctgttccccttcccacttccgcatgagtaaaagcttcctgaggcttcaccgaagccaagcagatgctggagccacacttgtacagcctgcagaatcatgagtcaaataaacctcttgtctctatcaattacccagtcttaggtattaatttatagcaacacaaaacagactaagacaaatactgtaaaattttacaggatttttaaccaactcactgggagggtcaggcattttgaagtgaagtgtggagacaggtggccagctcccaggagaaagagatgcctttagcctcaagagagtcagtgcaggcttaggctctgagctccttgtgaattggggaagggaataggagaagggtgtcacgggcataccatccttggtgggtaataatatggaagagccaggtaaggaatcaaaggagcctgcacccggatcctggttctgccacttctcagctctgttcatttggctaagttattgaccttctgtgaacctcagcatttccatctgtaaaatggagctaaggcaagtacctgcctcagggagctgttggaaggattcaatgaggcagtctctacattgtcagacctggctccagcctcacagcatcatcatgagaagtacctaattcttcctaaaactctctcattctaaatagaaaaaactccaaccccttgtcttccaagggtccacagctgaaaatgccccacacccaaaccatccctttgcctgctttccccatgaatccagcaactttgctttgaagaccaagtgctcacccaccccaatgaagatccaagataaggggaacagaaggcacaggttacagaggaatgcctccggctgctcctgaggccacacggcaggcagggcctgagaaatcagacattttctcatgaaaaatggcttgtgcagtgagtttttcttgcagattgtaggatcgccatggtgacagggccagggcagcgagggaggtagaggcactgccagcctgcagggatctggggctgggggaggctgggttggcagcagaggtcagagaaagcctcaggctgcaacaggggccatgaagcaaagagaagaaggcagtaactacaggctggtccattcacttgacactgagatggtttggggtccccaccttcatatacttaacagacctaggctgagccccagcgccatataacatcaactgggtctaaacactggagggacagacaggactgtgcttgttcatctctacagccctcagcagccgaagcagtgcctggtacatgcacacacagaggatgcagaccttgtggatgcggatcgggacagggtggtaggaaggttttcctgatggaaaaggaacctatctgtagatgacttttttcctgtttccaaagatcagatcggcctctgagcattgctgagcaaggaaccaaactgtgcctctacaacatcctggctgtgtaactttggcaaggcaggtaacctctctgggtctcagtttctcctctgaaaaataagggttaaatgagtgaatagaggaaaagcatccagagtttctgagttaagtcttagctacaatttgctgtaatgcactttgtcaggcctaactaaggagaatgggagtcagtgttagaacaccagtttgtttcctgacaaattcctatgcatccttcaaaccccaaatcagagttcaccttctacaagaaggcttctctgccctaagacctgccctctgactcagtgagtctttgctaggtctgtttccccagccatgctcaccccacaacactgcattttgtgttcttatctgttcccttgtcccggtgagctgctatagctcttatttttgtgtccacatctcctagtactgtgtctggtagggactgagcaccaacatatttcaaaagatgaataaacgaaaggatgaatgagcgatttcttcacaagaagagcagataggaaggaagtaaacatcttgaagtaatgtgatggcaatttttcaaattccaggacggagacaggctcctacaagcacacaaacagaagtaaagaggtcatgtacaatggaagataaaagaatcagagggccctaaagacttcttggtacagtgcattaaatctcagatggcagctgaacatccaagctagggcttaatgggaaaaggttgcaacccaagaattctatacctgtcagctggtcattcatgtgtaacggcaacttggagacaaaagcatatagtcatttgagaaacacgagttcaaggagttttttaatatttaaaagtaactgccaggaaaagtaagagcaggactcataactttctgatcgatagaagcagtatattaaagtcacacagtttaggtttcagtatcaattctgctactctatgtctagtgctaagtcatttaatctcttgctgccccactttcccatctgtaaaatggaaacactgatagtacctatttcacaggattttgggagaattaaacaggataatccacatgcaatgcttttcccagtgaccaggacatagcaggttgcagtagatgctgtgctgccaacagatcttccctctggaacaaaagatgaccctcatcagggtgccagagttctctacaagaacacctcagcaaccagctcttagaggactatgttggctgaaataaaactcctcacctaagatcatgcctctttccacatgtggtccacagccaatgactcaccaacacacaagtaaacaggcagcccccttgccccaacttgaaacaattctgagagatcatcccagcttcagagattgcgtgaagtcagttgaggcctttgcagggactgcaacgcagctcaactcttccctcagctcagtgctgcttcctttccttcccttctacagttgccaatgtcaaaggtacttccttagaaatagcatgcatgccattgtccaactcagagtgtgctttctggggagcctaacatgccagcaaagagactgcagtggtctgaatgtgttcctcagagttcacatgatggaaactcaatccccagtgcagcagtgtagagacgtgaggcccaatccaaggccattaggtcaggaaggttgtgtcctcaagaatggactaatgttatccagggagtgggttagtcatcttgagagtgggcttgttataaaagtgagttctaccccttctgctctctcacactctcctcccctgctcttccccttcctctcttccttccaccatggaatgatgcagtaagaagaccctcaccttgaagagcagaattctggctgctagaagttggtaggagagggggaaggggcaatggggacaaatttgtgtatgggtacaaagttacagttagaaggaggtgtggcagtgagcccctagcaaaaaacaaaaaatataagagcaaggaaaaagcaaggaagtgtaatgaacaggaagcataaaacacaacaagatggtaatgatgatggataatcaagcatataagttaaaatttgtttaaatatccttaaaacactctatccgggcaaaaaaaaaatcaagtctaacaattttgtatctactagaaacacatttaaaacaaagtaccaaagaaaaagtaaaaaataaattaaagggccctgggatggggggatggtgcagggaaagatcagactttcagggattgcttatgtggtctgaaaaatccttcaggagatcttgatacacgttcctaaaaaagcatactctcctgattggaaaagaaatgacatttcacatcagaatttaagggtggtatccaaagctgtccttagaggaaaatgtatagccttgcatgctgtcaatattaaaggaggctagattaaaataaataaagtaaggtttcaatggaatattttttactcttaaaaacagcttaataaaattaaaaatataaaaatataaattaagagtaaaattgaaatataaatcagagccagttaaacatagacaaataaaattttctcaggaagcatatataatcacagatatatatcagtttttaaatctcaaaaatattaattatagctagttctgtgtagttatccttgaagcagttggtgaaatagatggttttaaaggtaaatataaattaccaaagtgagttcaaaaaaaatcttgagggatatcatacaaaattaatcatccttttaaactatcaccattaagtaagatatttcctattggtttcaaataattcttaccatattaaagaggtttatttctatgctattgatataaaaaattggaaacagatatcaaactggatcaattgccaactggtcatctattaaggtgatcatataatttttttctttcacttattaatgtgatgactcctactagaaactcttctaatgttgcactatcttttattttcctggaatggtttatgaatcattcctctgactctaaggaaaaacagaaattctctaaatacattttggggagcattacatcatgttgaaaactaacaacaatatgatttaaaaaacaaagaatatcttcactacaaagaaatgaaaaatgtttgtggtgatggatatgctagttactctgatttgatcattacagaatgtgtatatgtattgaaacatcacactttcccccacaaaatacatacaattattatatctcaattaaaatttgagaaaccagaaagaacattctctcaaatactcacagaagccaaaatcctaagtaaaatcttggtaggagagtttagagcatattaaaagaaaaagaaaatcatcatgtccaaataggatagcataattcaagacgtctgaaaatagggctcatgccaagaacacaaaagatagcccaacattagaaaagtttccaatgggagtcattacatcagtaagtcaaaggaaaaatttataaaatcaccttaatagatatctaactggtaattaatcaagtttgatgtcgttcccaatttttaaaaatcagtagcatagaaagatactttcttaatatggcaagaattatttgaaaccaataggaaacatcttaattaatagtgaaaacttagagctagtttcactaagacaataaaggaaaggctttaagaagtagaaactctaagactcaaccacaaaatagaagactgatagaggagattttatacataaaaatgtgaattttttgaagaaggaaaaaacaatgaacttcaaagaaaagtgacaatttgggaaacccatctgcaatatatctgatatcaaaagattactgtcctcagtaaataaagacctcttagaagatcctgggagttataaaagaagaaataggctgggcccagtggatcaggcctgcaatctcagcattttgggaggccaaggcaggaggatctcttgagtccaggagtctgagaccagcctgggaagtatagtgagatcccatctctacaaaaaaaatttttttaattagccacttgaacctgggaggttgactctacagtgagccatgatcgcctcactatactccagcctgggcaacagagcaagaccctgtgaagaagaaggagaagaagaagaagaaggaggagaagaggaagaggaagaggaagaagaagaagaggaagaggaagaggaagaagaagaagaggaagaggaagaagaagaagaagagaagaagaagaagaaacataaagggttaaacaaggaacattttcaaattcactggaaataaatcaattaaaaattaaaattaaaatgtgatatgacttttttttccatcaaatgagcccagatttttaaaaatgatcatgcaaaagattctggaaaagaggcatagtcgttgtttgctcgttaaattttaaatggacttaaatttgttttaaagcaatttggtaataagtttaacaatatgtataaatattcacaccttgaccaactgactccacttctaggaatacattctgaagaattaaactaaagagtacgagaaaacttcagaacagacagtgccattattctagttaaaaagtaaaaataatgtacaagttcaacaatagggtaccgattaaaaactttctacctttgatggaatacaagaaaactattaaacatcatcaattagaaaaaaaataatattagaaaacagttgagggctatacttaagtgaataaatcatgttgccagtagcatgtatagcatgacttagatttgtatattacaaaaagaaaaaaaagatgagaggggttaaagtttcattcatttattaatttcttatttatttcaaaaatattgattaaacatctactaaatgtcaggcctggttccaggcattgccaaataaaatagacaagatgcttctcttcataaaatagattaatggagttatttctggaaggtaggattagtaatagttttcacatttttcattgagattttatacttctacccaagtgtcttacatgaatcgtgattttaatcatcatgcagtggttctgattccattctatgatttggagtatagtgggaaacttaaataccgacacatacatggataaagcagattcttaaaaaacattctggaaaaatttggtatcaagtggaaagaaaaaacaaacacatttggcctctacctcacaccatatacaaaaataaattccagtttgatagtagacttcagtatttaaaaaaatgaaatttcaagaaaaaaatggagaaatcttcatgaattctttcataaaggacataactgatcaatctcactgcattaaaagtaagaatctttgttcaggccaggtgcagtggttcacacctgtaatcccagcactttgggaggctgaggtggttggattatctgaggtcaggagtttgaggccagcctagccaacatggtgaaaccccgtctctaccaaaaatacaaaaattagctgggcgtggtggcacatgcctgtaatcccagatacttgggaggctgaggcaggagaattactcaagccagcagcgagctgagattgcgccattgcactccatcctggccaacagagcgagactctgactcaaaacaaacaaaaacctttgttcataagacaaaacaataacaacaaaaacatcaatagagagaaacaccacagagtgagaaaaggcatttgctgcacatataactaacaaagggcttgtatccagaatctgtaaggaaaacacaggcaacctaatggaaaagtgatgtagagactagagtactcacttcatgaaagaggatatccacatggcttttaaccaaatgaaaagtgagcaaccccagaagccactggggaaatgcagattaaagccacaacaagacactgccacatacccatcagaatggctaaaattaaaaccattaacaacatgaaagatggttgagatgtggagtagagagaactctcacatgctattgctacgagtataaaatgctacaccctctcaggaaaacacctagacattatgtaatgtatttgaagattaatgtaccctttaaccagcagttgtgtacctaggtacaaactttgcaagcacacacgcatgtatgttccaaaaagcacatacaaaaacactcctaacagcattatttgtaataataaaatataagaaattacctaaatatccatcgactgccattggtagtatggttatacaatggaattctacacagcaatgaaaaggagctagagctacatgcaacaacatggatacaactcacaaacgtaagacttagtggaaaaagctagacacaaagttaacaccttctatatgtggttccagttatataaaaccaaaaacagacaaagaaaaagtatagcatttaggaatgaatacttagggaatgaaagcatacaataaggtaggaaagtgatgagcataaaagtcagaatagagattgcttttgggggagagtctgggcttgagtagaaagggacagtgcagcacctcccaagtactggcaatggtcttgctcctggtggtgacacagttgttctctttacagtaattcagctgtacattgtgttacgctttctgagttataatacaccataaaaaatgatattaaagcaacccaacaaaaacattaatgcctgggccccactccagaccagtgaaatcaggatctttgagagcagggtgtggtatgggtgttttgtaaacattcccaaggagattctcatgcacctccagggctgagaagccttggaacactgtataagagcaagctcaggttctccagtctccagcactctccagcacttctctctgggcctccatttcctcttcagttaaatgagtgcaataacagtactgacctgatgaggttctaagaattgcaagtgccaacaccatgaagggtttggagtatttaccggcacattttaagtacccgatcagcattagactggtatctttataataataaagtagcaatacatttcgtttcttaaataagacaatggaaggggtcaacacaattccaaatatttagcaaacactttcaaaatgttattactattaaatatttggtttccacaatctcaggatgaactaggatgcccctcagctctggaaagcctgtctcctttgggcttgggaaagaaatgcagtttcagaaaacagtccagtgatattcagaatctgctggaataagtggatattaccacttggaatacccccactagtttttagttttgtaaattctccagagacaaggcccaggcccttcttttcttgattctgctgatagtgcctagagcataccttgtaagtgctaatgggcacaatgctattttgagccaagactcatgggttcggtaggtcagaaactacccatgaagatgatggtatcaaaagggcagagcttaaaacttcattccaccctttactggctgggtgactttggccaaggcatgatctctgaaagcctcaatgctcacatctgtaaaatggagaggatgacaaagacagctgtctcgcttcttcaagatgttttggtgaggcgacgccgagaagagatgcaaaaactcctaacacacaatatgtgcccagctaacaaatgctttacgcctctgcacccagcaggtggccgggtaatggcactgacaaaacaaattctgcaggctgaactggattttgggagcctgttgagctgaaacaaacatcaccaaactactctgcaaggatacacttgggtacacagtgctcaatgagggaaaagagagtaggaaaaatcctttcccactggtctacagctatcagaagagagaaaacatcttccccctcccaacagcaggacactcaaaaatagctaccccatttctcttctttctaaccccctcaggacatattctcaaccaaatgccagccagccttctgcaccacattccatgtggggagcagcatctgcttgcaatacagatgcccatggcacctgggcagccgctgtcttggaaactgcttcctgcactggcgagggtgggtatggacacggtgtgttttcctgagccacagaagggaagataataatccatcctaaagcctcaccgaatatacactctgacactgtgtgtctgcatgccacacctgtgggggtgtgtgctcatttttatcggcacgcatcctgctgtcataaaccatggtggactttaattgcccagcagtaccaagtctgtgccttttaatgcctacagcatccggcctcccccctggagaaacatatctggttacgacgtaattcctctgacctaaattgagtcactttcttgtcaaagaggacagtggttcttcagctctggggtcaattttattgacttttctccagcagaaaccctttggaactcatcttttgctcctgccttggattaaaagtttctagaggagaatttaccatttgtgttttttaaaacagaggtgctatgctggcccccgagccctgccccagcccagtactctctgatttcaaatactatcatgcgctctcctcttcctaaatcttccccggccacaccagcatccttgctgttcctcaaaaagatcaggcccatttccatcccagggtctttgcactggtccttacctagatgttcttattccccatgtctgcctggctcactcctctctctctctcaactctatattcaaacctcacctttccatgatgcctacactgattccccatttaaacctgcaacactcttaacctgagcaacacagcaagaccctgactctacaatttttttttaattagctgggcatggtggcacacatctgtaatcccagctactcaggaggctgaggcgggaggatcacttgggtagaggctgtcaagagccatgattgtgccactgcactccagccttgggaacaaagcagaacctgtctcaaaaaaaaaaaaaaaaaaaaaaaagacgacaaaaaactgcaacattctcccccttatcagctcttaccatatcatattttagtccacagcacttttcatcttatatcttaagataaagtttaaacctttttctttttttctggtagttctttattgtctgggtcttgcacagactctagaataaaaatcagagaatgctaacaattttccagttttgttcaacttctcggtccccagcatgaagcacacagtaggtactttaaaaatattcctgaattgttactgctctcctacccttccccaacagaagctttctgttgtgaagaagtcaatggcttcacaggcagagctctgtttaaatgccacctcaagggagaagccactctatctaaatagccatccactctacctccctactcccctgcatcactttattttcttcctagtccttatcaccacctgacattatataatgaaaacagagcacagctttgtctttgttggtgttcatggctctatcctaatcatctagaacagggattggcaaacttctcatagaaaaaggctagagagtaaatatttttggcttcacatgacctgatgtctttgtttcaactactcaactctgcccttggagcacaaaagctgccacggacaacatgtaaacaaagagtatggctgggttccaaaataaaactttatttacaaaaacaggtggtgagtcggggctggcctataggacacagtttgccaactcctgatctagaataatgcctggtgcatagtaggtgtttaataaatattagctgaatgaatgggctgaatgatttaacaactaaatttatcaatttaccgcatgtcaggcactccgtcaagtgatctttcaatcatgtcatttcatccatagaacacctattaaactaaggactgttattcctcatttagaggtgaaaggacagaggataaaggagtttctgactttcctgggctatcaccatgagagaggattaaaattcaggtctttcagcccctgctcattccactacagaacatgtaccctcccagtcttgttgcatgctctatgaaaatgcaaagtcatgctgaagatgataactagaattcttcaccacccactgtgtacagattccttcactcatctgccagccagggtttgccagctacctactgtgtgcccttgctgtgctcagtgtgataaagctctagtcagacccaggctccacaagacaacagagctacggaaacagccaaataccaaccacgtgccaggcaccaggctgccggcattagaaacctgactctgattcagggcttgccttcaggaggaagggcaagaagcgcaagtactctcagggccttctatgtgccaagcactatgcaacatatttccttgccatgcaagtaaatgacaggtgtccacagaaatgcaaaggttgggggagttctgaggagagagcatgggatttcctccttgggactcaggaaagctgagttaaagggcatggttaagccatgtgtttttgggaatcagaactgggaccacttcccattccaagaacttactagctatgcagaccctgggaacatgactcagtttccctatgtcatagaaaacagtgataagagtgtgacctcccaccccccaaattttttttgaaaaactaaatggactaatatatatgtaataagtgattgcttgatccagtgtagggacttaaagtgtggccataattatcatcctgatcacccttgaaggacctgagagaacttcagagtgaaacctttggtattcagagatctacgagtgaaagtggtaccctaccctacttaacacactggttattatcaatgatgacaatggtgtgatggggtggggagtgatgggagaagttcaaggacttcccagatcatgaggctcctgtttgttaagtagcctgaagtcagacaggaccccagattggatcatttgcttatttaaccagcacccagcactgagtaggaattctgtctgctgccaaaagccagtgagtgcgccttggccagagctgcctggatatcctgagaagatgaactgtgcttctgccaaagacacaacttaagaccaatggtcaactccagctgcgtcggatgtggaaactgagctgggcctgctggtaatggggcctgcctccctgacaaccaaccctgcctccatcagtcagcgcaagcctcatgcatttagagcacccagatgggagtgtagtgctaataggtgcttcattactgttcccttccaaccctgctggtttttaaaaatttaatgtaatttaatttttaacttaatttgtttaattgacaaataataattgtatgtattcatgaagtacatagtgatgcttcgatatgtataatgtacagtaatcaaatcagggtaatgagcatatccatcatctcaaacatttatgatttctttgtgttgagaacattcaatatcccccttctagcaatttgaaattacatcatattgttaactatggtcatcctacaggagtatagaacactagaacttattcctcctgtttttcccagaaatctccaatcacaccatgctctaatagaagtatcaggagttctaacacgacagcaaagagatgccttagagtctggtttgacataatgcagttcaagtgaaagtggtaccctacctgacttaatacaccggttactaccaacaatcacctttttaaaactcaaccaaacatcttagctcagagcaattcaaaacacaaacaaaccctaggaaagtgatgagactttcagtcacagagtaacaacatgttgtgtttatccagcatctcctactaaagagatttctcattcaccaggcattctggagcttctacaatgatatgcctggagctttctaagttttcccttatttattccttttgaaacctccttacaggcattgggctcatccccatttggctgaagccgaagctcagtgagctcaagggacttacccaatggcatctcctaggggaatgtcgcatctcagcaaagaggaggaatggacagaacccatgggaacacgaactggcccaaagcatttagcagagactcttgttttccagatgctaggccctggctgtggtcacagccgggcctgagttcagtcccagctctgccaatctgatctggaaggatttgggttactattacctagtactctaatttcggtttcctcatccactaggtggagctaacgccagtctctctgcctagcactgcagtgaggattagaggagatggcgcaggagaggccctcaacgcactgttgtcaaaaccttcatttccgacccaggcagtggcctgggtgctccacatatgtttctcatttagtctccgaaatggcccactctttgccccattgaacagagcagataacaaacacttgggtctcccatccagtttccatggagcatcaattctctaaccactacgtacactgacactctgcaacttagaactgatctttgcagaagcagaatttacatgagagaaaaacttccacttatactgcaaagaaaaaaacaaaacaaaacccgacctcctcagagccatgaacttggtaacaggaaaaaaaaaaaaaacccagagcctgacacagcagtaacttcatgtattatattatcaaaaggaagacatttcttccttttactttcaaatttggtctcagatttatccagccttgccgcctggtagttcaaaaatctagataccaaaactttggaaaaataccagaattgaggacagttgtagcgggtaagattataagacagtccccaagatttctgcctctgcgtacccacaccattttctcctagtgagttaatcaaacacaaacccagggactgctctgaagggattctgctatcgtcattaagatcccaaatcagctgacaacagatacagagagtatctgggtgggcctgagctaatcacctgaattcattaagagcagagaacgttcttagaagaagtcagagagaaatgtgttagctagtgaagtggtcctaagtagttggagggatcttgccagaggtgaccagaattgaaagaaaagcaatcaaaggggatgggataaaaattgtgtgtgtgcgtgtgtgtgtgtgtgtatgtgtgtgtgggagaaagagagagagagagagagatttaagagagtcagggagagcctctctagttggtgccatttattccccaagtgttttattattattactgcatttttcattaaaaaacacccattgcttaagacacacatcaaatccagttggtctagttgggtggtggcttaatgggctaatatcgcattttaccaaatcactactggaaacttcattactcagtctgagtggctgagtcaggccctctgtgcccagaggactgctgcctgacatgacctacatccccatctgaccgtgcctcagtgccctctttcaaggtacaatgagctgggaaacgtggttatagtcacctttccagttgggtggaaagatggcagggcatgagagcaaagtactagattccattaaggccttcctctccctgccagggtaacctagacaagttgttcagcctccctggaacctcttctgtgatgagggaatcagaataagactatctacgctgcatagggttgggatgggaatcatgtaaaatcttatataggtaagtgctgggtacaaagtagatgctcatgaattgctgttcttctgatcatgatccttagggaagtaggatatgttttacagagaccatcagctatgaatttaaacaggttttcagtacactgtgctcagtaagggattaccagaggagatttaaggaatttccacggcttacagactatctggtttgaaaagtcttttcccttcattaataataataataaagactaaaaaaagttcccagagaagctaaggaacttgttcaagggtgcacagaaagattaaaggttgttatctcacttcaagttcaggaatttgttttcttcatcttcagctaaatgccaactatctatccatctatctatctgtctttctgtatatccatctatacaaaatcctaggaaattttttaaggaaaagcatatctactataaaatatctaatttataaaatattaactccctgtgcaaaagcatacacctttctttgtgtcttcgggcggttacacaagggtagcaagggaaaccagtggtttcagaggcaaacactgagaattacaactccagagaaacaacaaattccatccacagcaatttttttaaatcatcaagtttttagagaaaccttttggtttttttgtcaaaagtaaacacaactcccaaaatttaatcttcactctctacaggcagtttctgctgaaccaaaagattagcaatgggcttcaaatctctccccctcttcaactagttggttaattgttactttccttttttctgtgtgatatagtctcttcaaatttttgagtctcttgattttgcttttgcattttatatattttatatattttttgaaaatgctttatagaatcagatagaatagaaagaaaccaacttacactggcttttatttttaagtggcattttcttaaatgatttgcttattattcacattttctaaattctctatgtactttgttctgccaaataaaaatctcaaatgtcaaaatctcatttggggtgcccgaagaactcaacatttcattaaaggttacttgcataagcctttgcccctattaaaatgctattttaattttgctacagatatataaatagtataaaccagtacaggttaagtggctggaaacagaaagacaggcagaaattggatgatgcttacagtgcaaaggtgggggatacaggagaggggagcatgagagtaaggaacagagggaatgggcagatgagcctgaagcaaagggagagaaggaagccagcaaataaattaggcagcatgttgatggattgaatgggctttcccagaaccccaggtgatactggcatctgcccaaagggaagggaagctgaacttcagaccacctccctgagacagcctaagttaaaggctgcagtggtgagcccaggcatcacatgacttctgaccacagagtgaaggcaccatgcttgcatgtacctaagacaaattcagtgcagccatatgtcaagtgcctttgagacaggcatcgtaaaagtccaccaacaaaataggaaggcttctccagaccttcatcccagaatgcacatcaatgacagaatatgcagatacgatttacaaatttattcagaagacaggtctctataggcagtagaatcaacttgttttgcaggttcttattaacaatgttgcaataaaaaactcttttaatgagttacagaaatagctctcacctctgtgagcccagagagcagcctgagcctcagcttttggggagtattttttgctttcaatgcattcgatcatttttgcagctctcacagaaagcagttatattagatgacaagcaaccagctgcctgtccctcaggaagacacttctcccatgcacccagtgtttcttggtttccagtcttctacttcctcttatcccatccctggccatcctggcctttgggagtcattttgtatgtgaggcccacagagataggagaagagggaaaaagcgccctccacccctggaagaaaataaaccctatgatttgtataactccttacattgtccaaaattccaagcatcaagaactcactcctcctggattggaagaacttaatggacacctcccattagaatgaatcattctaacaattccactagaattagtatcgcaatacacgctcacacatatgtctgtgttcttactcgatggtgagatacttgaagagaagggaaatcctacacatctcaaagtcccaggtggccacatctttaccacctgtttggcttcagataaacactctctgggcctcagtttctccttctgtaaaacggaaacactaggcacttgtaccttggaggactgttgtgaccaggcatcagaggagttaagaaaggcttctgagtctactcagctctgtgaatgagctaattggatgatctttacatcaggttttctggctcccaatcctggacaacaacctaccgggtgcccatgacaaggaaggggtaggtgcaggagaacgtaacctggccaccagggaaggcttcctggaagcaaagacacctaggcagacctgagcagtgagctggaattgtcaggtgaagagctgcatgttcagggcaacagacaaacacgtatgtactattcaccaattccattcatgtgttaaatgtattcagcgtctgtgtgcctcttgtctggaatctgcctcttttgtgaaatgagaagactgagctaaatatgagctcaaatcctatccacttctaacattacctgacacagagctgggttcatggctcatttaaccacgatccgatttgcaggcattgagtggaaccccagggccggcttttcacacatccttgtgctcaagtctgcgtttcatacaataacctaaatgaaagtgacatttgatcaactttgaacaactgactctcaacagcacggctgtgagtggtccaagctgtgggatgaggcttgtctatggctgatcagcaagagcacggagccagctcctaggccctggtgatgccaccgcgggtccctgcacacacaacgacccccacaccagatccagccaggcttctgaggaagcccacgtgggtacaggaaagcagcagatgtgctctctgaaaggatcttctctcctgtgtcatttctgtaaggaaaacaatcacagaggcttatcccagtggggagggaatagtgggaaacagcgtataaagaatcagagtggtgaggccctccagcagtctggggctctgcctttatattcagggccttgctatgcctgggcacaatggcattaatcctaatccctttccctcccctcctgcttacgctgtctcacttgccctttcaccacaaccttgaaaggcaggtagcattgttggtcgcacatctgcccagagggagcctgtccaggcccctgacatgatctcagcattctgttaattcccctagcctttgcagaggccacagccagcattcaggataagcaagctgggaaacctggacttagtttcacaaaacaagagcaggaaggtccaggctagggtgaaatccaggagagtagctgggcaatccccaccaggcggcaaatctacatatgaacccctgcctcagaaactactagaaaccagggctgcatccatgaacaaggagccagccacatagagactgagcggagaatcctcccagctgataggctttcaaggaaaacacaaagagaaggcttgatttcataagatggttgaatcttatgaaatccactccactgtggatttcacccacttccactccactgtcccatgtcccttttatccccatgaatacggatcctacaaatgccaatatttgggaggaatagaacacttttttttttttgagatgcagtcttgctctgtcgccaggctggagtgcagtggcacgatcttggctcactgcagcctccaaatccctggctcaagcaattctcctgcctcagacccccaagtagctgggatgacagtcatgtgccaccacgcccagctaatttttgtatttttagtagagatgggttttcaccatgttggccaggatggtcttgatttcctgacctcgtgatccgcctgcctcggcctcccaaagttctgggattacaggcgtgagccaccacgctaggccaaatagaacacttttaactgcaacaatatatctgcaactgaaaagctatgaaagaatctcctttgacataccaccctctgccctgcccaccctcctcctagtcagtgctgatgcaaaacgaaatacttgaggtttacaccaaatgctgcagtgattctaccagcactgccctgacgtggggagggacaggggctaactagatttggccagtagaacctgaggaaggggctgggagaacctagagtctggaactattgggacactgaacacttctgagtgagagggctggtgcagtcgggcagttgctagagccaaagcaaatccctggggaaggaggctgtgcctgggttttctccttgcagacctgggggcaagggtgtgcatgtgcctgtggtgtcataattagtctggggccacaggctttggaatgttaattctggagatatcatgctacctagagctgtctcttgcccagagagcgtgtccgtgtgtgggcactgtgaggggccacagcacttccatcttgctcttatttctatctatggcctgttgagtgccaacttccttcttggcttaatgagaaggagcccagcttgagaactggcccccactgcccagccccttcccacactgcattgtgtctggtggcaaagaacttgctcggcttctggtgagcaattagtctaattcattctcccagttctctttcctatacaaggcaaatctcagctaaatagaaaccttcagcacattttaattcagaatagcactaaaaactgttattatgggtaaggtctttcgtgtatctcctgacagagcctaaaatgaccaaataggttgtttataaatgcattccttggcacatttaaaggccttgcatgctgtttctaaatggtttctaataggtggagcacagggaacttgtaaggcagtaaaactattctgtaggatactataatggtggacatatgacattattcatttggcaaaacccagagaattgtacaatgcaaagacagaattataatataaattatgaactttagtaaataataatgtattggcccggcgcggtggctcatgcctgtaatcccggcactttgagaggccgaggtgggcagatcacgaggtcaggagatcgagactgtcctggccaacatggtgaaaccccatttctactaaaatacaaaaaattagccggggcgtggcagtgcatgcctgtagtcccagcttactcaggaggctgaggcaggggaatcgcttgaacccaggaggcagagattgcagtgagccaagatcgtgccactgtactccagcctggcaacagggcgaggcaccatcacaaaaaaaaaaaaaaaagtgtcaatattggtatgtcaattgtaacaaatgtaccatactaatgcagaaagttaataataagggaaattgtttgtggagggggcaaggaggcatacagaaaccctctgtactctctgctcaatttttctgggaaacctaaagatgcaccaaaaaaatctattattaatttttttaaatcccaaggcaagaaaacgcccaaatgaggacttgtctcaaaagagccatgaccttgggccctcctgtggatctctgggtgcccctaagaccccagctggtcccatggctgctctgggccatccccagcccctgtggatggagacactccctcagcagcccaagccttctgtgcacagacctgcagcccattcccgctcttcagggagcagcctactccaaatgccatgtctggcacattcgaggagcaacagcagctttgggttcattaattagcaattggggtgttaagcagcatgcagacccaggctgcaggtgtgaaccttgcttcctctccatgccttaaaaatgccaccctataaggaacaccaatgatccatcccaaactgggaagatggtgaactgtgaaaacttcaaggaaggaaagtatcatagttccatttccaccagccatcatctatgaatccttcaaatctcggttcagtgtcatctccccaggagcttcctctggcacacacagccccgggcctctggtttgctcctgctgggttcccagggcacccaggctcaccctgctggagataactctttccccatctgtctttgtcactagtctggtggatcctgcagagaacagggaccttattttattcatccttgggaaacctcatgaaacatcctgtagcctgtcttgtttttagctactaaggcctcaccaaggggccagagccatggggtgggtacaacaccgccctctctccagggctcatcctgaatcacttctccctgaatctcttctgaggaccaagccccattctgtacatctccacagaccagcccttgcctggaataacatgtctcagacttgcccacttccccttctcttgcataaaactcagagcaaatgggaggaagaaatggggcagaaacgtttttactatgaaagaagaaagtgggacaaagggatgctctgtagagtcgtggttctagatggaaagaagcatcacctaccaaaagctccagggaaggtgggcttctgtcatttgagtaagttgcctgatgtctcagacacccctctctcttttccctgggttaagaagttggttggtcttctgatatgtcagttaggctaggtacagcccccagacacttaatcaaacattaagtatttcctgtaaggctaatttatagaggtgattaaagtccctaatcagatgattttaagaatgggaaagtatccaagataatcagggtgggtctaattcaatcaattgaaaggccctaaaagcaaagctaaagcttccctgataaaggcgaaatcctgactttgggcagtggcttcagtccatgaagacaattccagtcttcccttcctgaaagcttcccctaagggtttcagatttgcctagccagcccccgacaatgacatagccaactccttgcaataaatccctttatatgtctccttctggctctgcttctctggtggtaccttggctcatacaagaactaaaactcttaagtagtcactgcagttctaccagcagacactcaggaggatgagacaaggaggggacttaatagtcatcaagcactttatataaagatcaggcaattcacatgtgataagcatttatcttaatcttcgcaataaccccattgtcctgatttttcagtgtgggtgacttaaattttctgtgcgacagcttcattttttgtgagggaaagggaagactcccaagtgacccacctatgaccacaattcagagacaaagcaagggtcttgctgtgttgagtacacatctgcaggaataggaagcctatatttcccataacaaacaatctgggcaaagtgtgagggggtgcaggaaggggtgaaagcacaacagcagcagatgacacatgctctttgttcatattctcctcctcaaaagtttgccactgagctgccactgggcaagatttcaagaagcagccagagaggagagattggctcctcttgacgatgcatgagaatgcctaagaaggtgacaggtcccactataagccatcagccctcatgctgcaagggcgggtatgggggaagcagagttttcccacggcataaaattgcctgttccacaaaaaacagctcctggatttcccaagtcaaggtcctcagctcacctttcctccagcacccagccaccagtggcagtgaacaatagagactgatccaaaaagactccttcttgtatttggtttcagggtgagagaagtgctagggctcatttccctaatatctcaaaggtgaacttcaagactgggttgacgggtgagtactccactccaccaaagaaccctgataaagcacccactcagtgtcaggggctgtgctggggaacaaggtgggatgcaaaggtgaatgatggggggaccctgccttccaggagtttataacttagcatgtcgaccaactctacgttcaaaaacaactctgggtcaaagcaagatcagtgctatagtagagtacaatcatttcttcattccatcaacatttcttcatgcagtaaacactgcagatttggtgttggagtgctttcaccaggcagcaggaatgtgacattgcaacaaagatggaggaggagaataaaaaggcaccctagaggaggtggtcctgaaatgaacagctcctgtcctgaactgtaactgcttctcctgaaaactctacttcctaacagcctccaggtcttaggcaacactgaactaagcagtcagccacagagaacaacaaaccaggcagaaatgtcccaggtgggtggcagtgtgtgtgtgggtgacttaaattttctgtgcgacagcttcattttttgcgaactgggagtaattatgccaacttttccaatttcataaggccatggtgaggattaaacctgatagaaagaagggtgtcgtttcaaaatatttaaccccaggtattgcctggatactgataagtcagaacagatgttgggcttgggtggggtggtggtgagggtgccaattgttaacactttctttgctggatcaagcggggcttggaatagcagtattagaaggtgggaaggaggggactcgggaggatgggctgaagctacgtccaatctcacagtggagaacttcgacatttcaaccactgaacttgtccactgaatatcaaccttgctcctaatgctcccacagggagaaaagtgctgatcagtttcatatggacatgaagatttggttctgccttctttgtcagtctcaccccctccacaattccattcctgagccccactcactcagcacaaatgcacacacacagacacacacacaggcatacactcacacacagacacacacacacagaaagacacaggcacacactcagcacacagacaaatatgcacaaacatggacacgaacacacacacacaccagcaatactaaactaccatgctttctcagttctatgacaccattaagcatatgaaacaccatcagtttaataataagtcaggggatgtggtatggagagagcagaaactacattaaatatacaattcaattgactccgacttcaagagtcaaccctgttttaggtattaggccaagggttctcaactttagtgggcttaaagttctaaaaaggtgtgtacaatggaagaaaggggccaagacaatttcatgtggtggaaagatcacttactgacatatgaaggacaaagggaaagtgaagaagtggagggggaagtgacatttctttccccttttatgaacagagccagcccctgtgccccaaggctgggcacctttgcttcctacactggctgtcaaaacaaactgaaaatgcctctgcgcccatgcctttaccagaagacattcctgcacagacaggcaggtcctgccgaggaagagagagaaaaagagggagtggtgagttaggcaggagggcagggacccttcccagtttcaccccaggagcagccacagcaaagagccctccttcaggccagcggagacagcacagccacctgcctcgaatggacccacgatcttatttatttggtctttcagtggcagcggacaccctttccaaaaactcaggctctgagaccatctctagtggacaaggagagcagaatcccaaaacaaagtgattgatttttctctccaccctggaaagtaggggcttacagccagattaaactggatttagccaggttacactggcctctgaacaaatcaatgtgtgtagcacttcctgcatctaagaaccgggtggtacttcagacgggcttcacttcagtcccaggatcaaagcagcacactattttcagtcccaagccatccccattttctgtcctccctgaccgtctttggtgctgttccttctccctgggacacccttcctccctcacagggatcaaggcacagagtgaagctgttggcttgttcccttgtctttcaccatcactacagtatttggctggaggtgctcaaatgtacactgtcctcaactacctgaacagtttgtaaaaaatacatcttcctggtgctgcctccccagagtctagctcggcaggtctgcagcagagtgcaaaagactgtatctttcacatgctctccaggtcactgatgctcaagcagcccccagaccacatcctggggaactccgagctaacgaagagggcagggactctgtctcgttcatccattacatgatggggtggaggcttcaataagtagatgctggctgactggcaaaggtaagtcgctgggtgggtagctcaggaaatgagtgagtgcataaattaatctagtttattactagtttattactgactcattcagtcagccacccacccacccaccacctaattaattatgctacgtatccaatgactgtaaaaagtattgtgcagaatataaatgtcgggtaacatcgtttttttaaaaaaatcattgtggactatatgtacaacatggaatcgttttcccaaaattctccctggaaagctttggcatatattccatggagatactttcaagaatccagcaatgtcttaagtctatttgccaagtactgctgtggagagtttgaagcttctgcctctactacatggagtgagcttctgggtgtactggagtcccttctgtgcacgctctggtcttctaggcatccccctgaccttcaatccagctggtgttcgactctctacctgatgctgtgccctggggatacagggatgaattaaacatgggccctgctacgctaggcagacttgtaagatctcctcccctggtgtgcataccctgtacagcgccctcccatgaaagtgagcaagacttgtgaatatgatgggatgaaattccagcaactatttttaccttatgtggccaaaaggattttgcaaatgtagttaagttcccagtcaactttgagttaatcaaggagattatcctgggtgggcctgaccaaatctagtgagccataaaagaggtcagagagtcaaaacgttggggagcatgttgccatgtaaccacaagggctgtatagtagcaaagggcactaggcagctaggagctgggagccaaccctggatgacagccagcaagataacaaggcctcggtcctacaactgcaaggaactgaactctgccaacaaccagtgagcttggaagaggaccctgagcctcagatgagatgcagccctgcctgacaccttgacttctgccacatgagactcttgagtggagaacacagctataccatgtgaggacttctgacctacagaacttgtaagataataaatgcatgttttactttgctaaatttgtggtaatttgttatatagcagtaaaatctcaaagagtcctttcccccaagaagctcatagacacctaggggtgacaaatacaagctagtaattactatgctatattgttttcaagactacagcaattcatagctttagtagttttcaaaattgagccaaatttgccttcggaaagtttttcctattcatctctaatccatctatgcattcacttaatttacaaacttaagttgagctcctattctgtgcctgatactgtgctagacactgaggacccaaggtgacacagatacagttcctgatcccctgaccttggaccaaaatgtcactcccaaaccttgcacaacccactcatgccccaagacccagcttaagtgccacctccttgacctaacttcctagatctcctgtaaaaaaaaaaaaaatagctcatcctcagaattcccacagcaaatttcatggtactctgcttaacacgtcttggttccactgtgtgtttcaactgtctgtgcatctcactggactgtgacctccttggggacaggggacatccctcatcatctaccttcacaacctaatgtctgacaggtagaagatgctctgaaaatactggttgaatactgaacacctcaccatttatccctggatttccttgccagctagccctgggttctccctatttccctattttagagtcagtgcatattgaaatggaggagaaatacatcaggggagacactgggacagttggatatgcagccccattctaagactggccttgcctgatgcccagaattaaccaaattttttggaataataatccttggtcatgattataagggttctttgcttatgcagaaggtcaatttcagaagcattactcatacactgaatttttgcctgtcaaatcttattttttaaatgatagatttagtctggcatggtggtgtgcacctgtagtcccagctactcaggaggatgaggcaagaggatcgcttgagcccaggaggtcatggctgcagtgagctgtgatggcaccacttcagtgtagctgggtgacagaatgagaccctgtctcaaaaaatataataaaagataaaataattaagtgatggggttgctgtttacttaaggaatgactataatgagccttattttaaagtgaggactcaaaaattgttttttgataacaccactaattcgaaaagcatgtaaggtaggctaaaataactggagaacatgagagtaaaactgaagattttcctaaagggagaggtaaattaatgggaagaggaagaagataggccaagaatttggaacaagataatccctgagcttcttgaaaaccaggacaaagagggaaagatgttggactttttagctgttgctgccagatggaaagaagcaaacccgtccacctgggagagaaccctgtccttggagctcaattatgagtggctcatgagcgagatccatgagaaaatgcattgcatgcaaagtatgtgtcccagtgcctggcacacagtaagtgcccagtgacagccagttagcagcagctgcagcagcagccacctttccctttcccagaggtctttaaaaggagaactggatggcatctaacgttacctttcactacagctctgcagaaactaacagtcacatttttctaacaggaatttgggatatgctgagttcccccaatgtcaaggtcatgtcattacacgataactctggagagagatttttggagaccgcttagctaatttatagatagcgtgacagatggcaaagtgggactctgttgcttctgtttcagccagggcttcatacagcagccatcacctgtcccctgaggccagaccagcacatctctgacctcaccgtacacacaaagcacctgggcatcttgctccggtattttctgaccgttaagtctgggatgggccttaaaagccccctttctataaagctgcaggtgatgctgttgccacagaggggcagccagttcctggagcaggtgctgggacaactaaccaggtctgcatggagcaggctgctgaaaacccattgtgagaaccaaactgtaaacatgcataaaggttccacctgaggaggtgagaatgagagtgttattttaagagaaattgtttggcaccttgtgaattcaatgttgcctgagggaggtgagaggggcttcacacattgttgcctaagatctagcaagaagagctctaagagaccacctggagagtgtactgtccccagaccttggggacgcagcagtgagtagtgcagtgggcttgattacaggggacaccgacatgggattggggacgtaggaatgtcagactagagatgcaatatggcttctgccagctggaaagcctctctcagcagaaagagaaggaggtggccctgggtgtggcagcttaagaagcagctctggagaggcactgcaggggtagaaacacagaagcaggacaggtgttggtgagggaggctaccaggaacccaggaaagacccatgagaggaatcagcagctctgaatatctgctagggctagagaaaaacaaactggcatatcagggacacacacacacaacacacacaaggcctcctcctgtctccacctccctccttttccatgctcccacccaaaggaactagaagctggtctgggactgttgctgcctacaatgagatcattcctggactcaaacaactgagggacttttcattctctaagcacaaggacaagctgtgggctgccgaggtttctttgaccatggagggatggagcccagctcccaagcgtgggttgaaatgggcaacatggagatgatatggagctgctgctggtgccccaggcatccttcctgttcaatgaatggcttccaccactcttttgagcaccaattcagtgccagctggccttttctggggttaggcaactaggatttgaaccttagctctatcccttacttatggtgctatgcagaaggttcaccccatggcaccccagagaggactgagaatgaagcaagcccactgcctggcgcttggcaccccacagggcatgcagcagggctcagccaatagtcccttgccgattccagaaaaacaatttgatttgtgctttaaaatggtgcttctccaacatgaaagagcttgagaatcaccaagggcagtgattaaaaatgcaaactttgtagctccccccacccgccggccccaataaattctaattcataagtctctatggggcttaggaacctgctttgcatctccccttctgggtgattctgactcaggtgatccataaagcacacattttgaggaaaagatgttcaggatggctcttaggtgaggaagcagagtgtactgttctaccccaaaggaatattgcgacacctccaaccaggattcagccaggacctcagggctctgggtgaaatgttttaaacaggaaacagaaattcttttgcaaatgccactggccacctgagctgtctgaaggtaaaagaagtgtgcatatttgtgcatcccacatatgagccctcagcctaagcaatggtagtgtcacagggaagaaacccggcaaactcccagagacaggagagaggcatgatgatggccctgtggggattctggcaatgaaggcaggatagcatggccacctcccctgccctgggacagcaggaagaggacagtccatcactgtccagcagcacttctggggccacatacaatgtctatgaatggaccccaactgcaaaacaggatcttgctgtggtcccaaacaaacctagcacttagttctgttgacccggatcacttaaagcaaagtgataaagcaagtgaccggggaggcagcctcgatgtcccatccaccacctcccaacacatcagctttgtgacctcctctctccactgacacctcacagtggagtacacactaggctctcaagaagtatttcttgcataagtcaaaggacgaatggatgaattagtgaaaaaatgagtgaatgaatgaatgcacaaacttatctcccatttccaagtttcctttcttcaacccaatctatatcatgcaaccaaagtgttctcgccacgctacaaatgatcttaagttccccttctacccaacaccttcagtggctcccactggatcatgtgcaaacctccagctatgtcaggacttccacaacccagctcctacctatacatccttcatctatttgcagctttctgaaaacactgtttctttgtgtttctcaaaatccttcttcacctacgttatttcaagtcacccttcagacttcagtttaagcatcacctcctccaggaagccttccctgactgcctcaggctgggttaagtcgcctttcagtcagcagttaattattaattcagcagaaggttattaaatacctactctatgtagcacacacaccactttgagtttccataccattctatacagatctccatttatctccattccccatgcctatacaggccagaatccgagaggaatgaaatgattgtgaaatgaataaataaatggatcctataattcccaggagacttgtgtgctgcaatggttaaaaaacgttgtcagacgttgtcaaggacaccgcaagatggaaaataccccctttcttccagaacagagcaaagcttttgtcacatatggcacaggcagcagattcaccgcatccattttcagaagctgaggttcctgcctgtcttctccaagaagcagggcttcctcagcatgtctgtgtcacgctgtctgcaggagcacgtgactggggaatcccatctgttctcacccgcacgcccacccatgacaaatgaattcatctgcagtgtttgccaggagctgctttgggagcaaaggagactggtgatgaattattcatcctgaggagacgcccgccccaggtttccagagcgggtgcagcctggagaagcacccctctcaattgcagggctcaggccccaggacacaaaataatagttaataatagtgagcacatctaccatgtattgacttcctacaatacacgctgttgggagcttaacctatattatttaatttcattttcacaatagcccctcgaggtttcatcatccccattttcagcatcacagagggggaaggtcaccagcccctggtcccacaggttcctctgatctccagaagatgtgcttgcccctgcagaagggcagagagtcaggagggagcagggaagcccagggaagcccagggagggatcccctctagcagagctgagagatgcctggcctcccctcaaccccactagatttaacattcagagcagcacgtggatcaggcaggatgacttgctcggagccctcgccagcccaaggcatgtcaaatgcagctgctatttccagcagctattctaccagagaagccctgtcacatctgatatggctgaatccatgattttggaggatggatgtgcagtcagcaatggctatacaacagatactagaacagttgctgggagctggggaggaaggggaatgaggggaccccttaggagcttaacacttgatacaattatccatcttcaaccccatggactgacggtgggaaaggtggagagacaggtggcatgatccttttaggagaaacaaaagcggaagaatagcaaaataatagacagagggagcaaacaaacactgtgcgtgatagaaacgcatgacccacctcatttcacaaggaatttggagccacctacaagatcaaatacatgacagcaaaaccgaaatatgtaaataagaaatcagaggagtgataaataatgaacgaggaacagtgtgtccggcagaagtagggatggaaagtgggctgagttagggctccgagccccagaccacctcccggagaggggctgctgtcagctgtgttagagacacttggcagttatcgtgtcactcaggtgttctctggcctgattgcatcagctcaccaaagcaagggcaattaaaggccatcaaagctagcacaggtgtggaaaactatggctggcagcctcctgggctgactctcagcctccctctgaaccatctactgcctcaacctccactccagggtacttctctcttgtctttcatttctactcctgcagcctgcgtttcctcccaggtctgctcctcagcctgatgtctttgtcagcctgagtgtagcaggcataaggattcaggaacctctactccagtcagctccagtgcaatgacaccagaggagtgtcaccaccaggctggacagtgaggtgtctcttgccctggcatttcctctaacatggtgcttagaatgtcaccaccatcaccaccccatgagtctgggagctctctgactgcaggagccaagtcacccacctctggatttccagggcccagcccccggctgcagaaccaaacagcagtgacattcagccttgtgactcatgtctctgcagtgacagtgctcagggacccaggctgctctgcagaccacaggctcagatgggattccatttctgtctgttctctgactacgaatgtctcaagagcagccccaggctctggtgctgtacatggtatggacagttcttttgatggccatcagagagagataaatcatcgtaactgtgcattctcaacgggacaaaaaaaaaagctacttagggagcaaaagctatcttagctattgccatgattttcggcccttcaacaggccacagtacatatgcagcatatctctggcatgaaaatttcatgggattaggaagaaaagatctaaaaacactcaccatggcaataatcatgaacaaaatattgagaaacactggtccatactactcatgtgcatgagagcccatctggtaggcacctcccagctatgccttcatttctccaaagaataaccagaggttcagggaggtcatatgactcaccccaggccacagtggtggcactgaaataggactcagacctggtgctagaggttctaccagaagacaccttccatgtgtgggaatgagatgtttgtcttgaggcactcacgtttgttgttgttgtttttattttgatgtttgtaagcaaaaaataattttccttttctaaaaatgaaattaagttctataaatattcattgctaagacggtatttctctaaacaccatctctcaaaatcccaaactggacttcctctttggaattcaaaaacttatcttctctttggaattccaaacttaacagagcttaataattcataaattcagtcgggcacagtggctcatacctgtaatcctagcactttgggaggctgaggcgggtggatcacctgaggtcaggagtttgagaccagcttggccaacatggtgaaacctcatctctactaaaaattagccagacatgatggcgggcacccataatcccagctactcaggaggctgaggcaggagaatcatttgaacctgggaggcagaggctgcagtgtgagctgagatcgtacaactgcactccagcctgcgtgacagagtgagactccatctcaaacaaacaaacaaaaaaaattcatacatttactcaagaggtgtatacatccagtaggtactaggcatggggcactgaagccacagagaggaattagatacaaaacctgccctcaaggggtttccagtctagaggaaggtggtgcccagggctgggtccacgctgagaaaaggtgagctcggaaggctgcagggtacagacaggaaggctgggtaagtgcagtaggctttgtgaagggtgtccctctgaactgaaactgaaaggcagggcaggtgttccctgttggagcagacagataaacaatctaaacagaagggctaacatgtgcaaggggacacgtctgagggagcctgaagggtggaggagctaacagttctctagggagaaacttatgtccaagtagccaccaccattattgggtcctccttctgcccaaagaaactgagcagaacaaatctaatcctcgtttaacctgacaggctgtacgagtctgatcccatacactcatgcaaacattgaaagtgggcaacatcccgtatagagactatttacaaaggtgaggaaaggtttagggaaatcaacaagggagggtgaagcccctgggattggcaataacagagaactgttaccatctctccaactaaggaggccaggggagagaccagttgtcagaaaccaggaaaactgatggctcttggaggagctgtggcccacaacagcccaacagggaggggaccaagtcctctcctcctgactctgacccacccatctcctgctggttcctcctattgtctgcatccaatcagaactcagaggcaaggaggccactggtgaaatttacaagttgagtctcccatgggtggagaatagatttggagaggcaaacagaaaacacccagcacatggacagccatgggagacatctacttttttttggaaacctaatctgcatatagtctctgttctggtgacatacacactctatgtgctggggacttgaccacttagcagcaagacggtcatctgactcagacctgggcaaacccatccatccatccattcattcattcattcattcattcattccaggcatggcactgaataagaaggatatgtccgtgaacaaaacagacttccttcctaatggagtccaagcaatgggagtgctcccggaatatatgccaagccagtcattcagaacctagttctggaacctctgtggacaacaacaggaaaaaaacgttctctttctgttggccttggagttgagaggatgcaggtctggagacccatgagccagccagagggcagcagagtgaggatggcttcaatccacccaaggtccgtggtgcaaaagcactcctggctctagttgaggggaatatttctccaccgagccacacccccctcatcttccagaggagatttcctgagatcaccgggattggatcagggacacgacacttagcatgctggcactgtgattgggaataagaaggcagtgctggtttttttctgagtaagaacatattacccacactgagtgacccacacgaaaacaaggaggaaacaattactttgaagcctgaggacaagataaatataaactcagaccataggctttctgaagaggagcggcattaactggcagccagcaagaagggatctgtgacagagctgaggaaacatccgtggctctgtgtgggtttaatgaggcgtgctcacggaaggctggcaggagagcagaaaaaagcaggcgagggagggaggagctctgggtctcaacccgactctgcctctaatggtctctgtgactaggggtaagtcatttattccccactcgggtttcaccctcctcaattgctaaatttaaaaagtagatggccgggcacagtggttcacacctgtaatcccagcattttgggaggccaaggcaggtggatcacttgagaccaggagttcaagacctgcctggacaacatgatgaaacatcgtctctactaaaaatataaaaattagccaggtgtggtggtgcgtgcctgtagtcccagctacttgggaggctgaggccagagaatcacttgagctggagaagcagagggtgcagtgagccgagaccatgccaccggactccagtttgggcaacagaatgagactatgtctcaaaaaataaattaaataaatttaaaaacataaaaataaaaagtagatagttgtaagtggtgttggggtgtgggcacagagaaaggtgaggaaaagcagcaggcagcattgtggtcagacttctgtgcaagtcctaattcaatctttaaaagccatgtgacgtaaagcaagtcaatttctaagcctcagttttctcatctgtaaaatgggcattacagcacctaccataagatacacaaagatgtaagtgatctccagcacatgggagaagcatgagaaaagcgaggcaacatcactgagaagagatccatctaaaaaggtcaatacaatgccttccagtccaaaagcctaatacttcgggaactaaggcatggcagcactctttgaagaaggcagaaattccttccactgccaggctccctgctgaacaacagtgttctctcaccttggcttaaccacagcacctttcatcctctcaattttcagctgtaaaaactttgaaaactattagaccatttgtctggatttctggatttgcaggtcacgggcatcattgaagatagagccaccctagtaaaatgcaataataaatgcaacatttttcatttaatactgcttttaagagcattatctccctctgtcttaccattgttaatacactgatggaaaattcacacaaaaaacatccagtgcctgagtcctgattcctgagaccagacagagcctttcttagccttaaaatgctttccaagaaaaccatcatgggggccagagaaaagacaatggacagccacacccatctccaccactgaagctgcctgtgccctcagagagtgctctctgtagatcagaaaaatgagaactgttttctatgtagccagtagatacaggtgctattctaggtgttgtacctcaaaacaaatctttgatggtcaatattattagcccattttagagatgagaaaactgaggctcaaaaatcccgaagtgactttccaaggcaacacagatattcagcatcagtaacaacaactgataagtcctgtaattgagcccagtactgtcttaccggaaaacctgcattcttccaaacatgtcaacatgtcatctcttaaaggataaaacgaacagcactcccacgttggaatacatgggtactgtctcagtcagtttgggctgttataacaaagtaccagagagtgagtagcttataaacaacagaaatttatttctcacagttctggatactggaagtccaagatcagggtgccagcattgctgggttctggtcagggccctcttctggggtgcagactgacaccttctccttgtggtctcatatggtgggcagaacatgggagatgggagagggctctggggtctcttgtacaagagagcactaatcccattcttgaagattctcccccatgacctaatcacctccccaaagccccacctcctaatactatcacacttggagttaggacttcaacatatgaattttggagggatgcattcagtccataacaggttgcccacccaagggaaggaatatttgggtgggtaagtcccgatgtgccttagaaaacatcactgcagtgtcatggacacagatgatgagggtccatccaccttctgggctgccacagccagaagaccagcctggcgacatctgcagcttgcccttttcccttgagccagaaacatccagcaccaggacttgatgtctcctcggctgacacccggaagtgtgtgggctgtgttcttttttcaaaagatagagatgaaccagatcccaggcagcacataagggaggtcactgtggtcagaacagactcacggagggaagaatcctctgggaaagcataagtgtttatttaactgctttatgcttcagtgaataactaatttgtaccaaaccccagtgttcttgaggtgtgttgataaatgatgttgcaaaagcaacatgtttctgtgctttccatgtgttttgcatttctggagtctgtgaggagagtctctaactggggctctagatgctgggaagcactgcacagagggcccctgggtttctctcctcgacctcggtcactccagctcccagaccagcacatagtagagatgtagagatgcaaaaaaaacaaaaaacaaaaaagttgcttgggttgacatgaaatacatttaaattttaatccccaaagtaaacatgatttgaaaggtaaacaggaaggcatgactggcatataccaggaggagtttgagcaggggatgtggggcagaggtgaatgtttaaacggctcatacagtcaacctgcaaacattaggagggctttgctgtgttttctaaattttctggttagataagtgtatgtgcagatgtaatacacagtcttgtgttccaattatctctacatatgaataatatattttaagatatttgatgactaaatatattcatgcatgtgaggggcacatagaagctctcaggaaaatggtagcagtctgggcccaagaaaacgtctaggaaaatgaaattccaacagttcatcacaaattgttcgataagaagtctcaagaagccaacgctgggaaatgggaaaggctccctcataactaccagctgacaaaaggaacaggtgacacgaggtgctggcaggaaacatttttaaaagttcttcaaatctacaggaagagcgcagaggagcagaggaaagacaggttatgaccaaaatgatgctgcctgacctagggtgtgtgggtcgggggaacaaaatgggggattcacttggggcagatggtgggtggtaacagatgacaggtgaaagtggtcttttttttcttttttaacctcaactggtggttctgtcttcagcaaaaacaatgtgttccaaaggaaaatgaggaacaaacctccgtaagcaggaacaagttggaacatatgaaagatcctaccaggatgcgagacactggcctagatgaaccctccacctggatctggctgcagaatcacacaggaaatttatcttttaaaacagataatgggagagacatctggatcctgaagatgggcaaatacagacttcattttccaaagggagccaggatgggccaggttcaaatcctcatactagttccaatgttacaggctttccgtctcccttcctcttctggtgggatcatgaggcctctagtgctggggctgcaccatcagtgttagaaagagagaaaggttataccctccactcagagctacagcctttctacccagatgcctggtcagtgcctccaccagctcacaccaacaatgactgcctgccaacaccagatttcacctccaaactggcttggatttcacctccaaactggctcattccaggatcgcccttctcaggaaatgacaccaccatctaatgcagttgctccaatcagagacccacgagccatccctgactcttcccttctctttatctgcacattgacttccagaataaatccagaaacctctgtcttcccttcacttccatgcctagaactcaagtccagccaccaccaccactcactgcatcactccagtgatcgctgacctggttccccactaagactcagcagagccgccagagggacagcctcaaagcatatgttttgcattatatttaaatctaaactctctatcctgcaggtgtgcctctgcaaacccacctgctactgttctcccaactgtgcatcacattctagctcctctggccttcctttagttcctggaacacgcaagctttcctacctcaggatctcaggacacgtgatcctccaagaaataagttctcttccaccagctgcacccgcccccagcactgggcctgactggctccccttccggcagctgtatctcagggacgcctcctcccacgactctccatataactaagcacttcatttccaaatcctaatgcataattatttgtccatttacttgtctgtctgcctccgcaactagagagtcagctgcctgagagaggaaatgatggatccgtaagcttaggcctgaagaaatcctcaggatagacagtggagggagagaggggtgagaatttcaggtacaagaaattgcatgagtgaaaacacagccatggaacagcacacatagagaggagcaggtcctgaaggagggcaggaaggagatggggttggagatgtaggcagaggaaccaggagacctcagatggctagactgggagccccttcccaagacgcacacattgctaaaatgccaatcccctctccagggagaagccagaattaattgtttgatgtggtctgacaaaatgggtattaccatgtaattaccaccccccaccaccacccctctgccacctgttgagaggagggtaacacagtgtgtatgtcatctggaggacacagcagcttccaagacaggtcactattgccagtaaggaccaaagggaaccatttctgagaaacgacaataaagttgcccaccaaacaggcattggtgttccaggactttaacccaatcccattgagttgggtccacattctagcaacctctcttccttctggacctccagagtgggcagaattgagcttcctccacaaaatggcaatacttactcctgaacatccatcatctgaaaaggcaggaaggggcaatggttaagagcatagactcaagccagactcctggtttggccactctatggccataagagatggccacaaaacagttacttaacctccccatggggccaagtcttcgtctgtagcatgaggtcactaacagcttctatctcacagggctgttgtgaagatccgatgagcaaatcactaacaaaggaaggcacatttatccccactgtgcagttgggtaaactggagttcagagaggtgagtaattcagccgaggtcacacagctgtaagtggcagaaccagtgcagtcccatcccagagccccacgctcctgacctttgagccacagcgacctgctcagctttcaggtggagcctcacccggatggccccaccatacagtatggagaccccagcacacaagcagctctgaaggtggttccaggacactgagtaaagcgtattgtacttcagcttagttaagtataaccacatcctgagcacaaccaaaactaggtcaaaaaaattatttctgggatttaaaaaaaaacaaaagctgcaggactatcttaaatgtttctcccataacttgcagctgaatgatctcaaatgaaaagcttgatactcttcttccccaccatgtcacatcgctgtggctgactggaatgaactggttccgaatggcagcccacacccctccccccgccacatagctggctttctccaagcacagcaaagtgaactagggacagaatcagctgctgcctctgaggggcgcagacacacagctgttctgcctctgtcgcccattccacagaatagacgtgccccccaccccagcccttcctccctctgtctcactgccctccagcccctacccctctccaaatgtcacaagtacttgacaattccagtctcaacagctccaaaaactctaacctctacctttggtcactctgtgttcccattttgtactcccatccccccaaccctctcattcgacagatgaggaaactgaggcccagagagcaaaatagattgtttcaagtcccacagtccattggtggcagaccagggcaagagcccagggctctggggactcaggctggtcatcttcctgcctcatcaggagaaggtcctagggacacttgggtggtattcatttcctggggttctcttaacaaattaacacagacttggtggcttcaaaccacaggaacttatgtgtcacagttctggaggcagaggtctgccatcaagaactcatcagggtatcactccctccgaaggctctagaggagagccctttcttgcttcttccaatttctggtgacatcaggtgttcctgggcttctgactacataactctaatttctggcccagtcttcacatcatcttatccccctctctccatgtgtctcaccaaggacaaggacactgtcactgtatttagagcccaccaggtacatccaagatgatcttatcttccgatccttaattatatccacaaggagtcttttaccaaataagttcatatccacgggttccagtgtttaggacaccaatatgttttggttggtcatcagtcaacccactataatgagtttcttcctggggattcccagtgcctttggaaatcaggaatttgtgaggaccatggtgggtaaagaccctcagatcaaagttacatcagcccacacagtggagctcgtggatctgcagcaatgacctgcccccaactggacgccaatacatatagtctcaggagagtcactgggatacagaatgccagaataaagagaagagctgctatttatagaaggcgtagtgggtaacaggcaagctgctaaatcattatacacattgcctttcatccttacagacactctgtaatgtaagtagcaagtaaactccatcaattactagctgggtgccttgagacaagtaaattctctaagcctcaatttcctcaccttaaatgagtaataatacgatctgcattgagaggatcttgtgagataaagaagaaaatgtatgggaaatgcctagcacagtggcacacacagacacacacagtacgaactgatatcatcattactcctctctttattcagtgtcaccatctggtttttttaaatcaatgttatatctcctttcataacagccacgaccccaaaaccttcttagggtgtaaacagtagttatatacttggagtgttattttacatgcacgcaggaagtttgttgtttcaaggaactcctgggggactcctgctgtaaggcttaagatcctccggcagcatgaatatgaatctgccaaggtatctactctactcatttgtattcatggtcatgttctaattatttaagtggggcacaactcctgtcagctcaatgaatctgtgttttccagtcttggctgtattcagtcccactgactggttacctcattctctgattctaagacaaagcctgaattaatttagaatattttggttctcccaaccactacaacatgacagtacaaagggaaattttgaagaaaatgaattctattgttaaaacaatgcccaggtgcaaagaaatacaaatgcagacacacacagagaagaaccacttgctcacatttgattccacaagcttttggcaggagcctgcatggcgggtgggaaagatcacaggctttggagtccaacagccctgggttcaaatttcagctctccctatcccagttgtggtgtaaggcctaaagttaaggatcaatatggcgggctgccttgacatctggtgaaactggcagggcctcagatggcctaactgaaagttcccctccctcctccgctcccatggataaggccctcaggcaaacaaccctacccatcatgacaccggccatggttcctgcttatccctaaatagcgtgtttcagttcctcctccaacagagttgttaaaataagccaatcagatcctcttgtgggaaccagggggcacccccgccagtaagcctgcctctcacagcctggtttgctctctgtgatcccacatgcaatcctcatggggaccagcatggcacgcagtgtcctccccctggggctgtgagtatatgtgaagaataaactatcgatctcccccgtccagtgtcaggtgtcataggtgcagccaatcccatatcccataactgtagggtgaaatccttccctcaccaatggaatgattaaagcaccagctggtgtgctgtatgaactttgccattctctgaccaatggttttatcaatttctccaaggaagaataaaaacttccttgccaagaaccaaaacacaaattcctatggtctcactacaggtactccctggtcccccaaaataaacattaaagcaaggagataaataacccttgagagtggatggttgatacattccctcccacttcctcactttcatgcataaacaacacttacattcctaagaagggataggctagatcccttctaactctaacatcatatgtgttattattattaactagtggacagtagggcacagattaagactataaagctatctacctaagaaacacaaacacatcagcaagagagtggtgcttggtgcaggaagggcaaaaagaatgcatctcacatgcagaatctaaatgattgttgctgccccctaagcactgtcttgagaagggtccagcagcagcaggtcatgattgattagtgatgcctatgattgatttgtgatgtctgccatgggcaggggtgtgggccaagacagcaggctgatggcagaggtgcccttctgcctctatgggagtaagagtaccagtcttgcacacagagccctagggttctagtcagtctccttctaggcacctcagtctctgtctgtaaaatgagataaatgaactgatgatttctgggatcttaccctcctctttcttgcctggtctcctttaacgtaaggagtcacatcatggtgagggacctggatggggtcactgacctcaggaaggagagagaagaaaccatacagaccatgcttttggctaattgtgttttttttctgcctgataaacacttaaaatcctaccaggtctgaccccaaagaaagtctcagaagcaaaggaattgctgtaagctgcatttgctctctgcaacagcaatttaagatgtaaaaataacagcctttgttccagcaaggcctgggatctgggcagcaaaaccaaagaaaccaaggcctatgctggggctctgtgtgggctctctccagaattacctggtgaggtggagctccccagctctgccacaggcaagaggaagaccgggggtaaagccacaacctcttctccaaggagcaactgaaacagcagctgagcacaggaagagaaaatggcccaggttggtgtctcttcataaagaggcccagatctcttttcaataaaatggcctttaatcgctttaaagattttattaaaaattccccatggaccaattatcggcaatgcttcctagccacgatctatctagcaatcatacccaagtcttatgccttcgcctgcagatgctcccgggcctgctgtctctccttgtcttcccagtgcatcagtctctgtgtctctgattctgattatgtatatgtccccatctcaggccttgtccctctgcaactctgtctctctcgacttctcggtctctgcacctctgctctctcaatacccatcttcctctttgaaactgtcctcctctttttctccatctggcacactctgtctctctctttgtgccattctcctaccaccccctcctctttaagatcttctttttctctagacagagtcctgctgtctaggcattcttctcattctttctgccttaaagaagtcttttccaacatgaaatgcctgctgtagccagacaaaaattctttggaagcacaccctctcaaccacttttgcataaggcaacttatttgaaaaacattattaccataattaacaaaaacaatttaaaaccgcaatcagcctctggtccctggaagcagcacatagaaattagtcagtattctctccttgcccccagaacccaggagaaaattcacacacacacacatacacacacatacagagagagagagagcactttctacccttcactacaaatggtgaacacttaaaatgctaccaaatttgtgatttcttttattaggttttaaaaatataagatacagcaagctatacctctgttaaactgtatacgtacatttacattttataaagctatttagcatatgcctcgccaggagcactacttaagtgcagtttagagcacctttccagttggcacaaaattatattcactcagttacataagcagatattaagcatccattgtttgggggaggttgacatatgaaaaagagaccacccttcctctaaaggtatgtaaacactgagggaggaaacaaacctccaaacagaacatcacgtataataaaggtagtaatagaagggacacctgagggaggtaagcaggaacgacacaatgacttccaagcttagttcccgaaggacgggatagccattccagaccatcaactaggggaagacattggcacttggagcaatgccaaactttgaattaatgctttatatttttcaaaacattatttgtaagtaccttccccagcattcatgttttgatcctcataagcacagtgccaggcaggttgcaggcacctgatgcaagtttgtcaaccactaatgaagaagtggatgacctggtcatctctgggtgagcaggcatcttgtctccttatcattgcaggcttaacagctagcccatgggtggttccaagtgcacctcccatacatgtgcactgaatgaatctctgggcgaggcagaactggaggcatcagtagctctatatgacagatgataaaactaagacagaaaagataatcccatggccacggtcatctagctaattaggaaagctgttgaaaacagatgagcattcatccactctgagattccatccatccaatacatgcattattctcttaagcatttctagatccatctcaaagttttacctcgctgtcatgtcaataaatagaagaagaaagagccctaagaatgagagttttctggctgggtgcagtggctcacgcctgtaatcccagcacgttgggaagccaaggtgggtggatcacctgaggtcaggagttcgagaccagcctgcccaacatggtgaaaccctgtctctactaaaaatacaaaaaattagccaggcgtggtggcagatgctgtaatcccagctattcgggaggctgaggcaggagaatcccttgaacccaggaggcggaggttgcagtgagctgagatcgtaccactgcactccagcctgggcaacaagagggaaactccttctcaaaaaaaaaaaaaaaaaaaaaatagaatgacagttttccaatcaccttacctagagttcctctgctcacaccttagaccacttccagaatcaagtgctctagttcattcattcattcattcattcaaaaagtgttttctcattctcagacacctactccctcccacaccctgggccaagaactgggcagagaggcctaggggttgccctttccctgagcagctgactgtcattccaaaaccatctcaaccagagaggcctcttggttctttcatgagctgtctcttcacagaaattatgtttagtgtgtgctttagatttagatttccacccagatcttcctgtataagcatcaggtgaagttagtttaacaaagactagcctcgttcccatccaagaccaagtaaataataatctctaaggtgaagaaaagataaaaatggggcattagaaattttaaaagggcccaagcaattctcacaagcaggcccttcagaagtgaccaaaccaagcatttctgtcatgtctcaataatgtggtagagaaaggtcactgagtcaggagccaaaggtccctgtgccagccctgggtgtcccaccaacctgctacatgatgttgagcaggtcatttccttccactgggctccattttctcctgtgtgaaatcaagtgttgagctaatggatccatcagcggggccttcccgactgtcctagaccatgagtctgtgcaagttctgatccatttttaaaccactcctttcctgaagatgaacttctgcagcagtgaggaaaccggtcatcaccaggagttcctccccatgcagacagacaatgagtctatttcggaaacagaaagtgtttgctcagcgcagtgtacctctccctacaggacagaaacgggaagatatttccatttaaactctcaaaagctaataaatgaacacatctcagtggtggttccgtttgtccttcctcaacaccttccaacatgtttgtccctgatgtctccttgggacgtcagtaaaagggggctcaatagagtcgctcagcattgctgttcctcaagcgtccatatccttctctggctgccaacctgggggttcactcactccttccaattttcccttctcccaagaatacgctggacaatggcaatctcctggtaatcccctggctttgtgtctaagagcagctcctcatcttccatctttgattgcactaggctccagaaccttctccaagcagtgccaagcccagctcatcccagcctcctggaggcctcttgcatcccttgaaaccccaaacaccacgcatcaggacccatgttccctactctccctaggagagtttgtccttgtcactgatgtggaccattcccatgtgtcactagccggggagaggatctcccttccctcctgctgctactcacatcagaatcacattgtcccacaggatctggaggcactggggatggtaagagtgagtctttcagttccaggcttgattcttgctgcaacgttccagtaaaacgcccatccagattccacctcctcagagtcgggggacacacaggcatccctggccagctctggtctctagggaggtcggtgatgtccctgaatctcctgggccagctcatctcagagctcagagctcagcgggagtctatccagaaaggcagggccagcctcttctgtctcactgacccatggagcctggctcacctgagagaggaccccatgtaaacatatgtatgggttgaactgtggttggtgtggtccttaccaggtggctccagggcccccagactgggagaagacagaaataaacagtgctttcagggtgaaacatctggggattcttcactgtcatggccttattgaaattgttttcatcgttcccgctgggacctagacaagcaactccctgggtagtatcccaacttacatggagatcccagacagaagcacacttaggccagccctgtgctccccacccaggcacctgctgaactctttccatccatgatctttgactgggtccgggggcctggattcacacctcattgataaaacctaactgcagccttgtgcaagtgtcctcacagctctaggcatcaatattggcttctccaaagcaatttaaagcacatctccctcagagggttgttatgagggatcattgagaaccacaggtacaacactttctgatttcatttaactgaatttgatgcttgtccaaagttttcctattaattctccattgactcaaaacagaaattcacatccccaggggaccacttcatacttgtcatcatatcagcagcacctgggatgggatggggcacttggcaggccctcagtgcacgtttgcagagtgaattggaatcgaattaatcaggatcagggaaataatccatggcaactcaactctccagtggtagagatatgaccagctaagacatctagggcctaaggcagaaaatgaatacggcaaaaaaaaaaaaacctggaacataacaaaactatgatctgtcaaaatattggacaatgttttcaagtccagaggttaaaacaatcaaaaatgtattaaatacattaaagttgaacactctgggttgaaggacatgcacaattttctgtattccagtataatagcttcactagcctcctaactcatctccttccttaagaggcttgcctttccattccaaactcgactccacaggcagagtgacccttccagtgcaaagccagttctctcactccactgctgaaacattccctactctgttaacaggacttaggactccattcatcatctaggtcctgcctacttcttccccctcacatcctatctctgtcatccactctggacacactgcacttaccaagcaatattgcaatccttcacttaaaaatgcctgtcttcttcaccagaataaaagcttcacgagggcaagaattagtaggatgtctttcttgtgccaggcacaggtcaagagctgaaggagaatttggtgaacaaatgccccagttcatgctaagaataatttgccaccacttgaagagaacacacaaacagacacggcaactacataacgccaaattctgggttagataaaatcacaaatggtctttcctacatggtagatgaagaatccccattctgagttatcataattattgacctgttcaatgcccaaagaaattggggtcaaagaatcttaccatattggaggagaattggaggaggcctcctgaattctccaggaggttacctcatactttattgtgagtgtctggattggaaatgtcctagaagtcaaccccactcatctggatcattagcccctcccagttcaaccccactcatctggatcattagcccctcccagttcctaattcaatgaaaagccaccactagccattctgttcatgaaaaacaacccctgactgatgtgtgagtttgttctgacccagcagagaaggactgggaacagccagatgtttctccatttccttttgtatctgctttcttttcaatccaacaagaatgtgttcatctctgaccgcagacacagcattctcatttctgaaaatcgccatggagaaatcaacgccaaggccaacacatgtgggagtgctggatgctgcctttgtggaagtttagggcagcttatgagagtgtactgaattgatgattgctttatttttgttagtatagattttaaaaataaactaataggctgggcacggtggctcacacctgtaatcccagcattttgggaggccaaggcaggcggatcacctgagatcaggagttcgagaccagcctggccaacatggcaaaaacccatctctactaaaagtaccaaaattagctggatgtggtggtgcacacctgtaattccagctactcaggagactgagacaggagaatcacttgaacccaggaggcggaggttgcagtgagccaaggtcgtgccacggcactccagcctgagtgacagagcaagactccatctcaaaactaagtaaataaataaaataaaaaataataataggccgggcacggtggctcatgcctgtaatcccagcactttgggaggccgaggcgggcggatcacgaggtcaggagatcgagaccatcccggctaaaacggtgaaaccccgtctctactaaaaatataaaaaattagccgggcgtagtggcgggcgcctgtattcccagctacttgggaggctgaggcaggagaatggcgtgaacccgggaggcggagcttgcagtgagccgagatcccgccactgcactccagcctgggtgacagagcgagactccgtctcaaaaaaaaaaaaaaaaaaaataataataataataaacaaatatttccatgatatttttaagttgctaatttgtggtcagtctttccatcatccatctcctcctctgtttttctttgtaggttttatcactgcttaacatactattaacattgtcttacattttatatctatcacctgcctgccactcctaactagaatgtacaatctatgaatgaagaggttattttttctcttttgctcacagatctattccaagcacctagaacagtggctggcacatagtagatgctggaaaaatactttctgaatgaatgagtcagttcatgtggtcaaccttctcaggtaggtatttttatctccattagataaaagagaaaatggaggcttagagaagttaaactatttttggagatgatgccccaaactcaaaagttttaagcaaaatcaaaatgatgtgaatgcaggaaacttcagagccatctcagataagaccaggagcttataggacgctagagagcaatagttagacatgggcaaggaagaatcatgtagtcagtatcaaatgttgtccactatggatggcaaatgctgaaagaggtaagagaaaaatggatttgtgagccatggaaacaacagaaggcctcagaaaggaggtgaccccggaagaggctgcctcttaaaggctaggtaggggtcattattacttgaaaccaatttgaacctctgtaaatttttctgagtctgaacagtttctggccccaaagttcagctctcttaaacctatagcctaccatagaaaggattcattcattctatacacatttactgagcagccacctaggtcaggggtgctgcctcagtgctgagcatgcaaggatgaaccagcacaggcctgggtgggggacagcagcccctacactgacagttaagaaaggatgtgagaagttcaaggagcatgcccaggacctcctggacccaatgctcccactgatcattattctctttgttttattttatttgattatttatcagtgtattcacatttacagacacaatagatgctcaaatattctgtggaatgtaacagtgagtaaaggaatggtacaagaacaggtctggggtcgttccagcaactgaagctcagagccaccgtgccagccgaccagttcagccagaggcggggagggatctccttacagctaaggaactaaagctcagagagcttaaggaatcactcagcaagcatgggaatcaggatattaacctccatctgtgcgaccttaacctctgtagactgcctttggtgcattcaattttcaaagcacctttgggggatatgtttgttatctctgctttattgataaaggagctgagagtaattagcccaaaatcaaactgcgttcaaacctagaccgagtagtgaacaggagctcaaggaagtagcgagagagcaagcatagaccatttttttcttcttttccaaattaaaatttatatttatatttatttaattattttattttattaagatgaggtctcactatgttgccctggctggtctcaaactcctgatctcaaacaatcctcccaaagtgctgggattacaggtgtgggccaccattttttcaagaacctcagggcggaaggctctcagcctttattcaccccctagtcttgtcctcatcatttggcattgcagccaagtttgtattgccccgccagcttccacggtcctgccccagctctgccagggttggcccctgaaagagaggcagtgtccaaatttattaaatggcttttttaaaacatctcataatgattacatatttttccatgaaatttccttgccttcattccaggaaaagcattaattatggtctataatcaagattttcatgtaatatgcactctgttgacataatgccagataaaacaaccttttttgaattaatgtagtttcttagtttttaattaactttaatgtggagaagggaattatcaataaaattgtaaatacttaggtttggaaatgaaccttaattttcacattaccacattgaaacactataagagagttacatatataacctgttatatcacagaagatgctataaaattttttaacttgatcatataaatcaccatcactaataaacattttcaatatttcttaagcagtatctagatccatgcggaatacctcaagttcttttgaattttaatgcttgtacattatgagaaaaactgaaaacagcagtatgttgttcgactttgtttaaatctctcttcaaatgataccataccttaccttacaatgaatgaaaaaacagcttctgtagacactaactagtttggggattatttgtacaggaatcttcttcaggccaggcaaatatttttgtttctttgtttcaatgtccttatattttactggaatttcatttttgctatgtatttcacgtgaggttttgagtttgtttctccacacttttaaagactcatttttaatccttaagaagtaaaatagccaaactgaaataattttttaaattgtgccaggaggatcaggaagccacagagaaaacccttggtagtggttagttctccctgggctcagtcctcagaaggtagggctggaagggaccttttgggggtcgcagatttccacccacttactccaggcagcccaggtgtctcttgtctttggcctgctgtcattttcaggacaggcttttcaggagttggactaatcttttgtgccagtttgcttctcttaagagtggggtggtgggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcacctgtagtcccagctactcgggaggctgaggcaggagaatggcgtgaaccccagggggcggagcctgcagtgagccgagattgcgccactgcactccagcctgggcgacagcgagactccgtctcaaaaaaaaaataaaaataaaaaataaaaaaaataaaaaaaaagagtggggtggtgtaggggacaggcctaaggttttagttctggcatccactcatggctggtctctgtgcctcagtttccaaaaatatgagatggggacagtggttcctctcctgcctcccttgcaggtgaacatggaatactgaatgtgcctgttctttgaaaagctaagtgtctatttctaacatttaatgtattaatttagtttacacatagaaatttaatactctgcatatgtgttcatttagaaatatttctaatttgccatactcgtttggtgaaaccatttattctttgatatcactgtttctgatgcctctatacactctaattcctcaactcagttttccagagcatcctgtattctcatgcaccgtattttcatacatctaggttgcttgggagagatacatcttttgaagccatccgtgatgctgtcactgaaaactctgtcccaggccccaaatacccatccatctttgaggatccttacactataaccactaactctactgaggtttttctttcatagatctttaaaataattgttcacagcagtttaacttgcatttgtaagaacattgccccaggaaaaatgatttaatccattaagcagctttgtgtgtgtgcatgaagccaattccattgagtgactgctacaagtgtctaaaactagcactactatgtttatatcacaggcaaatgtgccccttcctcaaagaacctgttgtaacctgttgtcacaaaataaaacaactgagatggtgccacataataaaaattttgtaaggactcaattattaggtgattcttcttatgagaaatacatttaggaaaaactgctttctattataaggtgattcttcttatgagaaatacattcaggaaaatttgctttctattcaagtctgtattatataagactagaattcctgcctctttcaggtcctcagatacactgaagtctccttctgacatttggaccaagctgtctcaatccttggagctcctgggctgcttccaaatgcagtagaaaacagtggcaggatttaaggtctctgccccgatcccaccctgcccattcctccttctatctgaggaacttagggactccactgggccctctattattttcctgaggaagagttctgcctgatttctctgtggtctgtgatgaccaacaggagatgtgctcagaacccagaggccctggccaggctccttacccaagggaacccctgcaacgtgtgggtgcggctgcttggtgatggaccagtaacatctctgagagtgatgatggatggtggtcagctgctaggagagccctggcttgggtggtctggtcattctctgtggcgctcatggagaaaaactaatactgtggaaagagacagcgagactgagctcaggtcaatgaaaggaaatgtggtcagcgtaagactctctaaggatagctgccgtgtgttgttccctatcactaagaaggttcatgaacagtctaggctacaactctcagggctcttgaagaagagattcaagcattgcatgtggacttctatgaagtgaccttaaggtccattccagccagatgtaacattttgtttaaccatttccagcctggctgaacattctgctatctagtggcagtcttcagccgcagtgtgacggaggccaaaagcagtttctctttgtaccttattttctgaagaaatcctataaccctggatgacccaaatacccatcccacttacgccagctcccaatacccccatacttcctaccaagctttatgccgaaccaattttttcatctgggtttagatttcccacatccctaacccattctggcaaagtcaagatttacccctgctgagtaacatgacttctggactgagcggcaaactcatcaggataaaccagactccggaaattcaattcatcccagcaaacctttttgaagtctactgcacaattataaatctaagtttcagtgcccattttaaagatggaaggctcagagagatgaagagccacagtctcccagcagttaggcagcaggaccgcggcttcatggcaagccccctgactccccagcaggacttctcactgagaaagaaggtgcttccattaaagcctccattaaagatattcatgttttaacccccagaatctgtgctatgctaggttacatggcaaaggggagtcaaggttgctgaaggaacaaagtatggtaatcagctgaccctaaagagatgattccagattacctaggtgggcccaacacagccacaaggttcctttccagcagaggagggggcagagaggagtcagagtgagagagagattgtgctgctggctttcatgatggtagaaggagccatgagctgaggaatgcaggtagcctcaaaagctggaaaaagcagggtaacaggttctctccagagtccagaagggacacagccctgctgacaccttgttttaccccagtgagacctattttggacttctgaccttcagacatgtaaaataacaaatttacactgctttaagctgctaaatttgtggtaatttgttacacagaagtaggaaactacagtcatccttcagtgtccatagaggattggttctgggacctcctgaggatatcacaatcccagatgctcaatccttaatacaaagtggtgtactatttgcatagaacctgcaaacatccttccgtatactttaaatcatctctagattactgtaatacctgatacaatgcaaatgctatgtcagtagtcattatactgaattgtttctttttaatttgtgtcatgttttattgctgtattgttcatttttatttttctgaatgttttccatttgccattggtttgaactcttggatgccaacagtcatctctgtggctctctcctttactcattccagtctctgctcaaagtcatcttaacagagagaagctgccagcagcacagatgaagtgctgccctgcacttgcacagtctttccaccgttttccctgctgtccttcatggcgctgaccaggtcctgcagtatcaggcgtcccctcatttcctggcatgtgtttgtcttcccacactagaacgcagccctgaggggtggccttgagtccttccttccctctgtgtccaagcccagagcctggccccgcacagtgtaatgtgccctgaagagtgaacacatgaatgtgttggtcaccgccccattgtgcagcgtagttctccatgtcggtcgtgggaaactgaggcttggaggggttacgtgaccctttccccacgccacgaagacaaggaagcaggaggagaaaatacactaactttggacagcctcaatctggattcgaactccacctctgccccttaccaactgtgcacacacaggaggggggttactaaccccttgaagtcagcttcttcctgcaacacagacagatgccactctgccaccctcacagaatgttaaagtgggccaaaccctgcaaaatacatagcccagccctatcaagtcctattcaaaggtgacactgtatttatcagggaccatgagtgaccttctgctcaaaggggtatggcattgccatcaagaaatcagaactctgcttctcacctgttaaggtttagggcctgccagatatccgacctgcacttaactctctattcttatcacagaaactgtggagtggatttgattagttctattttacagaccagacaactggggctccaagaggagaagtaacttacctgccccacatgccacagtcaagactggcagcaatggtggggcccagtacactctttcccacccccaacacttgaagacctcaaaagtaggttgatgccatgtctttactactgtgaatagtgttgcaatgaacatatgtgtgcatgtgtctttacaatagaatgattaatattcctttgggtaggccaggtgcagtggctcacgcctgtaatcccagcactttgggaggccaaggcaggtggatcacaaggtcgggagatcaagaccatcctggctaacacagtgaaaccccatctctattaaaaataaaaataaaaaattagccaggcgcggtggcaggcacctgtagtcccagctacccgggaggctgaggcaggagaatggcgtgaacccggaaggcagagcttgccgtgagccgagatcgcaccactgcactccagcctgggcgatagagcgagactctggctccaaaaaaacaaaaatcaaaaaacaaaacaaaacaaacaaacaaacaaacaaatatatatatatatattcctttgggtatatacccagtaatgggattgctgggttgaatggctttctgtctttaggtctttgaggaattgccatactgccttccacaatggctaaactaacttaaactcacaccagcagtgtataagcattcctttttctctgaaatctcatcagcatgtcattttttgacgttttaatagcagccattctggaatcaacctaaatatccgtcaatgatagactgaataaagaaaatgtggtacatatacaccacggaatactatggagccataaaaaaaatgagatcatgtccttttcagggacatggatggagctggaggccattatcctcagcaaactaacacaggaacagaaaaacaaatactgcatgttctcacttataagtgagagctaaatgattgagaatacatggacacacagaggcgaacagcatacactgcggtctttcagagggtggaggtggggaggagggagagaatcaggaaaaataactaatgggtactaggcttaatacctgcttgatgaaataatctgtacaacaaacccccatgacacaagtttacctatgtaacaaacttgtgcttgtacccctgaacttaaaatgaaagtttaaaaaaagaaagtaaaccggattcttcctccatatgtatctcagtttcagcatctgtgaagcccactctgagctgtcccaggagtataaatccctttatgcattaggcacctctcctctggagagcttagcaagggggtaatttgacatttatttttgtaattccttgatcaatgtctgtctcccccaccaggctacaaactccatggagctgcagaaccatttggtgtgggttccccactggtttccctggtgcctagcacagagtctggcaacgagtaagggctaaaatgtattttcagaatgcaccaacggctgcaaagatggactctaaatgccaatggcaaacttctcaaactctagcttccaacaaggtgggccagattttctcctagttccccatacaagctaccccggggagccgcatgagctcctacccgggccttggtcttcaactgacctatgaggtcaaggcattctctctcccagaagaaatatccagggcagaaaaaccactcccacagtgctcaaagcatttccctttgaacattttcctgcttcttattttattcataaccaggcaacctgaagctttaacaggatacatggttttttctctcttctagatttagagaaaaaaatgtttgagatatttttaactgacaacacccagccccttctccctatgcaacaccctctccccgaatctgtgctcagacaccctatctcagccccagagacaggctcctgaggccgaagcagctcaggccataaatcctcatctgcggccggtaatccacatggagagaaatgacaaatgctctatttagccctatttccaaggaaattagaattacaaattggagctattgctaaggccccgcttgagcataacctttggaaataaaggtagggagggggtcggggaggactggcatttggctagccaatttctttgtcaggttagcttttgtagaaatccacccccacctatgggaatcacacccctccccatcccttccacccccagcactaccaattagagccggtggcccaggagtattcgctctggctttgttcaccgctaaaggcaccaccaaaccaggtaagcaatcacttccagggaaagtacagaaaattgcttctttaattgggtagtttctagggctaagaataatttaattgaaaaccagcattaatgagaatcaaaaggttttaaaaaggggcctggatggagatgtccacgtgtcagagacaagtgacagccagagttctcaaaagatacatggagaaaagggctttgttaaaaatccatcatcccccactacccacactcctacctcactcctccaaacacacccctccccagcacagatacacaaggctgatttggatgcttatttcgaaaagcttcatctcatctccaaaccactgagaactactggggtagatgttttttgttgcattttgtttcattttcttaattttgcagccagtagtgaaatataaggcaaacagtgtagatttctacggggtgagttccaggagccctgagttcaggtcccgttccagtacccactatgaccctggtcaggtcacccagccctctgacactctttacccccccatttgtcttatttactcaacaactactttcacacagctaagggccaagcattgttctcagcactttataaataataagtgatttaatcctcttaccaagccccttggacaagcacagttcattgcccccttttcttcttatcagaaacccaagaggtaccgagaggttcagaaacttgcccacagtgacacaactggcaagttatggagctgggagttgaacccagcagtctggttccagggtccacctctggcaatacacagaaaggatgctaccactccatcaacccctatttcccaaggggtgtgagtgctcagaggacgtgggtgggttgctgagcccatttatctcatgtgatttagctcatgcccctctaatccttttgcacctgtctcctgtgtgctccctcctgccctcctcacccagccaccaactggttcctggcattaagctctgtttctgcactttgagttctgattctgtgccttcgtgctacaactggggtcatctgtcctgccccgtgtgaagggtctacactgaatatcgttgaatcaaggattttattccaaataatgaggcacaaactcataataaaaagacagcatggtgtggaggacaggagctggtgctttgcagcccagcagctgggactgaacttaggaaaatcatgtaacttttctgtgcctccacttccttcttgtaaaaataaaggaataaataatcaagcctacttcatagagttgtgcaaactgagcatgttaaaataagcatagctctacagaatgctacggggaatgtggtatgagacagatgcacagtgtgacacagctgaccacaggtcagtgctgctccgccaactgagctgcaggatggcagattgcagagagcgtgggatttggtggcattggactttgactgaatcaggcatgggactctgtcacatcaatcagcatctccaagcctgttccttttatataaaataaagagaataataattcctgctcacttcacctgattatgaggattcgacaaagcagagtgctttgtaaattacaaaggaacctagaaacattgagctttattcttagaacaaaattagttggtgagaaagtataaggagacttggatttcagggtagtaatatgggctaaagccttcagggtgtttccaggtaacatgctctgcacccgatcaatatcaccttgtaattctcacaattctatgcctgttttatagacacaaaaacctaaggctcagaaaggcaaaaggaccaactggtgtcatgaaaaggggtggactgacatttggagccaagtcccaaatgctcttaattgtggcattacattgtcacattcctgtcactgtcacttcatggggaagcaaagagctggcctttcagaaaggaagagggtcaggccccagatcaggagaaggagaggcagctgtgagcaaaggtgaggaggaggaaaggcaaggcaggtctccatggcccagggcagcacagccacgtggctttcccgcctctctcctccagactctgcgttcactgtgggcagggacacattagcttgcatttatttcccccatgcacctgccccatccccaacataaatatttttaagggaaatcaagtgaatgaatgaatgatattactcaactgaggcactaagatcaagttaagaagaaataaaaaaacgactctaataagcagtaaagccatgaagacatcttccccaatcctccaaatcaaattaattttccctcctttgggcacccttagttcttctgtgattagccccacccacccaccccaaaaaaacacacaaaaaatcattattattaatatcatttactgagctcttactatgtgtcaggcatttcccatacagaatcctattcaagtctcacaactaccccatttcacagatgagaaaatcaagactcaccaaggttacagaactgggctaggtcatacggttagtaaacccttggtttcatctcaagtctctgtttctgaggctagaactcagctgtttctctacatccctatctgtctgcctattaaacactttataattttccaagcaagaagtccatcttacatgcccatatgcccgggataccttgcacaatgctgggcacagagtagtgtgctccatgggcatttgcagagctgaactgtatttaatcatctgtgtctattcaaaggctgaggtctttatcagatgggagcccagaagggataagctgggttactgtttgcctctccaagcagaaaaagaaccagatgacctcctggtacatgtttattgctaacggccctgcagtggcttccacaacatgcctcagcctggatccaccaaccttaagctactctaaagacaatgccttcgtggtggccaacaagattagcacccaattaataactaattttggaaagactgtgcaaaacagcttggcaaactgcatcatgccacacattagcttgacctgagagcaccctgcctggaaatgaacagatcaaaggggctgaaaacatgagcttgggagacccggactctgctctccttggctgctgggaatctgtgtgtccttaagcaaactccctccttccctgggttcaggttcttcgtcctttaagctgaaaagcagagctagactgggaagacctcttccaggtccaaaattctagagctccgggatacaattaaagccaagcaaggcaaccaggatgagtctatgtgtcagcaaaaattcccaggcaatgctaattactggcacttaaccaactcatagttaactccaggtaatttccagaggatttattacaactctgaatgctattttgtgagggaagcaatgtatatttaatattgacagtacaggaggcaagttccctttctccaagcccataaattatcccaggcgacgggaggacaaaactaccaaaggcttgttacaagcaggctgcctcccaaacagaaatcaggcttaatagaaaacaataaaaaagatgtaggaggagacgaatttaaagccagaagcacgtgagtggtgtgtgagacagcatgtatgtgtgtatgtgaatggcctcagaaaatcaaacgatagaagtcagagaggaatgtccaattcatctcattaccattagggtagcttcctgttcaatcccacaacaaacatttcctgagccccttctgggaacccagggtgagtcacatcagacttggtccccaaataagctatgcatgtggctctttccctctccccctgggactctgagtccatcttaggatgctctgttttcatatccccaaaatgagaatccaaagacttacatcgtggcgtgttctgcaggcttcataaggtaatgaatgcaagaacaagatttttaacaagtggtggtaacacagctagaaataaccctaaagcagggcagaatgggcagacaagggtcaagataaaggtaccagagaaaaccacaggcagacagtaaaggtttctaggacacagatgtggagaagacactgcaagaaagaagaaaaggaagaaggtggggaagaggtggtggaggggtacctgtgcgtgggccacacagtgattggctgtgtgtgaggaaagagactgaaaaaaaacaggagaaagaaaagtaatggagattaaagaaaaagaaggagcagagtagcgggtgagctgggttatgggagagagagaagaagaaaagaggacgtaaaccataagggagataagataaaacagaaaatcaatagaagtgcctaaagttgattcatcaagagacagcgccacgagcgcatgatttagagatgcaggagaaccaccaggagttctaaggacagaaagaacgagactgcctctggggaaggggctgtggcttttcatttttaacctgccttcctatatgactttgggcttgaatatatgtatgtattcctctgatagaaataaaaataattgaaagcatttttaagagatggaaacagaagttaccacggcgtaagtactacctgctgggcatcacccccagcgacttataaataccatctcatatttgtcatcccaaccacactacagcgtaaccaaatccccttttcattttcctttagctgcacttactttgtgggggctgttgtgaggattgaaagagcacaggtaagcagctacaaatgtgcctggaaaatgcaaatgctcaataaacgttccttcctattgtcaaagaatttgacaagcactcctcctttttcctgggagctattctgccccctgttttgtagcagctgtcatgccatcttatgatcctttcacccaaagacacaggtggggaataagggttctgcagtaggcacctgaacccagctaagtcagtgggtccctaacttaggaaggcaattacttttcttcactgtaaagccacacccctcactcaggccttcttgatctcctttggggtccatgagcaagcaagatccctgggacgcctcagctggtttaagatgggtttctgctaccagcctctgaaagtgtcaagggagttcaaaagcaaacgtcatgtaggcgtaggtctctccagggctttcccagaacaagaagctgagctctaagggggaagaaggagaaatatgaaaaaaaaaaaaaaaaaaaaagaggaagaagaagaaaacaaaagaaaaagtaaaaaggaggaggaggaaggatgtgcttgcagtgaattctgcgttttgattgttgctattttatagctaggaaaaactaagcaaaagcaatctctggtcacagctagaaaactattatttgcgtttctatctttccaacccacgatctgtgccatttggatttcatggtctaaaaatatctcccaaacttccaagtatgttggcatgggttgatggacttaaatttttaatccatttgtaaatgttttcacacagctcttttttccctctcaaattctatttcttgctgaatcacttccatcatttagtttggcatttatttgagcaggaaggaaatcatcttgaacacaaatgtcagccctggccccgaaggctcctgagagagaaaaaaggccaacacgggttagagactggtgaggttgccacggtacggcaggaagagcaccggcttcggtgtagactattctggttgcatctggctgtgtgaccctgagcaaaatattggacctctctgagcatgttcttcagctacgatgtggggataatgaaattcagtttaacagtgtttgtagccattcagtgggttagagccccatgtgtacctcctagcacaaggcaggagcttagtaaatggcctcattgtgaattttaggtgtcatcttgaaatgtgtcttgtaaagaccatgtgtatgcctgcctccgcatcccttctccagccaatggcagagtcactcttgcaaaacacaaatctgatcatgccactcccgaccgtgaaacccagtggccacaggatcggattacagtgttcactgtagaccactgtggtctacagtgaacatagtacagtggtcaatttcccatcccccctccacaccagcctctccaactgcctgccctccaacctcccagcaggatgctcctactctgcctctcatggttctgatttccagttcaggtcctccagctcagccactcccttttcccacctctctagacccccacaggaaaacacatctctgatggtattccctctggagccctcagattcaccccccacaccattggccctgcctgggtcatgtgcttactcctgtacctgtcatcattgtcaggtgaggccagctgatcccaaacaatgaagtgaagaataggaaggaattaagtccccaaagtaaaatcatggactgcttggtgggagagctgggggctacatgtgggaggcaaggatcaagggtcaaggctagtttccacggatgagcaagggacagttaagaaccactgaggccttaaagttttacaaactgagaaattaaggtacaagatgggcccatagcaagcccaagttcatgccaggccatcacccagggtccagcccccaactctagccctcttcccactgtgtccagagttggtgccttccactgggttcacagtcttgctgactttaagaatgaagccgtggacctccgtggtgagtgttacagctcttaaaggtggcatggacccaaagagtgagcaacaggaagatttattgtgaagagcaaaagcacaaagcttccacagcatggaaggggacccgagtgggttgccactgctggctggggtggccactgctggctggggtggccagcttttattcccttatttgtccccacccatgtcctgctgattggtccattttacagagtgctgattggtccattttacagagtgttgattggcctattttacaaacctctagctagccacagagtgctgattgtgcatttttccagggcactgattggcacattttacaaacctctagctagccacagagcgctgattggtgcattttacaatcctaactacagagtgctgattggtgcattttataatcctcttgtaagacagaaaagttctccaagtccccactcgacccaggaagtccagctggcttcacctctcacctccgtactgccaacaccttccccctcccccaggaaaacagcttcatgattaaatcaattttgcaatcagcagttccagccacaggttccatagcaggatgtgaggaatggtttctgaagatgaagtggaagggctacagggcactgaggggcaggcatcacaccatctcccacaggcaggcccaccagagtcaggcccaatgcaggtgaatgccctttgagccgaagaggaagaaggagctcacatgcttgttctccttctagggaagcctcagcactccagctttccctcctttcctcatcatcaccgtcctcccttctctgcccttcaatggacgactggggcaagggaagggggtgagagaaaagaaaagcagaactgaaaaaggacatcaaaggatgggttgattagaaagctctttccagagaaggatggaatgtctagaaataacgtctgtgatgccctttgttctgagcctttctgaagagcttttactcatcgctcaagatcagtaatatggtttggctctgtgtccccacccaaatctcaccttgaatggtaataatccccatgttccatgggagggacccggtgggaggtaactgaatcatgggggtgggtttatcttgtgctttctcatgatagtgaatcagcctcatgagatgtgacaattttataaaggggagttcccctgcacatgctgtcttgcctgctgccatgtaaaacgtgactttgcttctcctttgccttctgccatgattgtgaggcctccccagccacgtggaactgtgagtccattaaacctttttcctttataaattacccagtctcagctatgtctttattagcaatgtgagaacaaactaacacaatcgggctcaagaagcatctcctttgggaagactttcttaatgcaccatccaccacgggcagacgttatcctgtccctcctctatgcccactggcctgagacacactgcacattctatttgtgtgactgtccccacagcttgcattttccagaataggaaatcagtaggtgctcactaaatattcaatgaattggctaaggatgcagatgtacaaagtgcagggaagaagaagatttagtcatgcaataaacagaaatgtaggtgcaggaaggaagaaaggcgtctattcacacaggactccaacgctggagcagcagaggatgagttttgcagagagtcacagcacacatctatcaatggataactgttgcaaatattcacccacgacattttctccatttaactgatgagatgagatctgatgtctccaggccttaaaataggacaggagcagcgggaaggtggggagagaggacaagcttggatgtttggatgttcggtcagcctgtagtttcaagcggcctcaactgggacaggtcaagagaaaaatgggacattttcaaatgaagttcttttttttgcagaactaaacaccctggagttggagggcacctttaaagtcactgggcccaaacactcacagtggtatgtggtttctcacaccgcagccaagggttgggtttttcgtttgtttgtcactgtgctaaaatatacataacataaatttttatcattttaaccatttttaagtatgcaattcagtggcattaaccacattcgcatcgttgtgcaaccatcacctctatccacctcccaaacattttcatccccccaaaatgaaacactgtttccatcgagcaatagctccaccttctctgcttcctccagcccctggcaaccaccgccccactctctatttctatgaattaaactcctctaggtgcctcttttaagtggagccatgcagtatttttccttttgtgtctgccttatttcacttagcctcatgtcctcagggttcatccatgttgtaacaagtgtcagaaatgctttcattttaaggctgaacagtattccatgcacatgctgctttatcacctccactggaaccttctggcaaagatgagacactacccgctttccaagactgctgtccccctgcagtcaagtatgactggcaccaaatccttgggttcagcagctgagcatcttgctattactccttccactggccaagggaaccacagaagagtccattcctcacccacaagacaggactagggatatctgagggtaaggctcacagtcctcttcactctctgcctccaagctgggcatgctccaatctgtcaagcatgatagaggattcaggtcattttcgggccaccttgctaaccctcctccagacacatcccagtgagtctgtctgggttattcagtcagtcaacaaacacacactacagtctggccccaagctgggagctggggacaccacagtgaacttgacatgatgtttgcctgcctagagctctcagtttaatgaagggagacaaatcagtaaataaacatgtaacttacagattatgataattacagctcatgacagggtgcttggaaggatataaaaatgaagactggctgagagtaaggtggtcagggaagcccctcctggatccgaaagaagccacttcatgggagttaagggtgcggtctctcgggtaaagcaaaggcccccaggggaggcaggaccttggatggtctaggaagggccatggtgatctggagagcagaatgctggggaatggctggtccacccaagggaagagaggtgggcaagggctggatcatctggggcctgttggcctcggtgaagacggcgggtactagtctaaggtcaacagacagcccctgaagggctttgaaccatggaaggcatcatctagctcactctggaaaaagacaactctggctgccggttggagaatggatgggtaagagcagaagacagaagagaagtcaggacattgcaggagatgaggcctgagaggtcgggctgcctggaattattatgtggggaccctcaaggccagtggcacagactctgtgtatcttcggctgttcttacagtagagcctggggcctaaaaccgaggggcctgcactggcctagaggctccttctaggcgggtggtgtccctgagtgcaggctcagaggccagctggctccctcctcttcccctccaaaccctccaactctcttcctgtgagctggatcatgatcagtcaattctcattgatctgttttttttttatcatctctgagcacaaacattgaccgacttaaaacctggagtagaatccacacacaacagactcctgataaattatcctaaatggcaaggatggttgtgggggaacagcagtggggctgacctggcccaactagaagacgaaagcttctccccaggctgccaagcaagcgcctgccagaagcgtgtctgtgcagtccccacggaagccagtggcattcaggcttccgagagcagcttccaatgccagtgttcgcatctggggtttggtttggaactcagctcggacactgcaaggccaaagggattagtcaacagtgcttgttaaacacagacctcatgcctaacaccatgcctggcaccgtcgattaaaagaaaacatttcacgcgtggctcttacttgcaagagaaccatgatctggttaggatgctcatggcagaccctgccaaggcagagactaatgagagatgaatctgagtggtagctccactggagctcagggagaagggcccagaaaaggactgggagagaaagcatgggcctgtcctcgggttcatgtaggttccatcccagcttcacagcctaacagctgtgtgtccctgggcaagtcacccagcctctctgttcctccactctctcacgtccacaacaggtcacagtcattaaaattatgtacagtgtgcccggagtgttatattaataacagtagcttcatttctacaaggtgtgctctgtgtcaatgctgtaccaagtgctttacataaataaactcattttattctcctacattcttttttattttattctcctttattctctataaggaaggaaatctgtaaaacgagtacctccgttttacagacgaagaaatggagacccagaggaatgaaagaactgcccaaagtaatccagctaggaaggggtcatctcagtgcctgatacccacactgtcctttcccccgactgaccaccatggagcagcagatgaaatgggcttgaggagccagagaaactcagacataattagatgcattgatatggtgatgtacacccatggtcctggaagtattactcataatagccaaaaggtggaaatgaagaaacccaagtgtcccttcatgaacaaatgacatatacacatacaatgtaatattatacagccactaaaaggaaggaaattttgacacatgatgcaatagggatgaagcttaaggacattatgctaagccagtcacaaaacaacaaatattctatgattccattcataagaggtatttagaggtgttaaaatcacagacagaaagtagaatgtggtcgccagaggctggggagagggggaagtagtgagttactgtgtagtgagtacaaagttttagtttacaatatgaaaaaaacattctgtgccactgaactatacacataaaaatagttaaaatggtaaattttttttaagacagagtctcactctgttgcccaggctggaatacagtggcgtgactgcaacctccacccctcgggttcaagtgattctcctgcctcagcctcccgagtagatgggattacaggtgtgtgccaccacgtctgtctaatatttgtatacttagtagagacagggtttcaccatgttggccaggctagtctcaaactcctgacctcacatgactctcctatctcagcctcccaaagtgctgggattataggcgtaagccactgcacctggccattaaaatggtaaagtttatgttatacatatattttactacaattaaaaaatattgatatggacataagaggcctatgcttcttcttgggtgccccagtattactccctgtacctccatttagatttattcgtttcttcagttggcattttttgagcttggtacctattctatttagagctagaatccaagaggcctggattcatcaccactgtcctcgtcattgctgtcctagcagatacttacactctcattgtgcccagcacttgtccatgtgttccatctgcactaactaactcatgtaatcctcaccggcacccttagaggtggatacttttttttgtttgtttgtttgagacagagtctcgctctgtcgcccaggctggagtatagtggcgtgatctcggatcactgcaagctccgcctcccgagttcacgccattctcctgcctcagcctcccaagtagctgggactacaggcacccaccaccaagcctggctaattttttttttgtatttttagtagagacggggtttcaccgtgttagccaggatggtctcgatctcctgacctcgtgatccgcccacctccgcctcccaaagtgctgggattacaggcatgagccaccgtgcccggccgatggatactattaatattctcattttatagatgaggaaactgagacccagagaagtgaagtcccttgcctgaggtcacaccactgaaattcagactccccatagtctggctaaaaactctcagctccaaaaagcctctgtcacctgaaacacaagccacattttcatccacattctctctgcccacccccaatccaaccaaagtggccaggcttctgtagcgacaagttgtgcagcctggggaggggtccgagtcaccgcaatattcctggaacaagcccactgcttctgctatttccaaagtcagcatttcccactgctatttttttttccagatgaaagcaacaaggtccccagcttaatatgtttcatacagtgacactaattaatgttccaaacaccagggctcggggattgagggtgtgtgtgtgtgtgtgtgtgcagtttgtgtttaggtaatttattttcccccacttttgaaatgatgtatgtgggtattttacctgagccaaactgttcataattcaaaaagcaatgttagctttctattttttttttattttatttatttatttttttttgagatggagtctcactctgtcgcccaggctgcagtgcagtggtgcgatcttggcagctcactgcaaaactccacctgccaggttcacgccattctcctgcctcagcctcctcagtagctgggactacaggcgcccgccacaatgcccggctaattttcttgtatttttaatagagacggggtttcatcacattgctcaagctggtctcaaactcctgacctcagtgatctgcccgcctcagcctcccaaagtgctgggattataggcataagccaccgcgcctggctgactttcttaaagtcataaaaaactactgtgaactacacactaaccccacaagtgcaatccattctgcagcctcctacatatgtatttttgcttcaaccaacagtgtgaatgctggaaatctgaagccaggagccttaggcagtcacggcctttagaacaagaagtttacagatcacagaagggagtggtcctcaaacaagggtgccaacaccccaaacagaccctttggaaagagtagatctgatttattacaataggggaactctaacagtgctgtgggcaggagcccaggatgctgaacatcctgcagaatgtgtgacgttcctgccccatgaggaacagtcctatccataatagcttctccactgagaaatcccaaaatgtgtccatatagtttttcagggaagaaagatacagagacaccgaggtttcttgcctaaggtaacacagtaactcctcggttaagaaaggtcacacgcctccagcttcatctcttgtttcatcctctcaccactcagctaccccaaccctcccacttccatataaagggtccctggatgcagccactgggaaatgatcacactttaggactttaggaacctgctgcattttctcaacaccaagcctttgtcagtgactcccttctgccttcacccctaacccagactctgacaccgttccatctttccacgcctggatcaaaggctgcctccagaaaaccagccagagctctatcccggaacccctcccagcagtccatctgtattttgactttcagcctgtgtaccaatctgcctttgtactggagttggttattagcattacccttaccatcaacagtactatgccagctgctgaacaaccattctgctatcctatggtcacagtgggctggtggggcaagacatattatcctattttaccaacgaagaatttgaggcttaggaaggttagcaactttctggaggtggcacaggtggcaaaacagggatttgctcccacatctgacagcagagcccacactgttgtgagagggccaccctgcctccctccatggtcatgagcatgtccacctcctgtccagacgatgaggtctttgaaggtagaagccctgccacttccatccacatcctccttatggcaaaccctccataaatcatgtcagagtccaggcatcctgactcctggtccaggacttgccacctggtctaggtccttttcaccccataagccacccttggcccaacatgacctccctcaaggtacatggtgagtcaggagtagggccacacagtgagaagttccctaaggttcctacctcccagcaaccaacaacagttcactacagtagcttcagttagacaaaataaacaccttcccatcatatctttctggctcagcagtctgctttagcattgcagtgggccaggcccatgaaggcatccaagcttccagaaccagaggacttctacatgtgtcatgcctacatgcacaaaacccgccaatcaactttttaaaatagactttattttttagaatagttttctttttttctttttgagacagagtctcactctgatgcccaggcgagagtgcagtggcacaatcacggctcatcgcaacctccgcctcccgggttcaagtgattttcctgcctcagcctcccaagtagctgggactacagacatgcaccaaaacacccagctaatttctgtatttttagtagagacggggtttcgccatgttggccaagctggtctcgaactcctgatctcaagtgatcctcccgccttagcctcccaaagtgctgggattataggcatgagccactgcacctggccatgaatagttttcaatttagagaaatactgatactgtagtacagaattcccatataacctgcagccagtttcccctattattaacatcttacattagtatgatacatttgttacaactaataaatcaatcctaatgcatttttattaactaaagtccatactttattcagattcccttagtttttacttaataccctcttttctcccaggatcccatctaggatcccatatttcatttagtttcacatttctgtaggcatctcttggctgtgatagtttctcagtctttccttgttttagatgaccttgatagttttgaagaatactggtcaggtattttgtggaatgttccttggttgcaattcatatgatttttcacccataattaaacgggggttatgggatttgtgggggaagaccacagcaaaatgccattttcatcacatcatgtcaagggtacatactatcaacatgattaatcatggttgatgttaacctggatcacctggtgtcttagtccatttagtgtgctacaaaggaatacctaaggctgggtaacttataaagacaagagatttatttggctcatggttctgcaggcatggtgtcagcatctgcatccagtgaggacctccagttgcttccactcatggtagaaaggcaaggggagctggtatgtgcagagatcacaggataagagaggaagcaaggcagaggaaaggtgtcaggctctttttaacaaccagctctcacgggaactaataagaatgagaactcacttatgccccagcacacagggaggggattaattattcatgagggatctaaccccatgacccaaacacttcccattaggcccctactttcaacactgggcatcaaatttcaacatgtagtttgagggtacaaatatccaaactataacacctggcttgaggtcgtgttttacaggttcctccattataaagttttctttttcttgtttttttttttttttaattcccttttcataccctttggaaggaagtcacttatgcagccctcactaggctccctctccttgagggtagaatatctacataaattagttggaattattcttacaggagatttctctcttcttctcatatttattcactcatttatttgttatatatcagtatgggcttgtggatatttattttatacttttgttatactccagtattactttattttttgtctcaaattgtcccacattggccagggggtgctctttcagttggcttatgtgcccctttgacatactcccatcaatatgggattttttaaaacacctttttactttctggcactataagatgcccttggctcaccttgtatatatttcctgccccatcctagaatcagccatttattcagggatccctgtatcctttttgtgcagaatggttttagaaaccaaggtctggatgccaggtgtgctcactgcaatcaggatttgactttctaggctcaatgagctgacagcgcaaggatatatatgtgtgtatatagcccatgcatatacacatatttataaatatttctattcataaccatctatgtttgtattaagttaaacatgagtttacatgcatatttccaactcaaatccatactacatggatactctagactccatttacttttctgtaaactctcacttcagtggtgagaaacctagctcccaccactgccatattttgcttaaccgttaaactccagtacacaagtataacagtatgagaatcattgacccacaccccatgggaaacaacagcacttacgtactaggccttttgtttttagtcttagaaactccattcattgccaaagttgcttaggtcagcaccttctccctccatcaccttcaatgaggttgtttcatttatttgtaatatagctagattctcttgtcaccatctgcatcccttcctggggttccgtgacctcctaaataattttttaaatttacaaacacaaggctcaatttttgtgccatgaagttctgtgggttttgacgaatgcactaagtcatgtatccaccattacggaatcacacagaataatttcaccaccctaaaatatcacctgcgcttcatctattccaccctccttccctatcttctagcccctgacaactactgatctttttcctgtcactaaagttttgctttctctacaatgtcatataattgaaatcatacagtatgtagtgttttcacttagcactgtagcttttgtcatttagcaatatgcatttaagattcattcctgtatttcatgacttaatatctcatttctttttaccaccaaatacaatagtttattgtatggatgtacaatggtttgtttatccattcatcttggttgcattgttcttggcaattatgagtaaagctattagaaacatttccatgaaggtttttgtgtggatataagatttcaaatgagttgggtaaataagagcacaactgctggacactattggtaacactatatttaggtttgtaaccagtggctcacacctgtaatcccagcactttgggaggccgaggcgggtagatcacatgaggtcaggagttcgagaccggcctggccaacgtggtgaaaccccgtctccactaaaaaatacaaaaactagccgggcgtggtggtgggcacctgtaatcctagctactcaggaggctgaggcaggagaattgcttgaacccaggaggtgaaggttgcagtgagccaagattgtgccattgcactccagcctgggcgacaagagcaggactccgtctcaaaaaaaagaaaagaaaagaaaaggcacccactgccttccagggtgcctgtaccatttttccattcccatcagcaatgaatcacagttcctgttgccctacatccttgtcaacatttgacattgtcctcgctttggattttagccacccccattcaaataggtgtgtagtgatatctcattgttgttttaatttacaattccctaacgaaattatattcagcatcatttcatctgcttatctgccatctatatatcttctttaatgagatgtctgtccaaatattttgtctatttttaattgaattgttttccttattgttgaattttgagagttctttgtatgtttgctacaagctctttatcagataggtgtgtggcaaatatttctccaagtcagtggcttgtcttttcattgtcttaaccatgtcttttacccattaaactttcacaactactcttttgcagatgagaaaaatcgaggatcaaaatgacagctttttatagcaccattttagtcttgactaacactagcaagtgtaaaccataaaaatcaacgagttattacaggaccttgtaaatatactaaaaccactgaattgtacatttatttatgtatttatttatttatttatttatttattttattttttgagacggagtcttgctttgttgcccaggttggagtgcagtggcgctatctcggctcactgcaatctccgcctcctggattctcatgcctcagccactcgagtagctgggattacaggtgcccaccaccacgccaggctaatttttgtattttcagtagagaaggtttcaccatgttggccaagctggtcttgaactcttgacctcaagtgatctacccacctcggcctccaaaagtgctgaaattacaggcgtgagccactgcacccagctgtgaattgtacacttttaaatggtaagtttttaagttatatgaattatatttcaattttttacaaatgacaagaaaatcaacagtcagtgagtggcagtgctggaatatgaacttttgaccgcatcacagctactgcattcagaatatctgaagccaatcccagccctgcccctgaaaaactctgagaaagtcagatacttttactgaggctctttgtccccattgataaaacaggggccaattatacacatctggcagtgttatcacaaggatcaaatgcaacaatgtttttaatgattaacctgataccctggacacaggtcaataaggaatagaaagaatgattaccattgttattactactgttgatatcccaaaatggaagagtattctccctctccccatctaccattttccctttccctccttccctctttctgtctctttttctacacacacacacacgtatacatatacagtatatgcctcattcaagacacacatacacagacaatgttagcattccgggaagacacaaaacataacaacctttagcttttatcagatttttacttcataaatagccctgttttggaagacgacaatttggcccacaacatgttcacatctatgaaagaacccagactaatttagtgggattaaaaagaccagactgtgtggcttcagttggcaacttcatttacaatatttattgagctcttttgtgacagaaaaataaaatcaagtaacaagaagtatttggaataagaagcgtagttcaagagcaccagaggagaggaaaaacctagaggaagaaagaacccaggcataaagtctataaggctgtcactctagttgagccacaaatggtattcacagccctgacagccaaagcaaacaaaacagaagcatcctgcagaattcattttctacaagatgaaaacataatttactcaggaaagaaatccgctagtttctcactcaagtgaaccgaaaactctctagatctctttttccctactcttcaagtaagccgagtgtgtggttgggtttagacctctaatatgattgcaaaaactcagcactggcctccctggaggtcgtgtggtctaggcaagtgtttttcatggcatacctgcttcctcaggtgactcgggccaggcagcaaatcttttcttctacacttctattttcaatgtaatttcctcccttttatcaaaacggcacatcagaactcacactttatcatgctctaggacataaccttagggtaggaattatgataccatattgacttcagcattacttttattcagtgacatcattttttcttttattctttgagatggagttttcctctgacgcccaggccggagtgcaatggcacagtctcggctcaccgcaacctccgcctcccgggttcaagcgattcatgcctgtaatcccagcactttgggaggctgaggcgggtggaccacctgaggtcaggagttcaagactagcctggccaacatggtgaaaccctgtttctactaaaagtacaaaaattagctgggtgtggtggcgggcgcctgtaatcccagctactcaggaggctgaggcaggagaatcgcttgacatcatttttatattagcagaattggaaaagaataaggatggaatggccatttatctgatacctactatacgcccataagactgtatcacagccacttcatttaatccttaccatgtgcacagacatgttcacgttacagacgagcaaacaggtctaggctggttaagtggtttactcaaggttactggttaaacaatgatacagccagacttcaaagccagtacttatgtccatgtctgcttatcagtgaagccacacactccttggaggctggcattgtgtccattcatgcaaaaagactttgtatccagagtgtcatgtgttgtatcaggctctggaatgcagagaatggatgcttgcatgtatgtaatgtgccactaaaaagcaagtcctcattcgctttacacagctcaaggttcacccagctcaggttttatgattccactttcctttgtatcactttcagcaactttccttcagtgtgataaaaagtcggaccttggattcttcatggtcaaggctgtacattagaaaacgaaggaggaagtggtctccatcctgtacacatgatgaaatgtacttgatggaaatcttccctgatccatttaaacagtgttgacaacttttcgtgatccccaagtggactcagtatctgcatatattagagtgagtgtcacaccattatgcaattatttattcacctatttgaccactagtccctcaagagcagaaactgatttattcacccctctttctcctattcctagcccaaggtctggcatctgctgggcctgaaatcaatggcctctgagtgatcagtcagcatgtcttgagtttgatcagtgtatgtatacaaaacctaaaggattacattttttccaagaaatgttttcccagtcaaacaagatatgttcaagtcatggcacaaaaagaggaatttaaaaaagaaatctcaacgtttcctttcgtgttccagaactgtgaaggggaatgttaatgacttccccaggaaaccagaactccagcacagggcggaagtcacagcacctagtttacaaccaagatcctgccattttctccacaaaagatgtgtttgtaagagcaactggaatatctaatttaatcttgttttgaaaatgctaatgtttctcacattataaattagttaagattcttcattctttgaaagtatcacaaaagccactcagaattatgtcaccaggattgaagttgtccatgcttatttaaaataactctcttgggagttctagatcagcttgggcaacatagtgagaccccgcctctacaaaaaacaattttaaaaaaatagcgggcataggctgggtatggcggctcatgcctgtaatcccagcactttcggaggcggaggcgggaggatcataaggtcaggaggagatcaagaccatcctggctaacatggtgaaactccatctctactaaaaatacaaaaaataataataataataattagccaggtgtggtggcaggcgcctgtggtcccagctactcggcaggctgaggcaggagaatcacatgaacccaggaggtggagcttgcagtgagccgagattgcaccactgcactccagcctgggcaacagagcgaaactccgtctcaaaaacaaacaaacaaaaaatagtgggcatagtggcacctgcctgtggtctcagctacttgggaggctgaggcgggaggactgctttgagcccaggaggtcgaggctgtggtgggccatgattgcaccactggactccagcctgggagacagagggagaccctgtctaaaaaataaataaatacatgaaataaaacaaacgacaggaataaataaaaggaaagaactcgcctgttttatttggtgaaaattacaaatatgtgaccataccataatattaacaaggagaaagctcctttccccaaaggataatgcaggcagtgaccaggttttgcggtgcttctgagaacactataattccagcatatagtaacagcttagaaagtttagctatcattagataccaggcattgaatttacatatttacaaatacttttaattcatttttttccggaatgacaaccctaactgaaaaattaatgagggggaaaaaacactagagaatcatcacaacccttaggcttcaagacttcctttacttaagaatcaccgagaaaacagagccacatattgtgagctttaagtcacagtattttctttacttacgaaccagaggacgactaccagttgtcattggcgcccttcccatacctcctcaggactcactcccagcccctgccaaaagtagcctaaatgtggcatgtttgtctaagaaatttctctgcccccaggagcaccgcttaggcagtcatggctggagttcaaggaccattcctggctgttctagatggcattccagggtccctaggaagactaagcctcagttgccctcatggtaacctgcttaatgacacatccttataatctacttctttcctgtcttatttcacttaccttccccgattttacaaaattctccaatttgtcttggaatcacctcctaaatcatgcattctcactagggatgctattgcattccagggggcaaaattcgttctgggaggatagagtgaaaaaatcttactctttttatactttatatagcaagcccatataaacacacagtttacaaagacgtacacagtgtatcagtactattaacatttcatgggtgagggcaattggggaaaaacgtctctaaagactcctcaaaggggagatattgaaaacaagagagagcaactgtgtggtaaataaaccacgtgccctgagccccctggctcagtgtcggcttctggtgaaacacaaaccaagagagaatgccagcactcatccccacactctgttggccacagtccagtcctccgttgcttcacttaaccctttaaataacctggaaggcagggaaaattaggtccatatttcagatgagcaaactgtggccactagaagtcaaatgagttacagaaactagagagtaaatcagcagaagactcaaggtgagagcctgggtttcctggtggctgggcgggtgttccctgggctctcagccacaccttagaactatctagagtgcctagcccatggcacagagaaataacactacaaataaatgtaagtggctgttaataataaaaataaatcaggtctccatgaatggaacaaacaatggtgctaccccacagatgactttataaaccacacagtggatacaaacattagttgtcattaacatggaggttttgaatgccccaactcaaggctgagctcagtggagtccagagactattttataggactcttggtagagaactagatgggaggcaggggaaggacagaaaaagggggatcttagctctgggatttcagcagaaagagaagccttccttggcaagagtccatgtagggatgcctgatccctcagcccgacctgcgtttactcctcctactgttcatttataaacaaacacctcacctcacatggatcaataagaaaatgtggccctgagtggtaactcatcttgcccttgaaagaaaacattctgaacaaatatccctagcttttctgagataaagtgaaagaccccatcaagcaaaactatacttcggacaggattggacttagatcctaaggcagctgtgaagccagaggaaacaagactcttctgatggcacactgctgttggaggcacgtggggaggccagtgtggctgaatggatgcccgccttgcacgaagacttggtttgggtcctccccttagcagcaccaccttaggcaagtttcaaatggccctgggcctctgtttcctcttctcaaagttccgttccagctccaacagcctctgatttttctaagctgtcaagcgcctctctctctgtgctgggaccataaatcccacaaattgctgcaaagtaactgctgattagtgtgattagacttgctgattattaagtactgctggtttcatttttcagattggcattaccagggcttcggagaagcatccatagctgatacatgagacagctgatatggagtgagacgaagcagaagctgggattggagggacaggcagaaggagagagatgaatagtccaattgggctaagcgattttccattaggacacatggcctgggctagatgagtatattctcctagcccaggactttcaagtcttgttggataagatttcactccatctctccaagaagacaccatcaaggcagaaataaacttaaactgctgtaatgagtttacaaagaacctaaggggtcaaagacaaagaagttctatgcatattctgcctgcctgcctttgggtaggacaccagcttaggagaaccgggtttggtgatttgcaagcaggcacctgctgtagctgtttaagcaggttaccctgacattgaacagatggcagtgttgcccaagaggtgatattataaactgtgaaatgatgtaaaagcattagttattactaatatgctggttttaaagggctcaacccaactgttacactcttgcagagtgcagataattttacatgactcttaaaaaggagcgcatggagaggagaggaggttcccagccctgaggtctgaattcagtatagagagaagcccacctcggggggaagccagccagagcccacgtatgggataccccatgagccagctgcttaagttctcactcttacttagtcatacactacatgcaggaagcagtgttgctcttgagctgtaacccaatttgttccctagagaaaacgcttcaaacaactcttctatcacttctgtggcagaatgaaaagtcccatccaacaaggctacaatgtggatgggatttgatgtgcatcctgtgacatctgcaaaatcagagggggcctcaaaacttcacattgacttcaattttcttatctccaaacctatgactctcttcgtctttccaaagggtgatcaccttggggaagctaacatccctatagacacaggtgctgaggtatacggttaatagatgcccaataaaagtaagcactgaggatcaggtgatgcaacataaacagaaatgtggcaaatctgtgcatgggcagatgcttgaacccaatatagacaaggtcctaattgtggggcccacctgatccttctacagctttaggaaaatactgcctcaagatgctgccactcacgctctctcacacattgtgactgttacaccaattatatgcagcaggtattgcgatgcccattttgcagactgtatggtaagtgaagtgtccaaatcacatagttaatgctgctctactgaaagctcactcaacgtactctgacaaacccagagctatcttgggctacccaaaaccagaatgacagggcatggcatctaaaaagggtttttattcagtccacatttgaagatcttttccttgcttcccttgacactgtcccgcttgttaaaagatgaaacaaatcttgtttgcattctgtgaagacctccagacccaaaccaaagagaaaaaaggagcagggaccctgatcggtgggaaaaaccataggatcacaaccaagtttcatttgatttatgaaacttttaaacatttatgaaatgttaagaaatgaataaacttgaaagcgggagcttccaaataatgcaagaataatttagcattaaattgaagaaaatttgcattctgttctccaagcagaagaaggataccaggcatcacttggacaaacagtagtaccttcgtctcatccctggctgcttaaacctcccttgaagaagtctccattgatacaacacaggaaggtcagcgatgtttcctttccctgctctcctgaggttcctcatttgcattctattattgcatttgctagactctttaaatttagtcatttccagcctctctctccatacagaaagaactatgctcatctccctcaacagcctggcacaaggtttggcaacagggtctatacgcagaatccatgaatccaagaaaacccattcagctcagccaacagttctcagcctggcttcatgtcggaatcacctaagggcaatgcctgtcatctggactcacgtgtatgctttgtgtgtttgtgtgtgttgagtcttcttctttttaaactatttgcaactttttatttctaaaagttgtttttaagttaaaggaataatataacatacatatatattctctttacctggcttcaccaattgttaatatgtttgccacattttctttttctctttctcattttgggtgtgtgtattgtgtgtgtgcatacacacatgcacttatattgtctgtatatgtgccgaaccatttgaaagtaagttgtaaacatcatgacttgtcaccactaactattgcaccatgcatctcttcaaaatatagaacatccacttacataaccacaatgaaatgatcaggctcaataaattaaattttgatacaataatgttatctactatggaggccatgttcaacttttcttaattatccttatataatgtcccctgttatttatttttttcagctggaaccaatcaagagtcaagcactgaatttggctgttatgtctctttagcctccattaactgaaacagttcccctcatcttcttttgtttatttgtttgtttgtccatgacatgaagcctttggaagagaccattccagatatccagcaggatgccccacaatttgaatttgtctattatttctttatgattaggttcagatcattttaggcaccattgcaggtatgttgtacatttccactgaattacgtcagaaggatgggttagtttgtctcattatacacaagtttgataacttttgttcaggtggagtctgccagatttctctcttatggtacctttttgtttgggtgatttacatgcatgccaaggtttgagaggcccggctactcaaaatgtggtcagcagagtcacagcattggtttcccctgggaatctgtcagaaatgcagctagctatcaagttcctgacccaggagggaagagttctggtctcccttcatcactcttctattgagtacaccacgacatgaggatagaagcaccacacaagagtgaggattcaggtgtgaccccagctgtgccagttcagtagctttaagagcctgggcagatctcctaacttctcttattcatttgtaaacgcgagccactggtcaccctccaagtcaatacggatggcctgagatgattgccaaggggagtgtgcatggatttcatgagggttgcaagaaggcagcagattagatatgatcaagaagagaagcaaaagagagaaagtatttactaaatgctgataatgacatgtctaggtgttttatatccatcatctcaattaaatttcacaacaatgcagaataatgaaacgacctctatgccttaccatatacaaaaatcaactcaagatggattaaagactcaaaagtaagatctgaaactataaaaatccttgagagaatagaggaaacaccttaggaacctggtctaggcaaatattttatgcccgtgacctcaaaagcacagtcaacaaaacaaaaaataggcaaatgggactattttaaactaaaaagcttctatgtagcaaatgaaacaatcaacagagtgaagagacaaccccttaaatgggagaaaaaattgaaaactattcatcgacaagggactagtatctagaatatacaagaaactcagcagttaaaaaacaaataatcccattacaaagtgggcaaaggatatgaatagatatttcttaaaagaagacatatatatggtcaaaagatatataaaaagatgtttgatatcactaattatcaggaaaatggaaatcaaaaccacaatgagatatcatcttaccctagttagaatggtcattattaaaaaggcaaaaaataacagatgctgatggggattctgagaaaaggaattcttacatactgttggtgggaatgtaaattagtacagccactatggaaagcaatatggagatttctcaaaaaactaaaaatagaactatcataccatccagcaaccccactactgggtatttgtccaaaagaaaagaaatcaatgtatcgaagaaatacctgcactctcatgtatattgcagcagtattcccaataacaaagtaaggaatcaaccaaaggatctatcaatggatgcacagataaagaaaatatggtatatgtacacaatggaatactagtcagccatgagaaaatgaaatcatgtcatttgcagcaacttggatggaactggaagtcattatgttaaatgaaataacccacacacataaagacaaatatcatgtgttcttacccatatgtgggagctaaaaatgttgatctcatggagtagagaataaaatgatagataccagaggcttggaaggatgaatgtgcaggagtaggggtataaagagaggttagttaatgggtacaaacatacagtcagagggaataagttctaatgtttaatatcagagaagggtgaccatagttaacaacaatgtattgtataattcaaaacagctaagagagaggacttgaaatgttcccaacacatagaaatgataaatactccaggtgacagatgccccaaacaccttgacttcattgttacacagtctacgcatgcaatgaaatagtacatgtacctcataaatatgtacatacattatccatcaatttaaaaaattttacaacagccttgggatgtaggcagtattatcttaatattagaaataaagaaatggaaattcaggaaggttgagcaaattattccaggttacacagaagaaacagcagagttaaatgcaaccaatgtttgactccaaagatcatgctcttactgctgaataaagaatgacaacttatcaaaatccttgcttctcaaaatgagaaggaaattggccatactgaggaaggaaaggcaaagagagattagtgggatgaaaaaaggtgaggactgattgagaatggttaagaaaaccaacatcaagtggtagatgagaaagaataaaatacatgggagctgaaaaggagaatgagctaaatagagtcagggaaatggaagttgaaatcagcattgtctagagaaaaactgatgttacttcagtaatgaattacagtttataggcatggctaagatactgctggagggattcattctactctggctgggacgttgaccagatgaccaaattctgagatttctgctaatattaacaaggttgtcattagagtatatgttccattaggcagagattgttttgtttccttttgttttatttatttctatatccctaatatctagaagagttcctggtacagagaaggcattaaaaatatctattaactgattaacgttaacaacacaaatatctaacactgaatgcttcttccatgtaaagtgctcttagtttcacaagagcctataacttacttacaacacttctcagatgaagaaactgaagcccaaagatacagcaacttgcccaagaccataccagctataagaagcaagcaagtttggaggcccaaatttatcttacctccaaattgggaagactctgcattaccgacagcattaagtgggcattcagtgtctcctccaacctgaagacaatagatcttcttgtcaacatgctaagtccactaggcaggccctttatgttccagagcagctgctggctccatgtgtctcactacccagtcttgcctgccagatgtccctggagcaagcatacctcagaatgcagtcagtgggtatttcttgtgatcattttcccttggtttgtcaacaggagagtgattgatcacagctggctgtggcaagatggtcagggcagcaggatgcctatccagtgccaaatgagatgaatgccaagatgaagccagcatcttttcactaacaggcaaagaaaggggaatccctggacagcctcaggacagtcacagtgtcaggtatgtatgacttttaaggagatccctattcagaattaactaatgtatactgagtgcctagtgttgggctaactgcattcatatatactattctttgagactaaaaaccaccctgtgatagggtagtgtaatcatcctcaatttataggtcatccccaacttgactcctgcagtcacagagacacaaagcagtccagatgtgaactccaagtctagcatgtttttcataaaatcagaatctctttcagccataaggttaaaaaaactagagaagtgatcaccctcactcaagttaaagcatggtctccaatcttgttttctctcccatagtccatttttggacttctaagaactattcttataattaaagtcctgtaatgctggctttgactacttactgttactgggatagtagtaaagctattgcagcaaagtcttgattaaccagaacccttacagaattctcacatgcatccattcagcaaatgcttacttagtacctaccatgcactctgcagcctgctgtggagtggtaaggttacaggagaataagcagctcccactctcaagtagctctcagctcaacagggcagacaagcagagatcaatcaaatgcgaggtacaaaattctatgcctggggaagctgggccaaggtgaaggggagtcaccaagtgaaagcaggggatgggcatttgatatggtttgtctctgtgtccccatccaaaactcatctcaaattgtaatccccacatgtttccagagtggcctggtggtaggtgactgaatcatgggggtggatttcccccttgctcttgtcgtgatagaattctcataagatccagttgtttgataagtgtgtgactcttccccttcactcttgcgctctctcctggcaccacgtaagacattcctgcttccccttctgccacgattgtaggtttcctgagacttccccagccatgcagaactgtgagtcaactaaacctctttcctttataaattacccagtctcaggtatttctttatagcagtgtgaaaatggactaatacaggaaattggtgcctggagtttggggcactcccataaagatacttgcaagtatggaagagactttggaactgggtaatgggcagaggttgggacagtctagagggctcagaagaagatcagaaattgtgggaaggtttggaacttcccagtgacttactgaatggttttgaccaaaatgctgacagtgatatggacaatgaagtccaggctgaggtggtctcagatggagatgaggaacttattgggaactggggtaaaggacacttatggtatgctctgtcagagactggtagcattttgcacctgccctaaagatctgtggaactttgaacttcagaggatgatttagggtatctggtggaagaaatttctaagcagcaaagcattcaagagttaacctggcttattctgaaaacattcagttatgtgcgttcacaaagggatggtctgaaattggaactgatattggtaaggaaagcagagcataaggatttagaaaacttgtagcctgaccatgtggtagaaaagaaaaacccattttctgcggaggaattcaagccagctgcagaaatatgcataagtaatgaggagttgaatgttaatagccaagacaacagggaaaatgtctccagggcacatcagagaattttgtggcagcccctccaatcacaggcccagaggcctaggggggaaaaatggtttcctgggccaggcccagggccccactgctctgtgaagctgctggacttggtgccctgtgtcccagccgctccagttccagccatggctaaaagggagcaaggtacagctcagcccattgcttcagagtgtgcaagcactgagccttggtggcttctgtgtggtgttgggcctgtgggtgcacagaagacaagagttaggctttgggaacctccacctagatttcagaggaggtatggaaacacctggatgtccaggcaggagtctgctgcaggagtgaagctctcatagagaacctctgtgagggcagtgcaagaggaaatgtgaggttggaacccccacacagaatccccaatgggacactgcctagttggactgtgagaagagggccaccgtcctccagaccccagaatggtagatccacagacagcttgcactgtgtgcctggaaaagccacaggtactcaatgccagcccatggaagcagccacaggagttgaaccctgtagagtcacaagggtggagctgcccaaggccatggaagcccaagccttgcattagggtggcctggatgtgagacatggaatcaaaggacattattttggagcttttttaatgcatgccctgctgggttacagacttgcatggggcctgtggcccatttgttttggccaatttctcccgtttgcaatggaaacatttacccaatgcctatactcccattgtatcttggaagtaacaaactttttttttattttacaggttcattggcaggagcaacttgcttgtctcagatgagactttggacttagacttttgagttaatgctggaatgagttaagaccttagggtgctgttgggaaggcatgattggttttgaaatatgaaaaggacatgagatttgggaggaagcaggggcagaatgatatgttttcgctctgtgtccccacccaactctcgtctcaaattataatacccacatattgtgggagtcgcctggtgggaggtgactgaatcatgtgggcatattttccccttgctcttctcctgatagaagtttcaggagatctggttgtttgataagtgtgtggctcttcccctttgttctctttttcctgccaccatgtaagatgtgcctggcttcctcttcccctttgccttcttccatgattgtaagtttcctgagaccaccccttcccacctccgccagccacgcagaactgtgaaacaattaaacttctttcctttatatattacccagtctcaggtatttctttatagcactgtgaaaacagactaatacagcatttgaggcaaaagaaacaaggtaagggtttgattgatttccatatttcctgtattctacctttaggaaggagaaaaaaaataatctcatcatggacctggttcattttaatttaaaaaaaaaaaaaaagcatccactagattgtaggcctatggtaagcccaatttcctgggcccattgtgccattagccacagcccagaacaagataatggatgcttgaaaacataaatttcaatgcaaaatcctgaatcatcaaggaaaggttcaattatgttcacttgactggactgtctcctaagctgcagggagaatgtactatgcatgtactaagtaagtatgcttcaatattaggagctcaatgggaattcaacacaggttttcctgtgtagctcccaatttatcagaatccgcaatcccaccaccaccccagttcatcctcaattttcctaacactgtggcttcctgagttctgaccagcccccaacttgattctaaactctcatttctagcaatttgccatctgagagctagcaaggggaggccaaggaattactcatggccctgcattaacaatggggaaaggggcacccagtgacgctcagcaaaatacccagggtcccacaattgttggaagagcatcagaactggaatcttggctcagaaacagagtgaacccactgcattcaaatgcgagctccaggaaccttagctgtgtgatcgcggacaagtgattttctctcttgaggttttcatatctttatataacggagataataatttccatctaatagtactgtgtgaggattaaataaaattagtacatttgcatatttgcatatatatgcatttgcatatatagttcctagctaggtaactgactttcttctcacaaagtcttaaattttcctggatcctttttgggaaacaggctccaggttttggcattatcaaatctgcttccaggtgatgcaataattctagaaaaaaataaaattgaggctcagtcagtaacagctttagctattcccttccccagactggacaaggcagggctggaggtgctggctgggaaaggtgggaagagaagaaagagggagcccacatgcttccataggacccccaggtttttcagtcagtacgtactgaacgcgatgtgcatgtgaaaggacacgtgaatcattgtatgactgtgtgcactcaacgaacttcttgtgccttttttaactatcacatatttcagtattcacttcaatttaactaaacatattgctagagacagagagaggaatgtattttaatgcttttttttcggccacctaaaaagagcaaatgaaagagcaacaattgttaagccgtctctccaaccagaccccgaccaacacctgcaaatagacacacacacacacacatacacacgcacactcatacagacaccaacatccacgtttctgggaaaatgccccactcccaccccacccttcctgctggttccttagtttccgggaaggcaccctctccgggcttggtaacctccttgaagaaacctgttgctaagtctgaggtcctgtgtggacgcccccacctggtggccgaacctagaaaaacgtctctaaccaagaaaaactggcaggtagtgtaactaactccaaggctcctgagcccttccgaccacatcagtcatgggtgaattggaggagaatagagaggaaaatccactgctaaacgcgtgggggagagaggggggagggggggttgccaaggtcataggcaattccctgccaaaaccctggtacagtacagcttcctagaagcagccatcaggatgactaaaccagagccagaaggcagagcttgatggctggacgtgccctgccagctccgagatgggtgctgacagcacagatttccaatcttgaatgaggagcacccccaccatcctctcccccctcccaaatacgggtggattttccatccccagtggcaggtgcagagggagttccttcttccttctggccatgcatttacatcggactagcaaggagattctttctaggagaacagtgcctgggtgcaaacctccaggccaagcccctcacattcccggtgccctaggccagccaaagcaggagaagcagcagcgactgaggctgagggaatatcggatcccaaatcaaggagatgtttcagccaaaagagtccccggccccctcacctcctggctctgtgaagccccagcccctcagtctaggcttagacacacacgttcccattcacttccctaaaaggaatcctagaacatgcattttggccagtcccagctcccagtcagagcagcaccaggttcttctctgtaccagtacccagcgatcagaagggtggcacaagcaagcgacacacacacacacacacacacacacacgctccccactatgggtggtgcgcacccctcccatccccaactaaactcagtggcgatcccaacagaagggatccacccgaaacagaaacacagagctcacgggaggacccgctttatcctcttcaaccctcacattaattggaaaaacccacataattattttaagcttccaaaccaacacccctagaagatgtcataaatgtgcacccgcgcgcgcacacatccgcccaaatcagcaggggaaccacgcttcgttttttaagcccctagtgtggaacacccggagagcggcaacacacacacacacacacacacacacacacacacacacacacacccagggaaacgcgtgctgaggacgggctggtctccccttcagcgggaaagcatccatgggtcttaaagccccagagacttctcagctccagccccgaccccaagtccccaagcgcgccgccgccgagggcgccccgagcggccgggtactcacaccaacgcgtggtaaagcagcgcccagccccgcggtctctccagggcgtcgtagatcaaagtttggatgcgccggtacttggcgttgtttctcttgactgggcggctcagcggggtcttggccaggagcccgatgccctgcggggtcctccgctgcccctcgtcgcggccgccgccctccagcagcagggtcccgtctttgtcggctccggccccgagcgccaaggtgacttgctccacgtcgccgggcgccagccccactttccgctcctcgtcgccggccgccgccgcgtcccctccggctgggttagccgccccgccgcctccgccgcccccgtcgccgccgccgccagccgcccccgccgccctgcgcgccttgagccccatctgcctcgcccccgccggccgcttcgccttctccgctgctgctctgggaagaaggggcgctcggggtgcgtgaacgaggcggcggcggcggctgcaagcccgggaactccaatgccatgatccgcgcgcccctccccacccccccccaaaagcaggcaaaggcgggccccctggggggcaggggaggccaggcagggggtcagggggtcacatcccgcgcgggtcagccgcaggaccccgagggtcgcgggccgggggctgcggagaagctgggagggcgcgcgaggctggcgcggaggcgctagggcgcgcggcggcgggagcctggaaccggcgctccggggcggcggcggcggcggcggcacccaggccggcgagcccaagacagcatcgcagtttatttacaagcccggtgccagccgccctcccgcccgccagccacacgcgccgccgccgccgcctcctccctcctccgcgctcccacccgcgcccctccccgcccgttccagcctcagcctgtcagcagcagcagcagcgagcgcgccgcgggccgagagcacgccgcgtccctccctccctccttccccggggtggggccccattgtcccgccccgtcgcggcgggaggcccgggcggcggcgccccgcctcttcccgccgacccccaccgctgattgtctggggacccaggatcgcctgggctaccgccgcccccgttgcaaccaggcagtgcgccaggcggctgcagagcccggctcctggagctcccgtgggcgttggggcttcccctggatggggcgtgacggcgggcagttgggggaagaagaggaagggaggagggactggggggttgtcgcccaccaaacattggctctgtggttgcagctttgtgaatttccctcaccccctacccctgctcctcggcttcagaggtaaaagccaagttgtcgggttggtcaaggccgggcgcaccgcgaacgcacctgctctgtggtagcgaagctcgtgactccctcttccctcttccctcttccctcttccctctagttcgtggttcatggtggatgccgcggccctctcctcccccaatctttgaatagcaccttcacctgtctgggtgggcaaaggactgaagaaatgcagtcagaatctttgattcctgctttgctcccgacttgcacccaagccagtcattccctctctggtccaaatttcaattcaatcaaccaatctgtaacccctcgtgagcttccctggcaaagggtagtgatctctgtcctgaagatatgaggtctctgcactcctaagacctccgtcctagccggtggaagacaatgaaaagacaaattttaacagtagaatttccgatattggtaaatagtatgtggtaacaaattagagtgctgcgctatagtgactgggggagtcactctaaaccggctggtcgtggaaggccttattgtggaggtgatgcttcgaggtgagaccctaatgacaagctgggagcaactatgtaaatgtccagagagccctccaaacagcagaacagcgggtgcggaggggaagggtggcttgagcttaatgagagtaggccacaggcaaaggctagatcttgtaagacactgacaaaggacaggagcatcctgcacttcttccatgcccaccgccatcggggaagcctccattcctgctgccccatggcatctgtggcctcctttccttcccactctctcacctcatgtctgtcagctggggtgagagacatggggtgaggggagaccctgtgaacaaggccgaggatctatccctagtgtataagaaaagaggaatcagacctgcaagaacaccagctctggatttgcctggagaagttggccaaggagagcataggagacagggaagggaagaaggaagggaagggagtaggaatgtatgggctggggcaggggaagggtcagagaaccaccaccctatagaatgactatcaaaggggagaacctcaaaagaggtctccaaatcaagaagggaggagtttccagaggaagttaaactgtaagactgaaatcattaaaacagtgtgggatcggtacaaaaataaactctcagtgcaacagaattctttgtccagaaacagactctagcatgggaacttaatattaaacgggaagagttcatgacaagaaccccaggggaaaaggctgttcactggttgatgggttttgtgaggaattataggaaatagcatatggaaacgtggcagtgcccagtaggacccctgtacatccgtgaatagataaatgctcagcagtgagttggagtaagtaaccagtccagcaggctctggaaaggagaaaaagcccaaggaaagggaattgcttggatcagaatatctccaaatgggagctgggcactgcaaagcctcctcctgcccatgtgttagccctgccatgcccaacacaccaaactcacgtgtattcttcctgtcctactcccatcccaactaaccaggaaacaatcttgccctttatctctgagcaccttttccaaagtcgctgttctccctcagtctcttcctgttttgttcattcattacatttatcactgccaaaaatgatcgcatttacattctgtttacttgtttactgttatcttactaaacaagagcagggactaagcatcctagttttgaatcctggaagtgtgtctgtcatatcacaggctctcaatctgtgttggcagcatgaataaatgatgaataagcgaatgaagagtgtaaagctctcagcacaatgcctggcacacaagcattccatgtatgtttgtgggtgagatttttgtttggtttcgttttaccattgtgaaagtcttcatacttaggaagtcttgctgctcctttatgctccttgcaacttaagaaacatgataaaaacattttgacagtatttaaaataaaaaggctcactagataaacataaaaagaagacgagtcaaggaatgtggaaagaagatgtgagaatttattattgtgcaattaatcaaaagttcagattcccagaatgacagtttggatcctcagatacatgaaaagacttctattttgatgggagcttcagactgtcaagtattacaatttaagataaggtgcaggggctatttgcatgcctcccataaaagatgaggttaagtcaataacaaattcataactgagccaattaaacccaatgatagggaaactgccaggtagttgagtctagtaaatggagttgctttgatggttttataatccaatggcaagcagtgtttaggcttctaataggggctttggaaatgtcatcaaaagcagggtgtgcactgagtgtcattggaggaactgtgtaatcacagcgctccacagcacaggtttcagctaaagaaaatcaaacatcctatatcccactggaaggaaacttctcagaggcctaaagtccctaagagcctcaggttccagctgaacatggcaccaaagcaaagagttagcgacacactatcaacaaggacaacaatgaggcattcctctcctggctttgagccccagctcaaagtgtaacattgaaaacccacccacctgcttcccctcctccatgccttagctttcatttttgcttttctctttagctggtcttcatctcaatgtataggcgagatgttcaggtaaactctctctcccttgcaggtgaggcacttcctgggaatgagtaaaaagagagagacaaagggctttctctgagcctacatttctgcctctgtaaatccagggttgtaagcatctcatgatgaggtgatattccagtgatggttattatgactgtcattgaatgagtaggacagtctcaggttcacaggcatatgcaaatggtggtcctgcctgcccctctcactctgttccctaaacacattaaataattgctttaggccaattttaaatttacttttattatttgttacacaagaaatgcaaagtagttgttaggaaattatgaaatgtaaatcagccagaaggcaacagtaatcatcttgttacccagaaacaccctctgtgaatattctgatcatgactactgccaacaggactgaagcatgcctgacctgcaagcaatggagatgctcagcccccagtggggcaccttccctaggggaccagtcagccacttggtggcaagttgattacactggaccttccaaacatgggcgggggcggacatatgccattactggaatagacacgtatcctgggtacagaattgcctctccagtcctcaatgattctgccaacaacaccatccatgcatttaggaatgcctcattcaccgtcaaagaattccacatgaaactacttctgatgaaatcatttgtcccctaaatgcttactctggacctgggtataaatctacctctcagaggagccagtgagacagatctttgtagccaaaaagagcactctttgcttgtttggaggagacacgacaagctctaattctgggtctaggaacaacccgggccaaaaggaaatatgtttgggaacaatggatcccattactaccctatatgcgttttttattcttgaaaacccaatctcagcaaatcctcaaatttactgccccctcttctcttcctccaggtcttctttttgtctttccctttcctagacttcatatcactgtacactaggacagaggaactcttgttcccttacaggtgagaagccttcctgggaaggaacgagaagaagctaaggaacacccttgtacatgtcactcagcagaggagggcagaatagagttcagcatttagatcgtcctggctctgtgactttgcacttagtgacctgaaaaaagttgccagacttatttctagcctgcttcctcagctgttcaatgggacaatgtttcttatcctccctgccttagacttggtctgagtatcattcctcccaggatccacgttaaggtagggctttgcagcctgtgatgtactgtgcacattgactacattactgaaaggcatctgacacagcatcgtggaaggcactcaagtcaggcatgatggggaatgaatgagctccaagccaaacggcgctcaccttctctccagatgggaatgattaaggggcttaacttagattgttctcagttggaaaagtgtttcttttcctgcctcacatttgcaatttttacattaaccttcaaattaattttgcatgtttcttaatgtcacttttgtctttttcttttaaataattatgttgggtaaaatatccaatttatctacttaacgaattcattcattcatccttccagtgagcattcaccaattgcctgttttatgtgttgctctccatcaatgaaaaacagaagaaaaaaaattaattctatatttagttccaaagatgagctaataaaatgcaaaacaatttactcatctttctacggtcattgctgtcaatgacctggctcgtgatggatgcttattatcataataacatttatcgtgtgcttcctctacacttggcactgggctgactgctatatatagattatctcatttaatcctcacaacaaagttatgaaataggcattatggctattgcttttcatatcaaccatgatgaaaattatacttaggttaaatactgcacccaagtttacatgattaagaaatgacagccccaggattcaagctcaggtgatctaactttggaacctatacatttaaccactacaatgtattatttcctgagaacgctattccaggtggcaggttcagtgtaggcaaaggcttggaggcaagacagagagtggagtttccagggaaagtggttgtgatggttggaggcaagcgtggatggagcagaggccacatggggaaggctttcatatatataccaggcttatggacttgggggtcatgagttactttaagcgtaaactgacctaatcccaggtggttccacaaagggctttctgacaactctgtggaggagaggttggaagtgagaaaaatcaattcaatcagagcaagtacaaggcagagcccagctgagaggtgttgaggcagatcttggagaggaggggctggctgcaagaggtatttagaaaagaatattgccaagaattgctacctaaaaagacagggctgggtcatgggtcactttgcatcttagaggcagaaacaacctccccacaatgtcgcaggctcttgccatcctgactgtggtctccctgctaggctgagcatcctcttctggctccggtaattggctccctgggcagtctgttcctttctcttcaccaaatgacacttcttctctttgggtcctgattgttaaaacacccagtttgcccatgtcatttacatatcccaattatccattgccattttcccactaatgagcccatgtgcctgcgtttaagagcgtctgacccagagtccacttgctcaagggggctgaatgcagcaggcacagacgctattcatagtgccttcagacaaaaagggctggggccatttttcttacctccctctattagggctggactgactctctagacagcagacctttatgcctcattaccccaccccacagacaccacgatgctcagtgtaccttggttacaagaagaaaagcaccatgccaactggagaagcactctgtgttcttcctgcaatcataaagggcccattgtgccctgaggcacaggtgcagatcctattaaagccaaggccttcttaatctccatctcagaattctttgcagaggggaagttgatgtttgtgtgctaagccactggccaggagatgatgctgaatagggagagttcaggcttttgagaccgcctgccctgagtaggaatcctgtccctgaaaaatgctaagcgtttgaccctgcacaggtttaataaccagccttagtctcacctgaaaagtaggaataacaataatcaccttgaaaatatgtgtcaggattaagggagttcacatctgtcaaactttagcacgaagaggcattcatttcatattcattgatataatatgaatggtaccatattcattcttactatttcatccaaatgagaagagaactttcaggtatgaagcccaatgttgctctaggttctgtgacagtgacccacgttttgtatcacaacccagtccacttaatagaatacacatagaactaactgaaatgatattttctattctctatgttataaaatgctgactgcaagctataattttttgatagcacttccataacaaaatcccacagaccaggtggctgaaacaataggactttactttctcagggctctggaggctggaagtctgagatcaaggcgcaggtaggattggtttcccctgagtcctctgtccttggcttgcagatggccgacttcatcctgcttcctcacatggtgtttcctctgtgtgcatgccccctggtgtctccttgtgtgtccaaatgtcttcttatgaggacaccagtcagatgggattaattcctgccctaatgacctcattttaactctgttgcctctgtaaagcccctatctacaaatatggtcacattctgaggtcctgggtattagggcttcaatgtatgaattttggggggccacaaaatcagcccgtcacatgaacacattacagtgacttcacatttttactgagggtcatgaatctggcctataaaatgttaatccagttcaatcttcagccaagctatttggtttctgcctgaatatctccatcatttgggggctcattgcctcccaagaaatcccattgttgaataaccaatatactcaccaattgctgagtgtatgttctatggccagacccaggctaagcatcttctttacctcatttagttgtcacaactgcccattgaagttggtgttacacaaatatacattcaagaatatgtgtggccgggcacagtggctcacacctgtaatcccagcactttgggaggctgaggcaggtggattgcctgaactcaggagttcgagaccagcctgggcaacacagtgaaagcccgtctctactaaaatacaaaaaattagccaggcatggtggcatgtgcctgtaatcccagctgagagaggctgcctgtaatcccagcctcttgggaggctgaggcaggagaatcacttgaacccaggaggcggaagttgcagtgagccgagatcacaccattgcactccagtctgggcgacaaagcaagaccgtctccaaaaaaaaaaaaaaaaaaaaaaaaaaaaaaaaagtgtgtggattgctcagagtcagagaagaatatctgagcagagattcaaactcagatttttctccaaagcccaaaaaatgatgtctgcattattggaaagtccttcatgttgagatgaaagtttcccaaagtaatgtgaatatcaaaaagatgataaaattcagatgtttcataggaggcctgtgattccagaaaggtttggtgtttgaagacctaggattccattccagccttagcactttctaagtggccttgaggaagcgctgtcaattctcttctacttggtttccttctctggaaatggagaaggaacaagtaatatctacctcttgtgctcatggtgagtttcaaagctaactgtagagacccaaaggtctctatctcaatctgtctctatctcaatctctgtctctgtctcagtctactgaggttattgctgcatcccagctggttccttgggctatattctcattgctgcctaaccaattattaatctctctgaacttcattttctattatgatgattatccttgtattatatattatctgcacaataatgactttctcagaagattattgaaagatgagatagtttaatccatgtgtgacattgcattatttagaattgtcttgacttttcttttgatgctccaaattgatcaagaaaaaacaatgaaaaaataccttttcttcctcagaggaagaacagataagtctctttgatcttcagttaaggctcccttttaaacaggttttaatttttaaattttctgagaccaccccaaacaggctttatgaatgcaagtcccagccacagtttacaaacctcccgtctgcagggaccaggcaggaaacttaagtcaccacacttatgtaaagggctatgtgcagaatctaccacaagagggagtaattcataaatggtaacggcacgtataattgccatcatgaggaaaaaggaagaggaagaacaaaaacaattaagagaaagaggaagatgctcttaggccctaattctggagcatcagtgctccctcagactgttccccttcatctacacccctgttctaggccaggatccctgtgctatgattttggacttctcatcctggtctcaaactttacgggcgatacttcaagtggttttcaacctaaactggaaatcctcattccataaagtgtttttgctacaaataatttgtggcaaaaataaaaataaaacaataaattaaaacaatccattaaaatatcactatcatttattttctgcatgtgcaaactacagctgtcatctttttcctcaagttctttgagtaaataaatgctcaggataaatattctgtcattttctattctcccaaaacatagtttcgaaaacccaaagggctagatgtgccctatttaagaaacatgtatcaccaccaacttttagtagccagcactcattaaacacaccaggtaagagtcaaatatctccatgaaaaccttcatgctattggtagattatgtcagaaaaccaagcatcaacatgagttcatttccaaatataacttttggatggccagccatactttctttcacttttagaaaaggggtaacaggacccaacaggatatctgtatgtaaaggttgttcctttgtgtttacacagtgcctccgtgcccagatgtgggatttttttttcttttttgttcgtatgtttgtttttgcatctcttagcacaacctgatgtggtctgaaaatcaggagaatgattactcttcagcaaatatgcactctcctgcatccatgggaggattacgcttcccgctgacgtggctggttcccataacttgctcttgctggtggaatacggacagaagcaaacatgtgccacctccaagcacaggcattcagaggcatcacctgctcatgctgcttc

SEQ ID NO: 354 - DNA, 23660 bp, Homo sapiens
ttctaatttatataccttttatttctttcttgccttattgcaccggctagaacttctagcactatattaaactcaataagagtgatgagtgtgaaaatccttgccttctctttaatcttaatggagaggcatctggtttttcaccattaagtgtaataatagctgtatgtatttttatagatggtctttatggagttaaaaaagttttcctctattcctagttttctgagagtttttatcataaatgggtattatattttgttaagtactttttcctgcacctattgatataattctgtaattttttcttctttagccttaaaatatgatggattacattgatttattttctattattgaaccatccctagaataaacaccacttcgttttaatgtataattcttttttacatattgttgcattcaattttgctaagaactttgtgtctatattaatcaaagatattggtctgtagttttctttgtttataacatctctttctggttttggtgtcagagtaatattagcttcataaaatgaattggtgggtgttctcctctattttctgaaaaagattttatagaattagcgttatttcttctttaaacatttggtaaaattccccagtgaaacaatcagggcctggagtttttttttcttgggaatttttaaattataaatttaatttcctgagttgttacagggcaacttcaattatttatttcatattgcatgagttgtggcactttgtgtttggaggagttgtttcatttcatctaaactgtcaaaaacatgtgcatagaggttttgcagtattcccttacttttttatgtttgtacagtctatagtgatatttaatttctggtattggtaatttgtgtcttttctcttatttttctttgtcagtcttgctagaggtttgtaattttattgatcttttcaaagaaccagccctttgtttcattggcttgctctattgtttttcggtttctaatttcatggatttctgttcttatctttattatttccttccttctgcttgctttggatttattttgctatttttttcctaggttattgaggtgagagctttgattattattattattatttgtagcgacaggttctcactatgttgcctaggctagtctcaaactcctggcctcaggcaatcctctcacattatattttagtgggattacactataaatctcattgcagtccacttaggggtaataatctaagttgtttcaggtaaaatatggtaaacttgcagcaatataactccaataaattcccccaccccaccccaccttctgagctattgccatgtatatataatcaatatataagtccaatacataagtgttatactttttctaaatagttctatgtattttaaataaataagaagagaaaatagagagattttacatttgtccacatatttgccatttctggtgctttttatttttttctgtggatctgagttaccatctggtaccatttttccttagcccaaagaacctaattttttgtaatgcaggtctgttagcaataaatttcttgtttttgttccttcctgccccattcaagatgtgtttatcttgttttcatgttgagtccaggcaacaaaactgcttgatatagaattattgtttgacatattttttcctttttaagcactttgaatatgtcattccagtatcatctgtcctccattgtttttgatgagacattgccttttaagtcatatccttgttctctgtacatgtgtctattattttccatgttttatctttggctctcagcaatttgattatgatatgagagactatgcataagaaaatttaaggacccaagtttggcaataacatacattagtttcactaccatccaactggttagactcaatcacatggccacccttaactataagggaagctggaaaatacaatccagctgatttcccaggaagaaaatgggtgttagaaacagctggcaagtctctgccacaacatacatacaccaaaaccaccatatatattgccaaagacacatatgtgtctagggacatacaacgaatgcactgtgggggaacacaagaggaactgaagtgcaaatcaggaatgaagggaacaaataaaagaacaggaggggggcctttcatggactgatcctaacatagtgtcatgaacttaggaggaggattaactcaattctcattaattgagaattctcattaatctatgtaccaagagcaagagaaaagcccaatagcagtggtgccagcagtgccatccttaccagactgattctaacatattaccttagtttttgcagtggttcatcctctgttgattcctatctgtttcatgcctcacctccagacttcacagttctgtgaattacttattgctatccttccaataatttttctttcttttttttttttgagactgagtcttgctccatcgcccaggctggagtacagtgctgcgatctcggctcactgcaatgtccacctcctggggtcaagcaattctcttaccttagcctcctgattacaggtgtgcgccatcagagctcagctaatttttgtatttttagtagagatggggtttcaccgtgttggtcagctggtcttgaactcctgaccttgtgatccgcccaccttggcctcccacagtgctgggattacaggcaggcatgagccaccatgcccggccaatttttcttcttaaccacagtttattgtagtcaaacttatactattacagagtagatttattttacctgttgaatgtccagtccgaggttgaactttatccattacagtaggcatccttattttgttcttggcttcaatgggaatgctgcaggttttcaaagctggaaagctgttgcagaaagcccaatatgtacataaacttgctttccagcagcaacaaccaaaacagcagaaagacagcctttacctcccaaatctcaaatgaagaaatctaattggtggaactgatcttgtactcagaaccctagcttcaagggttttaatttctccaggtagcaaagaatttgaggcaaccaggtgaatggataaatttactatggtggatgcatactatggaatactcctgcagctgatggaagcaacaaactagattaacagctacatggaatacactggttatttacctattttttttcagctgctagcctttccatctctccccctgcaactcccccaattctctcctctacccacccccacccccacattctggctgtgttgctgtagctggggttctacaaacatttcccagaccccattgccaaatttcctgttagggtctgccaatgggataccctaaaggaacccttaaagataggagagacttcattcctgttttccagttgtcacatgatctcagctgcagacatctggcttctactagctagttctgcactcaacatcagctttgccacacttctcagagatatttgcagcagtctgactacccacttggcagtctgagatcagtcatcccttgctttcccaccctcagggccatgcctttcctcagaggtataagcaccaagatacctggagggagcttctcccataaaagtcagtatcagtcaaagaaggccccttctctgagctcctagtttctggtaatcacatcacctcttcccttttgttttcacaggccttggaatattctgatttctgcagttactaattttttagttacaacagcaacttctttctactctttcagtcttctaatacttgtaattaagtctctgtattaaaagtcctcttcttgaaatacttagtgtggtttctgttttcctgactgggtcctgactgataacatgaatgaatattaaaaacacagttgagtgattttaaaaagaagacaagatttgtaggcaatactccacagaaataaagcacacacaaaaaaggaaaccacatataataagaatatctgcataaaagagaaagttaaattagagtttttcagttatctaagatctttggataacataccgaaactgaggacaagaggtgataggaaccaacacattccaaataaaggtactagatatatccacatgaagtttattctaagatagtaaagctgatccacagaccactacactttctattatatgtgagattagaaataaaagattcattgatgggaatctttaggaatagggataacttctccctgcaagacaaaggagtagtgcactcccttcattctaaactgagtgaggagggctccaatagaaccatttgtagatatttagtgttcccatgtgagggagaggcattacattcattcagcattatattctctagatagagacttggtaagctcagaaatgtacagacccatctccatctggccaccagggtggaatgtggcatggaggattcttgggagaacataacctgaaccacttatgaggatttggagccatgtgaattatagagactggcacttctcagatgtataagtaagagtcaggctggctgcgacaaggcagggtgagaaaagcaagctgctggctgggctgcacttccagtttggcaggacaaatatgcatgcatttcctgtgggttccatgaaaggtaaccagtcttgagggtttgttgggaccattcccaggagagctgcgtacaagggtgaagcactttagcacgaggaggctgtgggtacattgtcagggtcaggggctgaagagctgaagggcagtgtgggctgtgcatcaaaaagaggcaaccaaagtcagttagtgccccagtcctcatggagagctccagagaaccccaagagctcacaaaggagtcaacagttaaatgcctgtctgcacagaacacaccaatggtaccttaatcacgtaagctgagactttcttcgtttaatatgccctcccccattccaatcctagaagagacaggaagtaaagaatgagtgaaataatgaccatgttctcccaaaccactgaggtagaggaacagcagctttaaactggataagttgctgacaggttcctgagatgtgggaaagggtggggatgaaaagcatcatacatacatatgtatatataatattatatattatacatatatataattgttttatttatttattgagacaggatctcagttatccaggccggagtacagtggcacaatcatagctcactacagcctgaaattcctgggctcaagcaatcctcccacctcagccttcctagtagctgggatcacagataagagccactgcacttggcccaaaaacatatttaaaatgttaatactttagattggtttcagtcatgttatagggaataatggaacgtatttataccagagtattaacaatgtagaaggacccttgaaacgaagccaaaaagataggggctgtggcaattaaggagacttccaagaagtctaatactaagtagggcatccctgcttaatcaataacacttcatttcgtgaccatgagacaagaaaactacagagacctcatccctaacatccttcagctccagaaccaatgccaaatcacctaactccaggttatatgacaaaaaaaaacatctgtttaggacattctttagtgggatttgtttttccggtcacagtcacaatgacggatttaaaaaaaaaagagtatctcaacttcctattgggagtacatgttttcccctgattttaaactcatgggacaaaaagaaagtgttgactggcatctggcaagataattaaatatctgaaacaccctgaaggaaacaaagagggtactgtggtcaagagtaaggtggacaggataccatagaagatatatccagtgtatataatgataactgctaaaacaccctcaaaactcactagcagaatgtaatcaagtttattttcttgttcaaagtccaatatggatgtttttggtcaagtagctattatgccctaaatagtaactcaggtattcagacttcttctatgctatgactccatcaccgtcaaaacatgtgcttcaaggttaccttgaagaggaaggaggaagagaataatggaaatggctcagccaccctttaactgccttggtctagtattgaaacatcacttccactcattttccactgttgagaactactcacataggcctagatgcatggagctgggaaatgcagtttacctgtgtccagaaagaggacatttgggtgagcatctggccagtttcttccacagaagcaaaggtaatagtggtatgaattcaggaagatgaaaatgagctcactggggaaagagtattcaaggaagatggagcatgtgcaaagactctcagtagaaacagtttggaaagcttgaggaataaaaagcaagtctgtgtggctggagttttgtgaaaggggaggagtgggttaagatgcagatggtgatggtgacggaggcctgggcaagatcacacggggcctgaaaagtttgtcttttgttctcgaggcagtgagaatccattgaaggattttaagcagagaagtgacataagctgatttacattttaaaaagatcacatggctgtgtggaaaattaattgctttagggacacgagtagaagcaattagaccaccagtaaggcagttactgcaggagttgggtatcctaaaaccagatggctggtcagagaattcacctgggaaggaggatgaccaggggatgaaaggttctaattactggtctctgtgaaaagctgtagagagttttgtgcagttacataaatggttgggtttggagctgagcggtgtctctgccaagatcatgttgtttcttttagaactgtgttcccttaggactggactatattatgggaacagaagctggagcacaccaataactgcagaagcagtaactatttatttggagaactctcaaagggatgctgaacaagcatgaggcacggataaccaaacccaattttattcttgtctcttaccaccctccaaattttattcactgggaggtactctccctgctatggagaaaagctgcagcgaggttgtgatgttcttaatagatagtcctgtgatcagtttaaggaacaaacataatctcaattaattagaatgtctaatcctgtgtaacaataatctgcacctgttgcagttttaaatccctttttcctctcccagctctgccccagctaagtctaggagcctgcactgggaaagggaggagtgattggtatgctcttccctctgctcggctcctctctacctaatcactgctgattgctctgggcccaagtgatgaggagaggtaaacagataaatcattttgccctgactgggtatttctatgcactgtgggcctggaagatatttcctctcccctattctcactctcaaatgataaactggcttcctgctcccctgaaaaaaaatcaaagcaatcagaaatgaacttctggggccctatcaggaactctggaagagggctttcataatggagcaacctcttaccactgccatttacctcaaacaggccctccacattactcagcaatccttaccccactgcattctgagttctctctcatctcaatagcactcgacagctaacaacctgcccatcctcccataaaaaaaaaaaaaaaaaaaacactggctgggcacagtggctcatgcctgtaatcccagcactttgggaggccgaggcaggccgatcactcgaggtcaggagttcgagaccagcctggccaacatggtgaaaccccgtcactactaaaaatacaaaaattagctgggcgtggtggcatgtgcctgtattcccagctactcgggagtctgaggcaggagaagtgcttgaaccagcaggcagaggtttcagtgacctgagatcacgccaccgcattccagcctgggccacagagcaagactctgtcttaaaaaaaaaaaaaaaaaaaaattaactctcctggttttactcctacatctctgggtgaaccttctcctcttccatcaccttcactgcttcattttcctttacccatccatgacatgctcctcagttctattctgagccattttctcttctcattatcttaccctgaatatctcatctattctgactttaattaccacctctaggctgctgattcccagacccccagcacagatttcacgcatgtcccacttcctaaaatccaacactttgaatggcatcaccagcctacccacagttgagcaacctggaacttacttcagattcctctcttaccaacctcaacatcccaccaattctacctaatgaagttctcctgtctgcctacttcttccatcatgactagtcaacagtgccctcatcttgtgccctagtacctgggtttctataacacccctgttctcatctatcccactcaactggaccctgtcattccttatctctccctaggtgaataagtacactggctatatctcaaatgacaagctccgggaatacaaagataaacatggcttgagaaaacagcagccaaatgcacaaaggaatcacaatgcaatatttagaagctgaagtagcactcttcacatagtactttgagagtacagatgaagaactgattttgctttgggagtagaataggaaacaactaggctgttcggaaagatgagcaaactgccagtccgatgaatatccagcagaaagaacagtacgtgtagaggcactgtgtagtgcctgcctaatgattcacagcccagcctccaaacatgccctctggactacagcctgtttcaaaacctccatccccttattagaggcatccaactggctcagggcatagaacctatgatctcccaatgggtactgtcaggtattcctggaaacaagtacaagaggccatatctttatacctgggcacatggcagataccttttgggggaggcctagaatctatcattcaaactcaccttccctcagcaccttgcctatagctttcccaggacatgctgatctgagtccactgcaaggcagagatagtggacagactcttccgccaatgaacagcccaatgcccccaagcccacatggcatcaacaagttgtttatgaacagagacccagctccctcactacccctccaaggacagaagctcagaatctattaaaagtcattaaatagcctatgaagcaggcctgttgaaaggtctagcctctcccagaggcttccttagtcaacaaatccattctttacccctcagcctccaaccagcctagggaagatcttcaaaaaacaataaggcttacaacacataatagtcatagctagtttactgagcacctcctatgttcccagccctggctacagatttctccagttaacccacacaaccaccctgcaagacaaaaattctaccattttccaaatgaggaatgtgatatacagagattaaatgactttaagtgcctctgggtagcaggccaagaattaaatccaggtctacctgattccaaaatctgtgctctcagctatatacatcccaaagtcccacaggacaataggtgttgggagtggcttgatgctatatggttccaaaaatggagatgaggggagaggggaaagataaaccactagaaatgctcggtatggggacaaccaaacagtctcaagttggtggctcagactgatgtcttgagccaagatgttggtggacaaccagttgcctcagagtcaaacagcaacagctgcctgtctgcaaccttgaaggcctgggcaaactgaagctgaaggagcagaagctatgggtgagcagaggaagctgatctgtagacagatcagatgacagcagagtggagatggcaggacaggaaggccatgtggcttcttagttggaaagaagagcaaaacctaaagatgccttgaattccaaaccatctagttttcataacacctgaagtgtcatgagacagatatccccatgttctcacaataaactctttattgtttagctagccccagtgactttatgcatcttataaccaagaagccttcagtagagcaagtctgagccagaggttttatcacactttgtcctcagggtccaccaggaaccaggtcttggctcacagccaggctggaaacagtcttcacagttctgagcctggagtttgagatctgcctcccctttcaaggaagatccagaggtcacctgcgcttgtagagacatggctgaagctgcaggcctgaaagctgagccttgggccctaccagagggggcccagtcttttggaaatcaaacaagaagaaatggctgttggtcaggtcctaggggcagaaaagacccagtgagaaccaaatcctcatcccaactccttaaaacacctccctctatgtactgcctctgctcacaaagcttcccagggctcccacttccgttggggagcaaaatgtctgttcctgtgcctaaagcctccttcctgaacaccagtaccctgaatagggccacatgagacaaaaacaggtacagatgtcttggggccctcaccttggagacaatcttgaagcctagcttggtcacagcccgcagaaaggttcgaacatcctcaaagcggctgctgacctcagccactttcaggagacccctgagaaagacagaaagttctgtgtaagtgcacagactcatgcatgcacacatacatacatgcatctgtgtcctgggggctcttaccctggcttcagtactctatttgcctcctctaggaagtccctgatgttggttcccatcagtgaaaggcaaaacacagccacatccacagactcatcctccagaggaacctgtggagagtgagagtgttgtataaggcacacagtgcagaagaagaaagccagcactgagataccaggatgggaaaggggaaggaagggttagagattagcatacggaggttggccctagagcacaagccagataacataggggtttacctgggccatgtcacacacagtgaccctagggtccagagaagccaagtcaaagcaatgcacagggttccggatacttgaagccaagcggcaatccccacagccgaagtcagccaccactagggatgcaggcctgagagtggaaggcaagggtcacatattggtctgatctgagcctatgactgacccaccacatggcttctcacagtccctgacccccattcaccgctggcgaagatccctggcgatgcggtccactggctgcagtggccacttcttcacttggctctggaagccgcggtggtagagaagaaaagcctcagggtcttcctggaagagacgctgtgcagcactgctgggccctgagtacaactgttcattgaggtagcgaaatcgggccccatccagccgctgtgccatgcgggctcgcaaagcccctgcccgagcctcatggctgtctgtcctgggaacaggagacacctctgtcttctctgtgggggcctcagctggggcctggtctggcacctgaggtggctgaaacttgttcttacatcttctcttgttcttttgccggttccgccactgcttgcggcttaatgtatgagggggtttaggggaagtggacccagggctttgctttggtggatcatttgtagtactacccttccaggctttgggacctacagggagggagatgggaaggtgcacatgaggcaagatctcttacattcggagtcacggcaagtcatcccagccatacctctgtctttgagatcgtgactgtggcctgcagagaagtacttcttattgcctgagtacaccattagccccaatcctaatggcagtggataatcactcttgtatgtagaaccagctgaccccccgacacacacacaccaacacacacacatatacacatccaatggtacctgtttggtcaacattgtccaggtgctgggctgaatttataggggcatgtttctggcatttcctctttcttttctcatcttcagcagagtcactgccaacaagagcctgtttgtggcatttcttcttcctttctacttcttcctcagagtcactgcaaggtgggccctgtttttgacatttcttcttccctttcttccctacttcagcagaggcactggcaaatgatgcctttttggggcatttcttcttcctttcctcctcctcctcctcagagtcacttatacataggctggggggatgctgggaaagagatgctgcctctagggcccgtaatgtggccaagagctggcggcgcttggagccctggaggaaaacaggggatgacagtgggcctaaagagaatggatgaggcctggagaacaagaagggagagatgtggacctgattcagactggcagaagcatctgaattcttcccagtcaagcctgccagaacccagaagaacttttatgtcaccaccccaacttctgggaagctggagagcagagaaaccacctatcccactttcttcaatgtgtaaatgagctaatggaggtttccccaaaggaaaatgcaaaggccacaagcaacaagaccaaggccagagaccaggaattccaacccttcaccttgagcttttgcctagagctgatacatttctgtaagaggtaaggaggcttctgaacacaggagacacatgatcacacacgtatattaaatatttaacatgtctctagctgcagtgtagaaaacaaactgaaggggagaaattgcagacagagaggccagcggcttggacaatggtaatggggctaggggatgaaaaaggaggaaacaaagcaggccgattccatgttggaggcagactgaagggtaagaaaagcctgaggaagcagggccctcacatctgcagaggctcaaaggagaagatgtattgtcgggaaggctgattctgtgttgcagtcctaccaggtaatcctaggccaggcacttaccctgattctaagtttcccacaccctcctttgaacaatgatactgacaactcttactgtctccaatccatcctccacactgtaaccgacgaccctttcaaaatacaaatctgaagaaataattccattgcttaaaacctttcattggcttctattctcaatatacgcaaaacttctacctcttgaacttgaacagcatatatgcccctttcatttactatgtatttcaaccacaaggaccacttgtgtttgtgactctgacagaacatgctctcttgtcccagggcccttgtacgtactttttcctgtctgaagaaccctcttcgcttcaccaacttctactcaacaactctctctgacccaacgtcagtttcttttggaagttctcggatcttcagatcaggactcgcccttaacggtgccacaggtgtccctccccgcaatacacacagcgctgggatccaccaatgtccgcttcgcggcctgaaacagctcccattgctcccgcgagtcactcaccttgttttgcgaggaggccgcaggcggaggtcgtgagattacgggcccaaggcccgcggctactggggccgcctcggcccactcaggctcttcgaacatgagggtcgggagggcagggtcgccgagtccccgctcttctccacgtgcacagcgctcctctggaagtcggagcgctcagacctgccagaaccgacccggaaaccaaagcgtgacagccaggggttgctagagcggccggcgcggcgcagcgaaccatcgagtttagccaggcgcggctagaagggcagggaggcggtgggaggggagggacggaggcccgcgctgcccaagagcgccacgggcggggcggggccggcggcgggctgcgggcgcggccggacgggagttccccggagaaggatcctgcagcccgagtcccggtgagtgcgagaggacccgcgccccctgtcacccctcacttctcctgagtcccaagtaaggaacggagccaaccctggggaggacccccggtcccctctcccagagtatacggagcctgaacctccccacttcccccaactctgttcgcggatagggtctagttgcctgctctcggacatccgttcagcagacactacctcttcgtcaccccctgcccaccctgacccgcctttacctcgcgtctagaggacacagccagggatcatcccgcagccccgaactccttcacagacccccactagccggggacgcagctcaggccccctacccccaacacaaacacttctctcctgtagaggataaagcttggggttcatcctccttccctggatcactccacagtcctcaggcttccccaatccaggggactcggcgccgggacgctgctatggacgacattttcactcagtgccgggagggcaacgcagtcgccgttcgcctgtggctggacaacacggagaacgacctcaaccaggggtgagctgaaacggttggtggatgagaggaaggctagagatctcctggctacgtggagtggagtgctcatgtctggtggtggcggctgcctttgctagccagtgtaatgagtgctaagcatagcctgtggggggcagagggttttcacagaggacgcagtttgagctgaatcttgactgcagaataagagtttcacaggcagaggctacagagagctttccagcctcagtagactgcatggccaaaggctagggggcaaggcacagagcagagagaacaggaaattgtctggagttccatatggctggaggatagatgatctctgtgggtcggagcattgggtacaagaggaaaagaacaggacataagactgtagaggtctccaaggatcagccagatcatgcaagcatatttaggctataagaaggtctttattttaaaagcaaggttttaaagctgtatagtgacataatgagattgtccatttttcagtatcgtcttggatgctttgtgaagagcaggtggaaaggaggcaattgcctagttcatcgtagaagtaatgatgtcttggactagaattagggtgagtgaaaaagagaagtgatcaaattccagaagtctttaggacgaagaattgtggaacttggtgtggggagtgagtaagggcaaagatgaggaccagggttctggcttgggaacttggttgtttttactgagatggagaaaactggaggatgaggcattttattttggacatgttaaagttaaggtgacaatacagcaaggtggaaatgttgagtgtgttgttggttatgcagatttgcaattcaggggaggaatctgacttggagacacagatttgagagctatcagcatatagatagcatatatatatcatatatatagatgatacttgaagacgtggttgtgaaggagaacgtctcaggagagtggaaggcaagaggtcaggggacaggaagcctgcacgacagaaaaggagcaaccgcaagttgaaaaagaaataggaaaatgtgtgagtaaagcttacagaagagaatgttttaatgaaggggaggtagtcaacggcagtacaggctactgagagatcaaagaacattaatattttaaagtagccattgaatttacagttgggttttttttttttaagttaaggggtacatgtgcaggtttgttggatgggtaaactcaggtcatggaggtttgttgtgcagatcatttcatcacccaggtattaagccgtggcacccattagttatttttcctgatccctccctcttcctacccgccccactctggtaggccccagtgtctgttgctcccctcagtgtgcagttaggatgtatttgaccatctgtgagtgttgtttcagaataatgggtgaagaaatcagactacattgggttccttaatttaaggcactatgatgaacaccttctgtgctgggtgctagagtccagaatctgacataatctctgctctcgatacagcagatttgtggcagattgaaaagtaggccgggcgcggtggctcacgcctgtaatcccagcactttgggaggccgaggctggtggatcacgaggtcaggagttcgagaccagcctgaccaacatggtgaaaccctgtctctactaaaaatacaaaaattagccaggcgtggtggcgtgcgcctgtaatcccagctactcggaggctgaggcaggagaactgcttgaacccgggaagcagaggctgcagtgagccaagatcatgccactgccctccagcctgggccacagagcaagactctgtcttaaaaaagaaaaagaaaacaaaagttgagaggtgagcaaatagtgaaagtgaatgtacaccagttctacaaggttggctgagataggaaggcaagaagagcagtagtgatggtgactcagagtggcaaaatcaaattctttattttttaaaattggtggagtttagtttttaggtttgacaggtcaggatcacctgtcatcttagtctagacttcactggttcccattaggttctacactatttctctttaatactttgcaaagtcatttgttccatttttcatataattctcaaagggtaccctgataaagacagtaagcactgttactgttttgttggtgaggaaatagaggcttaggcagttgcccagtgggcctagcatctaggaagactctagctgagtctaggaagactctaggaagatgctgccagaaggaaaaggggtggaattaatgaaactggaaggttgtggtgctggtttgaggagtaaagtatgggggccaaagttggctatatgctggatatgaagagggggttaattccttgcaggtcttcttgagatagaagtccaggccctgaggtggcaggcagcctgatagtgaacagaacccttgtgcccatacttttgccccccgagtttggcctgccctggcgccacaggcagtactggaagctgataagtcagggcacaaattaaaggtctaggaggcaagaccaactgataaacagggggcgtaatgcttcctggggataatcccatctcaaggaaaagcttttggctatttctgtgttagcagatgcgagcaagttgtggaggaaaatgattaacttaaaggccacaccccccaaccccttcagctgtacgggcatctggatggccagacccctgatcagctccaggccttgcctagagtcgcacacaggaagtgaccacaacactaaggcatccggaggctgctggcccagaccacggaccgccccctgctccgccccttgaatctgcagccccgaactggagggaatttccttttatggccccaggctgtcaggcaggcccagctccaaaccaattgttttgttttgtttgtatactttactttataaaatacatatttcttggaaaagaaaaaaatcaggtatagttttaatcccaaaacagccattctcattttcttctgttttctatgcacaggattgctaagtaggggaatcctgctttgcatggtggtttgttatctacctcatcagtagtcaaaagcatttctccttttcaacataaacccttccaaaacatcatttaaattccattccatttttagatgttagtttcagtaccagagccaaatagtaagtttgttccctcttctataagttgtggcctgccttctccaagacacccttctcccccactaacatgcactgaacagctgctgtcaatccattccctcaagaaacttaaaggtctaacagacaagacagtccattaacagatttttacaatccagtgcaacaagtgctgaagtagggggacatataagatgtggtggaaaacagaaaggaccaatagatgttgcagaaggggtgcaagagaaaccaggggaagagcactaccacctaaggaaatgagatgtgggatatggtgaagataacacatttttttatagaggttgttgagatatctaggtggttggtttggtttgaagctcaggggaaggtctgaaatggacagctttgggagttgctggcatgaatgagaatcaaagtcctagagaggtaagccttcccagagagtatgtaattatcagtttttcaggaatcaaaacctttgccccatcccacctccagctcaatgaccattgccccttcctcaaagggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaaggtacgtacaaactccttcgtcatccacatcacatacatgccatgagggtcagtcacaggcactgtaacatacagtagaaagcatgtgtgctcttcccccttttcccatgccctgacaccagtatctcatttggaactgactgtactttctgcctcttctttttgtctggccatggggtccagctattgcagtacaaggcagacatcaatgcagtgaatgaacacgggaatgtgcccctgcactatgcctgtttttggggccaagatcaagtggcagaggtgagtactcagcccttaattcctgagatgggtaggaagtaaagtctgagccttggtgggagattttggaaccctcaacccattctgtcagtactactgtgtgacacttacaggattaagttctacatttgtgcattcatggttggttcagtgactgccagcgaggtagcagtggctctcatcataatggccttttcattccaggacctggtggcaaatggggcccttgtcagcatctgtaacaagtatggagagatgcctgtggacaaagccaaggcacccctgagagagcttctccgaggtccatctcccccatcccctagcttgtgtcctctcgtcccttcccacctgtcttctccctctgtaccacagcttaggttgtttttcttccctagagcgggcagagaagatgggccagaatctcaaccgtattccatacaaggacacattctggaaggggaccacccgcactcggccccgtgagtcaccactgtgggaagaagggttgtaaaaggaaataatcctggcctcttggggctgggttagggtgaagctgggtacctgacctgcccacactcttaggaaatggaaccctgaacaaacactctggcattgacttcaaacagcttaacttcctgacgaagctcaacgagaatcactctggagaggtgacccctgcccttcttgcccttccctcactaaacccccataaattacttgctttgtacctgttttaagtttttcctccagttagtgggcaaggaagtggcagcaacatttcaagcctcctaacccctacctgtcctgcagctatggaagggccgctggcagggcaatgacattgtcgtgaaggtgctgaaggttcgagactggagtacaaggaagagcagggacttcaatgaagagtgtccccggctcaggtagtgcaaggcgtaacctggaagctgctagttccaaggaaccctgaatagcactgaaagagatcttttgtactgggtctcaaccactccctccctcttctaggattttctcgcatccaaatgtgctcccagtgctaggtgcctgccagtctccacctgctcctcatcctactctcatcacacactggatgccgtatggatccctctacaatgtactacatgaaggcaccagtgagtagggatgttgaatttccttggggaggaaatggcagagagggagcctctctgaactatttgacttttgcctcctctcagatttcgtcgtggaccagagccaggctgtgaagtttgctttggacatggcaaggggcatggccttcctacacacactagagcccctcatcccacgacatgcactcaatagccgtagtgtaatggtgaggccacaagctcactcctggcccaggccccaaaagccctttgcctatctatgacttacctccttctatctgttttctcttcctcagattgatgaggacatgactgcccgaattagcatggctgatgtcaagttctctttccaatgtcctggtcgcatgtatgcacctgcctgggtagcccccgaaggtgagtgaagtcatcatgtcgggaggtaaaaaaggaccacctcagaagtagtggaagggggcagagacaggacaggcaagggggccagaacagacaagccctatctctccagctctgcagaagaagcctgaagacacaaacagacgctcagcagacatgtggagttttgcagtgcttctgtgggaactggtgacacgggaggtaccctttgctgacctctccaatatggagattggaatgaaggtgagagcacaacagcatacatttgtgttgcgggagtggttggtgatggtgaaaataactgtagtgggccttggctcctcacatatttgttcggatatacagtaatcctgtcccaagggccagtggcttctctctacatgacagactcaaattgtgaggctgctttttttcttgtattcgcaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaacaggctggtgtggggacatggggacagataagtacatttaggttgggtggctcaggtgaagtagtgcggcttcttcacattgatgccatactcgctgagggcaggggtcaagtcctccatggttagagtgtacttgcggtcctgagggaagagggaagagcaccaactgagcacaggaatcccggacttcaatcccagatgggtgaccctgagtaagtcttacacctcccctacgattcagtttccccaaaggggtggcaggataagcctccactgttgtggaaggtaattactgattcattaagcctcccctcacaccttgctcttgctccgggagctgccggaggccgtgcccttcattttgcagtgctgtagggcatcattggcaatatctgagatgaatttctgggcagctaaggagatgagccgaattctagagagaaaaaacttagatgagaaggagatggacaacatactgcacaagcacccaaaactaacctgccctgggtttactcacatgcgtgggtctgaggcctcaaagccagcacggttcaggtagtaaccagtcactgcatctgggatctgagaaatcaattaagagaactgtcagcagagcgggaggagggtgagggaaatggataggcctgattatcaggaagctcacagtttgggtgagcagagggcaaacacagaagagcgactaggggagcaaatggaagagaacgctgaaaagcacgatgtggctgaaagttttgacagcaggctaggtggccttgttcgggcggaagcccaccgtaggcgtgtaatcttccagctgcatcaagaagtccaccaaaggcgtgctggacaccacgggcttcacgtctccgttggccgcgctcggcagtacgtaaaccccgttagatatggccccctccgggggcgccgcgccacccgccgacaccggagctggaggagaaccagcaaaatgagacacagaggtgggaggcgcagggccccagctaggtctgtctataccctctgccctcacccgccgctggacccagcccaagacgcttccctcgccctcacccgtcccggccctcacccgccccacgccgctcagctggctccccggcccgcgccgccaagggtcccgtgcccccagcagctgctccagccccaggtccccccgctgtccccgcggggctggccttgttctccgcggcggtgctggagggcagcgcggcgggagccgagaccgggggcgcggggcccggggccgaggcggcggaggccggcgccgcctcggggtccgcgccggagccgctgcagctcatcgggccggtgggagaggcggcgaacagagccgcttccgcttccgctcgcgccgcgcacaccccggggtgacgtcacgcgcccacgactcgccccgcctgtctctgttagtgctctccagcccgctccccgcctcctcccatagtggatctgcgggttagaggaaataggctgcagggcggagaccgagccttggcgaactgcgctgccgtagccattccgccctagcctctgccgtgctccgcggcgattccgtccagaccggaaccagcgtgcgtctggctctcctccgccgctctgggacacctcattctgtctgacgctcaagacctggcttcgacgtttatggccctatgtccctcgactacgggttgcctgcctgtctgcatcgtttcaagttcccttattcagccttttaaggattcatagtggatttggaaagccccctctcttctccgccagctgccccgagaggtgggggcagcagtggggcggcacacagtgctgctgtaggaggaggaggagtttcagcctgagtcaacaacatatgcaaaaatcacaacgaatgagaggcgtgaggttttcggtgtagcagacatttaattcttatttgccaactcctgagctaggacctgggaacacaaagttaaataggacacgattctagtcctctaggcaccaacggtcttggaaaggaaggcagacaagtaaactggccatttcaatactacgtggtcgttacaatgctagaggtaggcacagggggcgcagtgcaagggaggaagggcgttaacatctgccacctacttccaggtgccaagcactgttatcaacattattccactttattccctggtgattatgaaaggcaggtattgatattcacacttaacagacgaggaaacagcctcagggagataagcttacttgacccagtctctctcctagtccatatcagaaccaagattcaaacaggttttgtttagaaaatctaggatttttcagccataccaaaataaagtagcctcagggaatcaaaacattcacgaaagaaggtgacttctgaactgagtcttgcaagaattctggaaattaacctggcagttgtatcaggggtggtaaggggacggaacagcttgagcaagagtgagagttccttggggtttggggagggaggaggaaaaatgattttttacttaagaacaaatagcaaggaaggtttgtgagctatgattgggggctggaggggaaagcctgaattctatccagtaatccttgaagggttttcatccaagtggcctgatgggatttgcattttactctggaagatgacttggggattggcaggaagtaaggacactttttttcaagagaatatagccctaaactaagg

SEQ ID NO: 355 - DNA, 28002 bp, Homo sapiens
ggaaagtatcttaatggaaggagtgatgcaggtctctccacaatgactgagtgcacagtatgtgcccagctctacgctggcctttgggatgaagcgctgacctctccttctcccttcttggaaaaaagcccagaactatcacaaatctgcctcctgggttctccctgtaccccaagctttagttcaggaggtagtgaccttttggtttatgactatctttggagaaaaagtcaagttaacacctatgtatgttgagcagacactggcaaaatccaacatgcctaatgtttgtttctctttaaaacttcccagagaaattatacactattacacatcttggggtttatctatggcttcctttcttgctccccacattttggcctttctctggttttagcttaaggcctagggaacaagaaattcaaatgtcaagtcaacaacaaattcagcaaatatttacagactgccaaatgtgtgccaggccctttgcaaaactctggagacccagtcatggacaagacacacagggcccctgtgggaccattttctgtttgagagatgtgctcctgagagtcgcccatgccccctcacaaaccccagaaagccagatctggcagagccggcagcactatggaatatgtctgactccgaaagcctgaaactctccctgtctggggttgttcagaggcttatgactgggcttggtttgtccaaaagaaagccatcctgcacactctggagctggccaagttagctgcttatctctccaggacaggccttttttgttctgtctgctgcacattgggcccttctaagggtgtggtctgtatggccctggcaggagcctccttagaattgggggaaaggatagagacttcttcaacacccactgggtagggctgggagtggcccaagtgcaaaggaagtacaattttcttcagtggcctggttcttccattttatccttatctctcccatgtgttacctgccaggctgtgcaacatcctagctcctccccaggataaaaccataagctctccaggagtttccagtcttgttaatatactgggtgccttgaaccaaagcacagtgctttgccaatagtaagtgccataaagtttggtttgttgaaaaaatgaattagtccatcaattaattattaatgactaatggttaagcccttatactggattacaaccagataaaactggttgaaagctagttcaactcccattgcatgaggtagcacaagctaattgagattatttcaatgtgaggaatccagacttctcaaatttggtgttcagatttagaaaaatttacatgcaaaatgagtgtcacctcctcaggggaaaaaaatgtagaatcacagaatcaagaactaatcaatcaagaatcaatcaattacagaatcaagttgaagttgactggacatttgaggtcacacaatctgccccgttcattgctgggatcccctctccagcatctctgacttatatccctaattttctgcaagttctgcccatggactgtgaagttagcccaggcctagagtgtggccacacaggctcctctcctctttgctccctcaaaggcaatgaaccaaacccagggctagaccagatcctccccatgactaagcatgaccaaagctatttaaattctctgcatttcagcatcattaaccataaaagatgatcaatcatctctgaccctctagatctcacaggaacatagctagatgaatgaaatatctgccagtgttttaagaaacatatcacaaggccaaatgtggtggctcacgcctgtaaccccaatactttgcaaggctgaggtgggcagattgcttgagcccaggagtttcagaccagccttggaaacatggcaaaacaccatctctatgaaaaaaatacaaagattagccgggtgtggtgtcatgtgcctgtagacccaggtgcttgggaggctaaggtcggaggatcacttgatcctgggaggtcaaggctgcactgagctatgattgcaccatggcactccagcctggacaacagaacaagacccttctcaacaaaagaaaaagaaaaaaggaaacatatcacaaaaattagaccatatttttccttataatatctaagagagcaggatggaggacctgcctttatgccagacagaaatgaggctgctgcttggtctggtgtggggtctagagtccagggcaatgagtctctaggaattcctaaacccatagtgattcagggtacttagtgccccaatggggggagatcttagtcattgccagagcccactgattctgagccatgcttgtcattcctttagagggaattatcttggagaagaatctttgagaagcaacatcacaaccactgctgtcatcagctagtcctgggtcggggacctccccagcagatggtggaagaaaaaggaagaagggcataatctatacttactcttggggttgggatagcagagaagacatggcttgacctttgagaggacagggagcaaaacaaagattggggaatacattcgtgggactagattgtcaattctgatcagagctgtgagtgaaggaagtggtggaaggggaggagataatcagtgagttgaaattcttattggttgggcccatccctctaaacttgtagggcctaataaacactttgagaaaacagagttggtttacagtcatccccaacacttgaattatctgaagtttattaactaagcgccctaagtgtttactccctggagaaaagagtgagtcactggattgcaatgtgtaaaatcgagactcatagggtgctacggccaggaggctctccagtccactcctctacctcgaggcagaattcacctggccactcctactcttcaggatccccatggaaggcgattcatcaaatctcctaacttgcccaggccagcaagaccccaccctgacccaaggaaggtcttcaaggatctagctttcgtgccttccactccatttcatgggagcctaactcctcttaaaggatcagtgaagttgtggtcagcagcaggaggcccagtcacctgtccgtcatggcatggcacccatacctctctgcttgtgaaggccccttttaacacacaaaaaattacattgaccttcacacatgtcagaactcatacttccagtatcctttgagaatatacattttttactatgaatttagcaacacttttaaataaaagtgcagttcatagtcatatacatttgaaagtggtaatacatatacataaaaagacacattattcactcagtcgagagacacttgcatccatgtgcattctcagaatccttgcagtcctgacacaacagcaaccctaactggggcctctcagcctcaggtctcaaggtcctgccccttccacggctggacacctgcccccagctgagattccccactgagcactgttaccacctgtcttccctgcctttgtgtccatcagcctgtggccctggcaggccttcagcagatgggaactgagttgcgatgaatttgctcttgcctggccttccatagtaaaacacacacactcccctggtttctgtatcacaacccttccaatattagaaaatactgtggaattcacagacaccaacctcccagttagatagacccagttgtttctcccagtcctcagtacagatggtttccgggaatcttctctgcacccactttaatatgttaatggacctcttaaaactacagtgccttgctaagataggatacttaaggtggcttcatgtgcaccagaactaataagaagccccttcctgtctgtgatgggggcactgtgcttctttcaatgcaagctaagattctgttcccttctttagctcttgacttccatcaatcctgcctggggaggaggaatggtaaggcatgggtttgttggtggtgggggcagggggttgtttttgtttttttgtttttgttttgagagagagagagagagcccctcactctgttgctgaggctggagtgcagtggtgcaatctcagctcactgcaacctcaacctcccaggctcaagccatcctcccacctcagcctcccaagtagctgggacactggcatgcaccaccatgcccagctaacactttttttattttttttgtagagacagagtctctctatgtaacccaggttggtcttgaactcctaggctcaagcaatccgcccacttcagcctcccaaagtgctgggattataaacatgggccaccatgccagccagcttcctagttttaaataactcacttccttgtcctgctgtaagaataaactgaagggacagcattcacaaagcacttacagagaaaataaacataacagtaaaaatgaaaaaaaaaaaaggtttgccctgaataagcctctatttacataagattcctctgcatggataagagctgtccatttatatttgtgctgaatcatgtctggctggcatgcctgctcaaaccagaggcttgtacacagcagaaatcacaaccttgtcctcgctggagaattcccaagagatcttaggaagttattaaacagttgtcttcaaacaaaagataggccgggcgtggtggctcaggcctgtaatcccaggactttgggaggccgaggcgggcggatcacgaggtcaggagactgagaccattctggctaacacgatgaaaccccatctccactaaaaatacaaaaaattagccaggagtggtggcgggcacctgtagtcccagctactccagaggctgaggcaggagaatggctgaatccaggaggcagagatggcagtgagccgagattgcgccactgcactccagtctgggtgacagtgcgagagtctgtctccaaaaaaaaaaaaaaaaagatagaaggggaggtgaaaaaagtcattaagtggtcatttaacctgggaaaggcatttaagaggaaaaatacatttatttctcaatgcaatgatttgaaaagcatggatctctctccactgaggaatttgaggggatccagttagacataaagcaaagggtacaatcatggtgaaaataaggggaccaggggacactgtaagtaacccaaggggatttttaaaatagcaatttatagcccctagcatatgaaagatgctcaataaatatcaaaggaatggatgccagcgtgtggggtgagagacaattctgccaagagacaaaggaatgacagcaaacctcttcattcctggaaacataccctcataggaaacaagagtgggaaaggaggcatggccatggcaaggcttagcattacagctgcgtggcaggggagggaggtgcagagtggtggttcccagactgcaattcaaagcacatcatgggcctccaggccacaccctgagagcaggtggcccagagctatctcctcatccatttctgagcttaatctctcagacacgccttgttctgagcttgtctagtcttagaacataaagcccaaaccccaaacaaattggacaatgggccaacccatgccctccacatcctggcctcaaccttgctctctagcgtcctctcccaccactccctgccctgtcttgagtgatgctaagctgcttttggtttggtactgcactgagccacacttccctgtctttactctgcaattcttgctgcctagagcaccctgttcccctgcacccctcttgcaagctccaggtccacaccccttttacatggctgacttcacagctgtcacctcctccagggagacttccttgaatccctggcaaaagcaaatgattctcccttaggcttccagagtctcagtgcttgcatacaccattgcttttaacattttcctgaaagtatggaaaatgtgtatttaatgtgtctacactccccacactcactcaccattttcacattaaactctgcccttctcaagggtgaggaccacgctgcaataagctttatatcctcatggccctacacagagtctgacacaatgtaggtgctcaacaatgcttctcgaactgaagcaactgcccctgccgtgctcttgggtggtggattcacaggagaaggagctaccagcccgatgggagaaatgctgcagcttcacaggacacgacacagaaaaaggagtgtgaccaaaatccagtatgaggaggcctaagggagacagaacagcaggatattccaaaggggtggagccactcctagaagacttctagacgaaaggactcctcttaggtatcagaatcttgccctctgtaagaagagcacctgccctgtctctagcatctagggcctgcttcttcctcaagaccccacttcaataccgcctcctgcatgaagcctcctgtgattgccaacccctcactctagactagaagtaattttgctaccctctggactgtcatgtccttcatttgtaacttccaaaggcattcatctgtctgtctggttaccaagttctttatgtgcatgcttttatctagacattatcatctgtattaaaagctccttgaaaacagagtctaattcttctttgtataatgggtccccattgcccagcacaaactaggcacttggtaaacattgttcaattaacatttgttaaacagctactatatggcaagcacagtggccctggaatgtcaagatgaataaagtcatggttcctgcccataaataatttatagactagtggtttgttgagtaaatgagtgaatggctgggtggatggatggatgaatagatggatgatggatggatcatagatggatggatggatggatggatggatggacggatggatgagtagatggatgaatgggtggatggcaaatgacagtccaaacactttctccagaaaatgtcttcccagcttatctagcttctcacccactttctcgaatttttaaggatcaaatccacaacactcaaagtaaaaaaactgcagatgcagaacaatcctaccttgacccaaagccaaaccagaaaaccatgggcagcaatgagcctgagtcctggggctcccaccaccaagacccttcatggccacaactctacactcccagccctcttagtggaataacgagatgactgttcagaccctaccatcaacacgggaaaaaaaatggaacaggtgctaaaatggcttttttcctttcagcctgctccctccctttgtccctcgttggcccactgttaccatgtcctgagggcccacaaagggggcacagccccctcaactatttccccacgtagctgtctcactaaaccctgaacatccacccaagacatgggagcagccatgccttattctgaggtcctctggtcttagaacacaaagcctgggccccgtcagcaagttaaaacaaaaccccacagtgggacatgaaataagcccctctttgctataaccttctgggtttactagcaacgaggtagggagacttcagaagtattggtgagaactttctggaactgagagggctgaacccagagcggagggtcttggtgaggtgggagggatctatgcaaacatagcagttgttcaggagttgacaggtgcctgagccaaagtgatggtggggctgcagccagggctgggagccaagatcttggggaatggagtcagggcagatgagccaaataaaccaagttagagatttgccaacctgcagttgggctcttcagatgtgaaaagtgatttccgtatacttagaggtaaaggatttaaaagaaaagggagagcatggggcctccaacggggtaaataatgcaagccatgtctccctgtttcctaagcactaggagctggccagaatccaattcgaaggatcagagagaagggtggtgtctattatctcagcagtatatttaccccaaataatcccctctgactagccagccagtttcaaacatatgaatcaaggccaggatccactctcctggactgttctagaaacagagaccaacatgagggcttttcctttttatgtaaaatagaagacttttttttgagacagagtctcactctgtcgccaggctggagtgcagtggtgtgatctcggctcactgcaacctctgcttcctgggttcaagggattctcctgcctcagcctcccgagtagctgggattataggcgcctgccaccacaccaggctaatttttgtatttttaatagagacgagatttcaccatgttggccaggatggtctcgatctgttgacctcatgatccgccccccttggcctcccaaaatgctgggattacaggtgtgagccaccgtgcccgacctaagagactttttatataaataagaaacgctgacacactcacatagccatgtgcctatgaatacaaacacatttattctaagatgcacatacacgcgtataatctacggcctgaccttgcagtgtaaatcactgagttcaaccaaagagatgctgagaggcacggagggctgctcaggctggctgctcccacactcagggggcatgagaaatgctttaacctgccccttgcctctctgtgaggcccaacacaacctgcagcctcctggtgggtgaacctgagaagctccacccctagttccaacctttaactcctcctcaccactcccagaaactcaaaaaaaaaaaaaaaaaagagcccatctgcattttgccaggggaggagtgcagcccttggaagaagccaaagccaccaaatgcagctgcagagacttcctgttctgacacatggggctcaatgagccctaagacaatggggatattagggccaggctgatgaaggacagagcccaggttgctcctggcaaagtcccctgcccagagagcacaagcccctgagattaaccctttgctactctgtccccgctttcccaaaggcagaacaaccctgagcctaccttggatctgcacgagactcccatgggcaaggactggtcttgggcaaacgacgtgcctttctgcctgcacaccatgaggccccatggacacagggctggaggaactggagtctgaatgaactctgcggcagtcaagggtgggaggcacagtagggtggccaaggcagagagtgcattctgcatctgcagcaaactgattcgagtcagactgcagagcaggagctgggaaatctttggaagaggggagactgtgctgctccaggtacttggaattggtccaatatagaaaaagggtgtccccaaatctacccagacccccacctctgactgtcctctccccgcttctgtaattagacagctccctccactcctgctccagaagacctgctccacctccaacattcttcgccactcagggacagcaccacagacataaccccaggcacccctgaggagctggggaagtgagcagctcatgaaaactctaggagaatgacacacatgcacacctccctccaacaaccgtgaccttgttgattcttggaacaggttcctgaaagccttgttgggccagtgagatttagccccatgcatggaatttcatgaaaatagggaggccttgctagacacagagtataagcactctcataagctccataacttcttgctctatattcagcagagacccctggcctgcttctctcacacctatcaaatgccccccacctgcagacttaaaccccttccctccaggtttattccaggatcagcattgaaatggtgctaccccagggtgccctacaatggacaatgtgtgtataattgttggatgccccttcaatctgtacaactgccctgtaggcaaccttcagcctctgtacactgtacttctcccccaataatttgagtaacttagaagtagagacctgagaaactagtcgatgacccagatctgtataaacagatccttcacacccgcaagcatacaccttcaccaaaattatctagttatacaggattctagagacctctccccagggaaaaaagaccattgctcagaatgaatgacaaaagcattttattgaagattcacctgcagatggataagagggaatgagaggagtagaatgggacactaagtggttctcatcctaagcttgcagggccaagtgctgccgggtgttggagaagtagtttggttctgatgtagatggataatacaggatctagtgggagatggcattggactgggaagggacatatgtgaccccaataattctggagatgacactcctggtcattttcttctctgtccatgggaggtgagaggtcagctgacatccttcccattccaggtgggtcaccaggcccaaatcaagaagtagctaccaaactccaagaggcagagtccctgtcccagcacagaagatcatcctggggcagagagagcccatgggatagtggaggggatactagtaagatgagccccagagacagaggatggaggtgaagtgaaggaagcacagagacaccagtgctgggcccagctggacacagtgagctgcagggacctcgtctcctctatcgtctcttgttcagggtggtggtagagatgatcttgctgctggaactgccagagacactgccaccaaacccaaagccacttccagagccggagccaaagccactactcaggccaaacccggagccacttcctaatcctccgctgatgcctccagtgctggtgctaccgctgaccacagctgcagaaaagacacaaaagacacagttattccaatgctgccagcaccccaggggtctggcaagacccgggtgaatgaacaactacagcaggcgtggaaggtacttacagatgctcacggcactctggcattctccagacattctgtaggggaaagaaaaggcggtgagcctcagggagcacagaattttgttcaataagcatgcctcactcacctctcttatccttgagcagcctctgagtttgagggcccagtgtgaacctattagctgagctgtcctggttcgtaatgcaccggcacaacactgatgcttgcagcccggcagaggcataaataagctcatggccctggacctctctggccctcatgttcacaccctgcctaacccctcacctgtactcctcgccctccagcagtttgcggtaggtggcgatctcgatgtccaaggccagcttcacactcatgagctcctggtactcacgcagcattcgtgccagctcctccttggcctgctgcagggcagcctccagctctacgcgcttgctgtgggcatctttaagggcattctcacctcgctgctctgcatcagccacggatacctgaagagtctggcactattgacaaaggcattagataggtggtcagcagtgccctgccttcaaggcctctacacctgtcccctcccctggtccagctttccttgggttaggatgtcaagattctatctgttctgcccactttccctgagacttatgcatctcattcactccagccatagcccaccaatgcctccaccagactgattaaataaaaatgagcaaaaacccatgaagaagagccaagaaacctatgcacaggagcgtcatggtgtgccaactaggatattgctgaaaaaatctgggtatgccttgcacaaagagctatgaattcccagcaacaagctcagggtcttctggcctgatgctttatctgcttgtccactctggagatgtctgcctgaggcccctggccttgtgctccatctggaagggagtgacacccacctgcttcttgatgttctcgatctctgcccgcagcctctggatcatcctgttgagctctgcaatttcactcttggtgttcttcaggttgtcaccatgttggtcaaccgagatctggagctgctggacctaagactcaagaagacacagagaaccaggtgttaggggcatttgggtagggtccattctcaagtgaactcagtgagaattgccacaggtggcaagaatagcaccaaatgtcaagtagtttcaaatcagaccaggaccaacgatgcctgggagagtctgttcatatctgacttctattgggcttgagctaatgatcacctgttcacagacatcaaaagcagagccccagagccagccccatctcctgagagatccataccacccaccttggtctggtacagggcttcagcctcagccttgctcctctgggcaatctcctcgtactgggcacggacctcggcaataatgctgtccaggtccaggttgcggttgttgtccatggaaaggaccacggacgtgtcgctgacatgggtctgcatctgggacagctcctgcagggcaaatgtctcacatcagcccccccaggaaagccttcactgacctgatacaggctcaagtaggagcagagctggcattcacaatgtgtaggaaggggagagacaggtaaagttctaaggagaaatcaagtggttgtgacagttcaggatggaagagcaatgcttctagtctttactggtccccaggaaccataagccactctaatgcagtgagtgccggtgtgttggaatggaagggaagggaatggatccatttcaccagaaaaaaaatgctagacagcaatgaattctattccaagcactctttagatctaatcaccccgtctaagaccaagaccacatctggttctaagaatctcccagttgaatttcccacttcaaacctttctatgcatgaccttgatgagaacccactgccctaaaataagggagctggagtcctttcaaaaaactgtgaatcccaaccagcagcgtcacagatgggggattccctttccctggatggaggggaggatggagccctcaccgcatcatagaggaccttcaggaagttgatctcgtcattaagactgtccaccttggcctccaactccaccttgttcaggtaggcagcatccacgtcctgcagaggagtaaggaggataagagatgaggagcaggaatgccagtaggaggacgggttactaagtgacaccgacaggtgttctcagcagcatttaggaaagactactcagcagcaggggagctggtgggagaccaattattttatatattcttccctagagccacctgaagacatggaagttgattatccaaataggctattctaacagtatggagatctctcaaagaactaaaaatagaactaccattggatccagcaatcccagtgctggaattccactcaaaggaaaagaaatcattgtaacaaaaggatacctgcactcatgtttatcgcagcacaattcacaatagcaaagataccaaatcaacctaagtgtccatcaacagatgattggataaagaaaatatgatacatatacacaatagaatactactcagccataaaaagagaatgaaattatgtctttttgcagcaatgtggatggaactggaggccattatcttaagtgaaacaactcaggcacagaaagacaaataacacatgtcctcacttataagtgggagctaaatcatgtgtacatgtggacatagagcatggaatgatagacaatggagacttgaaaaagggagggctgggaggggctggataatgagaaattacttattggatataatgtatgttatcccagcaatggatactctaaaagccctgacttcaccacaacacaaactatccacgtaacaaaattacacttgtaccccatgaatttataaaaataaaaatcagctgggtgcggtggctcacaactgtaaccccagcactttgggaggctgaggcaggcggatgacctgaggtcaggagtttgagaccagcctgaccaacatggaaaaaccctgtctctactaaaaatacaaaattagccaggcgtggtggtgcatgcctgtaatcccagctactcgggaggctgaggcaggagaatcgcttgaacccagtaggtggagcttgcagtgacccaagatcgcgccattgcactgcagcctgggcaaaaagagtgaagctccatctcaaaaaaaaaagcaaataggctttcctcccaaccttaatttcttagaacctggtttggttacccactttccttgactatatagatctagatagttccaagtgaagcagggatgaggcagagatggaccaaacccatgacttcagccaaagaccactccccaagggaaggggcaccctgaaggcactccctaccatccttcgtctcttaccttctttaggaccacaaagtcattctcggctgctgtgcgtttgttgatctcctcttcatacctgggggtgggcacggggagaaaaagacaaaaacccacagtgagctggtgtttctcagatctctgctgcttgttttcaagcatttccaaacaaatttggaaatatccacgtaattagttgcatttcccatattcatacagatattcatttaacctatattcattgaatataggaagtacccgtttaggccagggtttattcagatacatgaaaaccaaactttaaagagactgttttcgatagaaaacccagcaatgatgtagttgatttaatgtccctgaaagggctgtccttttggccattttggcagattaaattctcagcaatgtcatcagcacactccatttccctttgtttggtgggtgagtgaattgagagacagggttggtatttattttgtcagtcctatcccatagtgagtttaatgagaggtgctgtgtattcagtgttcactctgtgtcctgaaatatgccacatgctttctctatttcatttaattccatttaattctcacaacccataaagtaggaatattatccccatttcaaagatgaataaaactgaagctcagagaggttcagctatttacccaaggtcacacagctagtaagtgaggactcagtatgcaaaccacctccatctgtctctacagtctgtattcttctaatcatactatactgcttttcatctatttgggttctgatcttgttcgtatatggcagacccaaatccctgaatctatcattaaatttcctttcggaaaaatctgtggttaccagacctcaccctgagaaaacgtgactatgtggatgtagcaaaacagactagagggccttcctagacgccttcagagcctgagattctaagccactggagagagccccgggagcctgggtgtggctgggcacatgtgtcagatggcgtcccctccttcctccccatgtacttagtcttgaagtcctccacgctgtcctgcatggtcttcagctcagactgcaggcgccctttgtcattgcccaaggtatctagctgcttcctcaggacactgaggtaggtctcaaagaggggctcaaggtttttgctggaggtggtggtcgtctgctgctggagcaggttccatttggtctccaggaccttattctgttgctctaagaactgcacctgtgttgataaaggcaccagccaagtgatgagggcctgaagtgtggcaggagggccagccaaggcaacaccaacccagtcaatcccagggaactacacggcccaagaaccacccaagtagggccactatgttgcatctccagggcaccattcactcgggttgacatgatggccccattctcgagcccatagcaccaaggggtcacataggttgtggagaatagagcacagccagagaagcagggcctaacagtgcaacaagaacaacttcctagccgcaggcacccaaagccccaaagaacattaaacttctatgaaataacaaaataaaattaagagacatcacaatctggaggctcttgcattcaaagtgatcctgacccaaggcaaatgaaagacaaagtcactacagactttttaaataagcttacttatcaatggatctggcgtgtccctgtgaacctgtgaacaactgagtatagatatttaaaacaagggccctgtacgcattgtctcacctaaactccattctgcaaaggactttcctgaactttccctctctctatgaaaaaatctagccagacaaaccaggacagcagcttagcatgacatttccatgttatgagcctcagaattgaaaggaaagcaggtaaggcagaccgatcacattttgaacccaaaaggtaaaatgagatgagatgagacaaggatgcatcaaagagccctgagtttttgctatcacatctgcatgtcctatagtcacagtaaaacctctttaagttactatgggtttattcaaactagcaagaagaacaaatatgcaccttattctattccaaaagtgttcattcttgccccatatgtcgaagctgcccaagactttgatgcctggtgaaccagggcaacctggaccaaagggaggcactcatccacccagtcatcaatctttggatgactcggctctctggggctgcactgctcactatcatccatcatgcatgaccataactgagcttaaagaacttgaacttctagacgttgcatgaaaaaggaagttgggctacaaaaagaaaagagacctgtctcctttcttcaaacagacccagacatgagcagtgttgtccagtcaaaggaatgaaaaaagtaaatttccaaggccttggtgagacctagaatctgccactggagccagtccctttttcatttgcaaaatcagcttagttgtcttctgttctaagaacagaagtggccactgttaagtgattaatggggttaactgcattatattcaaaaccaaaatctgagaaaaagcagagaaataatgaaccccctttatagctgggatgactagagccagaaaagccaaatgatttgtccagtatcccacagcctgtctagggaattccaaacacttaactgccttgagcatcccaccttcccaccagccacgggacaaaaaggaaggctcaaagtcatgatgccccttcaacagctggagaattggggcccagggaagttcagtggtctccccagcacctgtggcaggctcaggtctgagaccccaggactcaggacccctctcttctaactgcccctctccagccgaggacacagctcaccttgtcgatgaaggaggcaaacttgttgttgaggagcttgatctgttcgcgctcttccgtccggactttctggatctcagggtcaatctccacgtggaggggggtgagcaagctctggttgatggtgacctcctgaattcccccagcggggcagacggggaagccagggccacccttaccactgaaggagcccccaaatccaccaccaaagccaccagtgccaaagcctccagcacccccaaagcaggcaccttgtcgtgacccagccacactcatggagatgcttttgttccccctgaggttgtagaggcttctgctgccaaatcccccagaagagcatcggccagcacctccagacatggagactgagctgaaggcacctctcttgccaccgcctacaatggccgagccacagctgaagccccggggcccgcctcggacacactgctgtctggcaatcatggctgcagagagcgagctgggagctatcagagaagtgacagggcccaggccggtgagtgctggagccctcagccttcgtctcttatatgtcctggagcagcagggcttggttgcaggggcataaagggaaaaatctgaaacatctctgggcttggcccttggcacaagcccatccttcccgcacccgttgagcatgtcactaaacacacctacagaagtcatctggagggcacaggttactggatcccatcacactactctctgggagaacctgaactggtgccccagggcttcctaatcagaagcccctgcctgggcccagcgctccaggcccacacccactgtacctccatctcgctaggctcacagcacctccctcctccagaaaagacaccccatcacccatcctctcaccccacagaatgtggagttagacagcctgagtttgagcgcacagcctgccacctcctagctctgcaaaccggagcaagtcaccctctgaggcccagttgctttccctgtaaattggaagtaatacaaatatttgccttgccacttctcaggatagagtgagctagtgattaatggagtgctctgtaaactgtcaaaagccacatgtatatttgtcattcttagcattcttattcctccacatgttcttggctccatgtacctataaaaaggggaaatattctgtattccagccttagccttccaacctagatccagattcacttcaacttggccaacagctactgagaaactgccaggcatggagctaggtactaaggagatgggggaagacaaaacacctccccaaagaaaaccgtgactgtctttctcagccctgggtacccatgctgccccgcaggcctcccttcaatctgtgcttgcacaattctagatgggcgttctccagcggggtctggtggtgtgcactctgctgctccatttgctgtccagttgtttgctaggtgtgttctggttttctgtaatggtgcagaattcagggcaggagttcataacttttttgctgctggggatccctttggcagaatgatgaaacctatggatcccttctcagagcaatgtttttaaatgcaaaatcctagttttaagccataacttaaattcttcccaactgaacagtaacagatctgtgttcaaatccctcctgttgccactaactagctgtataaccttgggtgggccaactaagcactctaaacccatccaatatggtttggctctgtgtccccacccaaatctcatcttgaattgtactcccatatttcccacacattgtgggagggccccggtgggagatgattgaattatgggggcggtttcccccatactgttcttgtggtagtgaataagtctcacgagatctgatgtttaataaggaaaaacccattttgcttggctttcattctctctcttgccaccaccatgtaacaagtgccttttgctttctgccatgattgcgaggcctccccagccacatggaactgttaagtccaataaatctctttcttttgtaaattgctcagactcaggtatgtctttatcagcagcgtaataatggcctaatacaccatccaatccatcttctcatctaccaaatgggacacctgcctcacaaggaattagacaatgtccccatggtgcctggcatataggaggtcagcaggcattcattctcttctttcccaggctttgccattgccatttacagggagaaatctggtgtgtttgttctccctcctttcctcaattcctcatagatgaaatgaccccaggtctgaggaagagcagtcaccagcacctggataatcccacagacccaagctgcccctagctgaatgaaagctggccagggagagagtgaacggctgcctccatgcacagagagagggcaggggccagtgctgaggacagagtggtcaggagatcccaccccagacgcagggctgcagggaaggccaggctggctgggagttcagccagctccttctccagccacttcctcccttgtccccattcccccaacccctccctcccctacctcgggtctgtctctgccaagatggcctctaagtaagtggagagggggtggaggggctgtggccatgaggactggaggccccaggccccatcacaggagaatgcccgcgtcatgggtcagtccacctgcagtaggtgagcattctagagccagaaccatctcctagaaggaaggggttggactttcactgatcctttctgcccagattcaccaagcgccgacttcgtgccaagctctgtgctggatgctttacctacatttgatcaactagtctacttagaggctctatggagtcagcaccattagccttccttacagaaactcagagaagtaaagtagctcccagggtcacacagcagcacgtggtggagccaggatttaaacttacatcagtctggtcccaaaagttccatattctttttttttttttttggtttttgttttgggttttgtttttgtttttttgagacggagtctcactctgtcgcccaggctggagagcagtggcgccatctcggctcactgcaagctccgcctcctgggttcacgccattctcctgcctcagcctcccaagtagctgggactacaggcgcccgccaccgcgcccagctaattttttttttttttttttttgtatttttagtagagacggggtttcaccgtggtctccatctcctgacctcgtgatctgcccgcctcggcctcccaaagtgcagggattacaggcgtaagccactgcacctggcccaaaggctccatattctatagcctctcactcacactgttctgcctggtataaagccactctgtctaaattgtgtcacaaccaatccagaatgtgcacccaaataaatctgatggaactgactgttcgggtcaaaggggctctgggggcactagcatcccagggtctatcgatttccactgttgctcctaaggtgggcatggcttggaaggagggtgggagctactgcaggtctttgcgggctgcagctgcaggagctgaggagacatgtgagcctcccacttgggaagctgaggtccaattgactggttacctgccccagaggacatggcagggccatcaggatctcaccctgagtgatggctggagctcaccccccggctgcctcacctcagcctctgcacctgccgttcactgctttcttctctggtagcccctgggatttgatggggactatcacaggccggggtaggctttgcctgagcacaagtgaatccctgagatggctcatagtgtgcttattgggtcttttactctatggctgtaacactccaacactaggagaaaatggcatgggttcactgcccctagagttgtgtctactgcttagaacaaaaagcaagccaggagccaaggggattttcagggaaacaatatagaatatgtaatcagtcttattttgtgcctgtggggcacccaaaccatggagctacgattgaggtacttctcatgaaggtgacttgaggtgtgccatcgctgatacaagaaggaagatgaaggaaaggcagcggtgcctcttgggtagaagggattctctcttggaactactgttatatgctgaacactaggtgcttcttccaacaacccagtcaaagaggtgctttgctatgtccagtttggagctgcagatattgaggctcagaggggtatgtaacttgcctgagatcacacagccaggaagtggtagagataggaagtcagtactatctgtctgacttcaaagcttgtgaccttacaatgtataaaacggtaggtataatgttttatatgagtgactggcccacacagaatatgcagggaaaaaaatacacagcaacttatacagccctgtacctcatggtccaccaagacagccatggggtctggccagcaggctgcaagctctgcagatgcagctccgctcctttttgtccttaccctcagcacatggtcagttgcttggttgatgtggccctgtccttacaagtacccaataaggtatgacactgtcctgaggggccagttttgtatcctccaattaactaaatccaaattaatttcatgacaaaccctaccataaacccaatccaaacaagaagaaagttctagtctagagccacattctgtgtccttattattaaatcagaattgcaagaagctcacaaaatcttcaaactgagcctgagaaaccgaaggtagacctaaggaagaacttcctatgcaagagcgcctttacaccctagagtgagagagaaagagagatgagtttctttccctgaaaacggggaaagacattgccttcatatgtgggccagaggcaggtggctgaacaaggcgccactacccagcagccacagctggaagcttgtcccctgcccctccccagacctccacacgcagattctgctactgccctcggtgacccttccttgtttggcagctgttcccaatcttttcacagagggatgagcagccgacaggggtgtggagccaggcggagggagtgtttgctcagggctttctgggtaagggaggcaagcccttacattcagccctgggattaagggatcctgagggcttctgtcactctcatctccaaacccactgtgtggtgtgggaaagtgctcctgccctccctggccaggcgggcaccctcactccattcggtcacccaacctcaactgccccaccgggcctgagtcattcttggggaaccagagacaacacggggatcagagattctgcagaaaagggccatcagcgttttagggagaggccagtgagggcaatgagaggacgggcactcctgagagccaggtatgggggtctgtacccaggggctcctctttccccgggccggagagctgcccctgctggcctcctaccccaggcatatacaggcaggggcttcccagcatgttctggcagcaaaagcaccctcataaacaaaatcacgtgcacagcctcatgagtaaaacagataaggagagatgatccagttggtgcagaggagggaccatgatccttctcacctgctgacctccccctgcacccctgaaagcagcccttagggtcctcagtttggaaacccctgggtctgggccattcccctccttcgacaagtatgtctaagcagcgcattattgttggtgggcccccctgggctgcagtataatctctgaggcttttttccatgacaatcaaaagtttctattgttcagtttttgagccctaaatataatttttttgagacagggtctccctctgtcacccaggctggagtgcaatggtgcaatcacagctcaccgcagcctcaacagcctcaagtgatcctcccacctcagcctcccaagtagctgggactacaggtatgcattatcaaacccagctaatttttgtatttttttgtagaggcagagtctcaccatgttgccaggcttgtcttgaactcctgggctcaagtgatccacctgcctcagcctcccaaagtgctggaattacaggcaggagccacaacacctggcctatgatctcactaaaactgattttttttttaacactgccactaagttaccgtggctttggatacattcttccccttcctcaacctgttttcttatctatgaaataaaaagtttggagtcgattacatccaatgccccttctagctccagcatccccaggtctccattcctttttctatataagcaaaataacctggtgcttaagagcttgggctatggaaccagattgcttggattccacacctagctctgctacttcctagctgtgtgaccttaggcaagttacttaaccactctgtgccttattttccttataggcaaaattagaatgataatagtatttatattataggctgttgtgaagagaatcagttaaaggcttgacagcagttctggcacacagttggcactcagtgagcattagcaagtattcctcaaagtgttgtacatggggtggactatactccatctgtctgagaagggaagctagagaccacccaagctggtgaggcagagctgaccctaaaccgctaggcctttgtgttcctaagctggaggttagggtttggctgaaaatccctctgctggccttccacagccctggaggaagctttctcagggctcttcggggctcctctgaggaggacagagtgatcaggccggaagagtgtgggatgcatcccagcaactgccaggagccctaaggttgccaaggaagggagcggagtggtgacagcctcgggtcgggccaactggtttggtagcagggtggggagggcctgagaggtgcagggttgagaggccagccaattggggaatcacttgggtacagcttgaggagtggggtccagactcaaagtagagaactgtggagatgaagaggaaagaaggtgataccaagagacgcatggagggaggagcagtaagatttggcgagtgatggaggcaggagtaggacggaggtagcttctggggtgacaggacagagggcttgaaattgcagccctggacactactgacccacctccagccagctggatgactacagcatgagaggtcacttctgtgagcgtgaatcgcctcacctgtaaactggaacaccacatgcccactactgaacctagggctgtggtgatggtcacaggcaaagtaatgtatgtgtaaaccacaaaacccaattaagtgtggatttttcttgccgactggatgtgggggctgagagagacatcactgaggccaagaggataagctgggaatccagaagtcagggagtgggaaagcaaagaaacctgattcctgaaagggcctctataagccagatgctttacacatgttcttatcacaacccacttttacaaaggaggaaactaaggctcagagaggttaggtaacttgaccgaggtcatacagctagtaagtggcagaacttggatttaaacccaagttgcctagttctgaagcctaagacctctccactgaacaaagcatgctgtctgcccctacagagttagtgggaggctgaacaggcaccaggggtggctggttaataggcagccacttagccaggtctggccttgagcagcttacatattccctctgagccttggtctcctcttgtgagccatgtacagccctggagtggcgatggtatcaaactaatgtacctaagtaagcatggcgattgggatgtggtgagtgtgtgattattgctgtgtcaggcatcaggatgttaatcaatggacacaatttcagttccccaggcaggacagactgcagccacagacagctagctgcagttgcaccatttattgagacacagacagggaagggggatgtgggtagattcagggagagggtgggtctggtgggggactggggaggttgaagggtctttggggaccactcccaatttctctctctcctaatggcttgagaaattcagcctcctctcggtggtcaaaaggtcacccccaagtcacccaagcacatcactcaagctggcaactttaaccttccctcccatcctactgcaggaccaaggagaaaacctgagtagatttgagcgcttcccaagatgcaaatagtctggtatgaaaataccctgggtctgaggtcccctggctgttcctgctcctgagaagtgactggaaaggacagcagaggtggggtgaggagggcagggacaggattgcaggggcccttgcagggctcagcagctaatacctctggctggacgtcttgaccgtagtggtcttccgcaggatggaggtgcccgcagagactggccctcccttgacggtgctatagcccacatttgtgctgaatccacccttggtggcccccccactcccacccagggagatgccacctccaaagctggctgcgccacctccgcacacagtggtggagttgccagtcacagctgcaaagcaaagggtctggattagtcagggcggccatgccagagagggctgggggagacccagaaatcagtggggaatcagaacaaaatcaagcagcagagctatgggaaatggatagagaagcccagaactaggaccctctgaacctgtctccaggggctcgaatggaggagagcatgctttaggacaggtacaggttgcataaactgagcagagttctggggcctggccaggggtggagcaggaagtggggagtaaatactcacaaatgctgactgcactgggacattctccagacatcctaggggacacagaaaggccaggagagcagtcagttatccctggtgcccacatgaaaaccctctccttccctctgcctttacattggatccactcagtgaatcctgatgacaagaccaggaaacatgagaagtatgtgtatagggctgtgcccaggtccaaaagccagtgctgcagaaagggcagagccaccagtaggctgtgccaactcccatcctccccttttctttcctctctgcccatgtgggctacggacagcatccctgccccaatggaaacaagcccacgaccagacagagctgcctagtttctgcccactttctatttcatgcttttcctaaggacagagatggtggatttttttttccaaagcttccactgctggtgaaatctgctggtggaagaggaagttccattcctaccgggctgtcagccacagtaaagattaacaagagttgtgccaaccaaggagaggagtgatggaggcagtgggcacaagcagattttccccccgcgtgagtcaggatcttgctccctggttcctctctccctctcttgaccccggagcagactccctgggctctcccccagggcaggcccgacccagctttctgggtcgggcaggaggggccaccacctgctctcctcgctctccagaagcttgcggtaggtggcaatctccacgtccagggccagcttgacattcatcagctcctggtagtcacgcagcagccgtgtcaggtcctccttggcctggtgcagggccacatccagatccccaagcttcttctgagcatccttgagtgccagctccccacgctgctccgcttccgcaatggccgtctgcagctgctgacactgcccaggggagaaaggtgttggaagcaccctccggggtcatcccattcatctctctgccctcaagccatggagacatcatcattcccacatccctgcccccaaccagctgggaaagagagaagagaaatattcatctgaagagatgctattacacaagcaggatcaagtaaggccactgggaaagtccttactgaagtctaacctcaacccctcctgctgcagatcagcccaatgcctcagaagagatgaaataaataacacagccttattagtaaccaggtgcttcattctaatctgtgaaagaacccacactttttagccgttctaaaggtggagtcggcatcagcatctgtgacctggccccttgaaccctctacctcctgttctgacttcctggagatgggatggatcagtttccttggagaaggttgtcccacctgctctaccactcatataccatgtgacgttggacaagctccttcctgctctgtgcctcagtttccccccatgtaaaaggagcctgtgatcaatggcctagcattctattgtgtccgtcaggagaagagcaggcctagcccctcggggtgacaatgagaaggccctgccaacacctaggccagacccccaagcccccagtagagtcccacctgcttcttggctgcatcagcctccccctgcagcctctggatagtgcgggtgagctcagcaatctcgttcttggtgtcccgcaggttgtccccatgcttcccagcagtcacctgcagctcctcatactggggaccaaagaagtggcagtgcgctttcaaatggccccagcccaccctcacagctggaggccccatgcaagttgagtatatctggccccccggactccaagggtcccagaggcccaagcctctcacgatgggagatctgatccgaccccaggcctcacacctgagccagctatgcctctcaccttggtctggtaccaggcctcggcctcagcccggctcctctgggcaatcagctcatactgggccttgacctcggcgatgatgctgtccaggtccaggttgcggttgttgtccatggacagcaccacattggtgttagacacgtgggtctgcacttggctcagctcctgaagaatcagagacagctgccaccagcacccctgctccaggccccaggaagcatcagagggtgaaggacatgggcccccaggtagcatcaggaggcctgtgctcttgtccaggctccagcctagagcaaagtaaggaaaactgcaaggaaaggcctcagtctccccagctataaaatgaagctccca

SEQ ID NO: 356 - DNA, 653370 bp, Homo sapiens
tatagaacactccacctaagaaaggcagaatactattgttttcaagtgaatatagaatattcacaggtatagatataccatatcctagaataaaaaacaagtttcagtaagttaaaaagtattgaaatcatgcagattatgttctctgaccataaataaattaatgagaaattaataacaataagatattgttatttctagcaaaaataataataatattattatcaacaataagatattgttatttctagcaaaagctcaaaaaattgagtattaacaacacacttaaaaataacatgtaggtcaaagaagaaaacacaaaagaaatatttcaagtttttcgttgaataaaaaatttttaattttcaaatttgtgtgatacatctaagactctacatagaggaaaatttagtgctttaatacttaggaaagaagaacagtctacagtcaatctaagcttccaccataagaagctataataaaacgatgagtgaagtaatcccaacataagtagaaggaaggaaattttaaatattgaagtagaaattgaagatacagaaaattaaaaaacaataaaataaaaactagtaaagccaaaagctgattctttgaaagaatcaacaaaattgacaagcctctagtttgactgatgttaaaaaaattgaggagacacaaattaccaatatcaggaaaagggggtatcattaaagatcctatagacatttaaaggataataaaaaactattttgaataactttttgccaataaatttgacaacctaaacaaaatagatacattccttaataggtacaaatcactaaaactgatataagaagaaatagaaaatctgaatagtaattctatatttacttaaaatatcatgatatgatttggctctgtgttcccactcaaatttcattctggattgtagctcccataattcccatgtgttgtgggaggggcctggtgtgagataattgaataatggggcagttttgcccatactgttcttgagatagagaataagtctcacgagatctcatgattttacaagggggagtttccctgcacaggtgctctttgcctgctgccatccatgtaagacatgacttgctcctttttgccttctgccatgattgtgaggcctccccagccatgtggaattgtgaattcattaaacctctatcctgcataaattacccagtctcaggtatgtctttattagcagcatgaaaatggactaatacagtaaattggcaccagtagagtgcagcactgctgaaaagatacctgaaaatgtgaaaatgactttggaactgggtaacgggcagagattggaacagtttgaagggctcaaaagaagacaggtaaatggggggacgtttggaactccctagggacttgttgaatggctttgaccaaaatgctgataatgatacggatgatgaaatccaggctaaggtggtctcagatgaggatgaggaactgcttgtgaactggagcaaaggtgattcttttatattttagcaaagaaactggtggcattttgcttcgccctagaaatttgtggaactttgaacttgagagagatgatatagggtatctggtggaagaaatttctaggcagcaaagcattcaaggggtgacttgggtgctgttaaaggcattcagttttaaaagggaagcagagcataaaagtttggaaaatttgcagcctgacaatgcaatagaaaagaaaatctcatcttctgtggagaaattcaagctggctgcagaaattagcataagtaacaaggagttgaatatttatcaccaagactatggggaaaatgtctccagggcatgtcagagacatttgcagcaggctgtcccatcacagactggaaggcctaggagaaaaaaaatggtttgtgggcagggcccagggtccctctgctgtgtgaagtctagggacttggtgtcctgtgttctgtctgctccagctgtgactaaaagaggccaaggtatggctcaggccatggctttgagggttcaagccccaagccttggcagcttccatgtggtgttgagcctgccagtgcacagaagtcaagaactaaggtttgggaacctctgcctagatttcagaggatgtatggaagcgcctggatgtccaagcaaaagtttgctgtaggggcagggcactcatggagaacctctgctagggcagagcagaagggaaatgtggggtcagagcccccccacagaatccctactggggcactgcctagtggagatgtgagaagagggctgctgtcctccagaccccagaatggtagatccactgacagtttgcactgtgtgcctcgaaaagccacagacacccaacactagcctgtgaaagcagccaggagggacgctgtaccctgcaaagccacaggggcagagctgcccaagatcatgtgaacccctgccttccatcagtgtgacctggatgtgagacaatcaaaggagtcaaaagagatcattttggagctttaagatttgactgcccccgtgaatttctagcatggggcctgcagcccctttgttttggccaatttctcccgtttggaatggctgtattttcccaaagctgtaccctcattgtatctaggaagtaactaacttgcttttggttttacaggcacataggtggaagggacttgccttgtctcagataagactgtggacttttgagttaatgctgaaatgagttaagagtttgggggactgttgggaaggcatgattggttttgaaaagtgaggacatgagatttgctagggtccaggggtggaatgatatggtttggctctgtgtctgcatccaaatctcatcttgaactgtagctcccataattcccatgtgttttgggagggactagtgggagataattgaatgatgggatggtttcccccatactgttttcgaggtagtaaataaatctcagtcagatctgatggttttataaggggtttctacttctgcgtctctctcgttctctcttgccactgccatgtaagaagagctcttcactttctgccatgattgtgaagccccaccagccatgtggaactgtgagtccaataaacctatttttcttcccagtcctgggtatgtctttattggaagcatgaaaacggactaatacatattatatttgaaatttatagtgaaaaacctttcaaaaaagtaaactatagcccaaaatggtttcactggtaaattctatccaacatgatgtagggaaggaattatagaaaccctatatgaactgtttcaggaggaagtatgctccaactcattatgtaaggtcatcataaccatgatacccaaaccagataaagatattacaagaaaaattacgatagactgatgtcccttataaatatagaaacaaacatacttttttaaatagaaaaagctttattcaagtataattgatatacaaaacactgtacatatttaatgtatacaatctgatgagcttggacatatacatacactcgtgaaccaatgccataatcaaggaaatagacatgtctatcacctctaaaagtttcctcatgtccctttcttctgtgtgtgtggcaagaacacttcacacgagatctacattataaaatattaagtgcacaggatagtattgttgactattagatacaacaatgcttaacaaaatattaattaatctactcaggtgcactcaaaatgggtgcactaaaatcttagacttcaccactatacaattcattcatgcaaccaaaagtcacatgtattccaaaagctttttgaaataaaaaaattatttatttaagaaaaaatagtaaatctaaactggtgatatataaagggataatacatcatgactcactggggtttattgcaggaccgtgaatttgatttaatgatgaaaatcagtcactataattcaccatattaaccaaacaaagaaaacaaatcatgtttatttaaacagatgcagaaaaagcatttaccaaaatttaatattattttgtcacagaaactctcaacaaaagaagagaattccctccactttgtactgagcatctattgaaaacctggagccatcatcataacggtgaacgaatgttttttccctctgataagaaattaggcaaaaatgtccactcttaccatttctattcaactttttaactggaagtcacagccagaaccaaatagcaagaaaaagtgtaaaaagcatacagattggaaagatagaaataaaactgcctttatttttggatagcataatcctatatataataatcctaaagaatcaacatataaactacttacaagtgatttcaacaactttttaggatccgatgtatataacctatatcacttatattactatgaaactaaatttatgaaaaattaaattgaaaaatatttacaatagcactcaaaaacttgaaacacaagttaaattttagaaattatgttgacatgtacatgaatgggaagccaagttgggaggattgcttgagcccaggagtttgagactggccttggcaacatagtaagaccttgtctctcaaaaaaaaaaaaaaaaaaaattaattagctgggtatggtggcatatgcctatagttacagatactcagaaggctgaagtgggaggattgattgaacccaggaggttgacgctgcagtgagccatgactgtgccactgcactagagtctgggtcatatagcgagactcatctcaagaagaagcgcggtggctcacatctgtaatcccagcactttgggagaccgaggtgggtggatcacttgaggtcagaagttcaagaccagcctggccaacatgctgaaaacctgtctctactaaaaatacaaaaattaggtaagcctggtggcacacatttgtaatcccagctacttgggaggctgagacaagaggatagcttgaacctaggccagagtgagactctgtctcaaaaaaaaaaaaaaaaaaaaaaaagaaacccaaaagacatgtacattcaaaactataaggcactgcttagaatattaaacatgtaaataaatgaagacgggctatatttgtgaatggaagtctaaatattgctaagatatcaattatcccacaatttatctgtaggtccaacctcattacaatcatgttccctactctccttttttgggtagaaattaataagctgatatttaaaattatatggacttaagaaaactaaacatattcttaccatatgatccaggcaattgtgcttctgggtatttactcaaaggagttggaaacttgtgtccacacaaaaaccttcacatgtgaaatatgagaatagttataatctatagtgacaaaattagatcagcagttgcctttttctgggaatggaggttgggggatttattgcaaaaggtcagatgctgatagcagttgtatcaataattgtcaaaacttggaaccaaccaaggtgtttttcattagatgaatggatgagtaaactgtggtacttcaagataacgaaatattttttcagtgctaaaaagaaatgagctatcaagccatgaaaagaggaaacttaaatgcatattactaagtgaaagaaacttatctgaaaggctatatattgtatgattccaaatatatgaccttttggaaaaggtaaaactaaggggacagtaaaaagatcagtggttgccagtgtttggaggtggggacagggaggaggcatgaatacgtggagcacagaggaatctcagggcagtaaaattactctatatgatagtgtaatgttggatacatgtcattataaatttaatgtaattataaattacattaaaacctaatgtaaactatgaaatcggagtgataatgatatgtcaatgtaggttttcagttgtgacaaatatatcactctgatggggcatgttgataaagggggaggctatgaatgtgttgggtcagaggtatatggaaaatctctgtaccttctgctcaactttgttgtgaatctaaaacagctctaaacaatagtctattaaaattaaaaaataaaatattcaacttcaccaatgaatagatttttacctaaatattacataatatgtgaagaacctaaaatagtaaagataattttgttttgtaaaacaacattataggatttaccttacctaactttgaggctcactgtaaagctacagtaatagagactgtgatagtggaataaggagatatatatatatatatatatatatatatatatgccattatatatatatatatgccattatatatatatatgccattatatatatatatgccattatatatatatatgccattttatatatatatatatatatatatatatatgccaatgaaaagagagtccaaaaatagacccacacgtggtcaattgacttttgaaaaaagatccaaggtaattagacgaggaaattatatctttctcaacaaatgatgatgaagtgaatggatatctacatggaaaaagaaagcccttacctaagcctctacttcacagcaaacaccaaaatttgctggaaataaatcatagacccaactgtagaagctaagactataaaatctctagaaaaaaaataaagaagataatgttcacaactttggtgtaggcaatgatttctgaaagggacaaaaaatattaagcataatgaatgatttaataaattgtatttaatcagaattaaacacttctgctctttgaaagcactccaaatgcaaagtcaagccacagattgagaacaatacatattatagtaaatgtacttgacaaaggtcttttctctagaatatgtatttaaatcttattaataatctggcaaacaaagcaaaatgagcaaagatttcaagaagaatttcacaaaataagatatacaaatgacgattaagcacatgaaaatatgttcagcatcatcaaagaagtgcaaatgacaccaccaatgaggtatcaccacacaagcactagaatggctaaaatgtaacaatattagatgttaataaagccatagagcatctggaactcctatatattgctgtgggaggaatgtaaaattataaaacaacattggaaaagaggttcacagttttgtatagcgctaattacatacctgataatataactcctaagacttgataggaatagagaaatataaacatgtccatgcgaacactgtgtttaaataatcatagcaattttattcttcatagccccaaactggaacaacccaaatgtactttaatagttgaatgtattaaaaaattgtgatatatccatacgatatagaatgatagatactattagaatgatagaatattattcagagatgaaaaggaatgtattactgatataagcaacatgactatacctccaaaacatgttgcaaagtgaaagaagccagacacaaaagattactattttattattgtatttacatgaaatatgagaatagttataatctatagtgacaaaattagatcagcagttgcctttttctgggaatggaggttgggggatttattgcaaaaggtcagaaagaaaactttttgagattatagaaatagactatgtattgggtactttgtcagatgagtatttacatctaaaaaatgtttcaaatgagcatatttattgtgtgtaaattgtaccttatttaggtttatttggaaaaaatatagctctaaatatactggttcattttaatttgggttaaatatttaagaattttttccatgtgctgaatcaaacaagtagagttgacagtggagatcatagtcttattctcaaggcattttcatgtaaaataggaactcaggtaactgcagtaactgcagaaaagcaggtacaaatattgattataaaatcctgggaaaatgtaaagaggaaggggatagagggaacatggtatattttcattccacaattagagttagcagctgcatcattctgattttcctttttataaatattttttattatttattagattaactaatttgagttgaggccacaacatggttgagtaaaaataatcattttcctttttataaatattcaataaaacttttcctttttataaatattttttattatttattagattaactaatttgagttgaggccacaacgtggttgagtaaaaataatcattctgagaatagcaataggtttagaaggttaatttagggtgcctctctgctattagatgtacctgaaaaacacttctaggcaaaattagaccaaattaaaaacactggggcttcaattataataaactctcaaatataagttttattattgtttattataataataaataatgtataagtgtgcagacatgggcagactacattttgcaaatttccacagtaaggtaaaaggattacaaagctttctggtataatattaacagaactaaaagacatgaataatattaaagaatgggctttggctagtgattttcaatcaattctcttcaaagcaatactctcttaattttactgaaagaaaattcaactttaatataatatttagataaatcaatacatcttaactataaaaaagaaaactatctatataagacaatatgtatttcaacatataaatgcttgggtaaaacttccttaggaggcaaaataaaataaaagtttgcacctattcttagatgaccccagtgtaatcgatgggatgttgatattgtgctggtgactcaagtaccatgggcaaggttgttatcagtgatgtgcttctctgaaagtacatctttacacccattgacaaatgggtgtaaaatccaaaaacacaaagtaaattatcttctcaatgtatatagtagatgcatcctagaaaaaaacaaacaaacaaacaaaaaacacacacaaaaatttgatgtggaaacaaacttaaattaggtttcaaatataaggcaaggttttgttgttttgtttgtttgtttactcactacataaatgaccagtggcccattcagaagtctaaggacaaaatatgttgtaggactgtcctgaccactgagggacagctcacaccctgacccaacagtacactaatgcctgcagtacccaccgttcccggagtaaaccaaaagacatcctgcgactcacaaaatccattatggagttgttttaaaccttatgagaaccactgacctaggccataaaaaacaaatgaaaaaacaacaaaaactaggaatggcagtagttctgttgagttaaagaggagaaagaggagaaaccaggactggaagagatgaaattgtgagtctggaaggaaactattgcaaaggcctttattacctttaagtaaatgtctcctaactgaactgaaagccttcattctaaccattagtttggtcaggaacatttcagggacgccagggtggctgttttattttgcacttcctttactgccctcccagcagcctacctagcagtaagttccccagcctgcagtgtccccagagggcaccttccctcggctagtaacttctcagacactctggccttggggatgtcttggatcttctaggtacacagtggctgcacacagttttgccaggcctttctcaagaggtaaaagttcctagctgtttgcatttcccagaaataatgttttccatgtgtagggattttacagatttcaaagtgctttcatgtcaattactttctttaatttaaaagaagttcagataccaggtcaagctaggaatgatccggtctcagagggaaggagcgctctaggaaaggaggatcctttaatagagggccgtcctggggccgcgtgcccatggaaggcgagagtggaggagtgtcctctttctcccccaccctcaggcggcggcccggccaaagccagagggggctgtctcctcctcttccccagcagctgctgctcgctcagctcacaagccaaggccaggggacagggcggcagcgactcctctggctcccgagaagtggatccggtcgcggccactacgatgccgggagccgccggggtcctcctccttctgctgctctccggaggcctcgggggcgtacaggcgcagcggccgcagcagcagcggcagtcacaggcacatcagcaaagaggtacagtcgaggcatgggcttgggttgcatcctttgccgggaccgagattcctcacttcttccactcttccgagagttgctgtctgtggactgccgtcttgcttcgccttcagagagtgcgctctggggcaagaggaacttgaagcaagttcaagttcaatgccatgagagcgtagtgtagggggaattacctaagtcctgcaaaaggaacggggagtgcttttcattgttctttagtttcgaagaggtcttgctatcacgatacatcccgtaaattgatttctgaaatctttccaagaggaaaactttttccaattggaaaaaaaagaatttcttcaaatcagagcccatcctgcagagaaaggcttcccaagctgtgtggttcatcctgggactttatggagggtagctgatgcatcaaaaaaaaattatatatatatatatacacacacacacacacacacacacacacacacacatatatatatatataaagttttacagaactttgttttcaacttttaaaacaggatttctaaagaagttatgtggttttttttctttcatggcaatggcgcctccagcctcacctttttcaaacccacatcttatcttcatatcctattttattgtagtgaaatcgtgaaatttctccttttgcttaaatacagaggagacttctatgtcatgtgtactttaaggccacagtgactagatatacactttggaggactttggaagatggctgtatttaatgtaacttaaataacttattctcctcagagcctcttagtgtttatgtatatatagctctcatttctgaaactttggggagtctttgaagagttattttattatcatgaattttacaggaagcacatgtgcagcattgtaagacatactttgtaacacattatttcagcaaacaattctttaagttggaaaacctgtatcaaagtaaaaaaaaaagaaatatttattattcggttttaaatatgaaaatgtttaacctaagagtacaaaatctgtaggttagaagcttttaaaagttttaatgaggctgaatctgcttaagttttgaagtatacttatccttcttccagttaacttctagccaagtcaatagttctgatatttgttcttataatctagcatttttagcagtactattttttaaggagtaaagagatatcccaagctctttctataataataactccctgattaaaattcttggaataaaaatgaccttgcattcactatataacttttttccttctatttttgcttttgcttctctgagaggtaaaatggggccaatatgacttaattaatataatttacgagagtgattttaagagtatctctggccacttatttttaaaaattctacttttaactattaaactttgctcaattacaaggtgtgtttaaacaagacataatactttaataatgttaggcagctgggagaaatgaggggccaggggcaccaatccttatgtccacttggaatggggcagaaactcaaagcatgcagagtaaggatcaagtaaattgttgctaagaattatcctgaacacacacaggatttctcttttttcctctcccttcttatttactctcttttcaaataaggtaatattaactctgatttctatgacccaggcacaagatgaagtgaattcaggaggaagggtttatactaccattctgtcaagataccacttaaatgctacatacaataaggaattttattcaaaatagctacaacatacaatctactataggctgctataatctgcattctagtatatattattgtctttgtcatagaccatttacaatatatctggaggttggctcaaggataaatgacttaaacctgttaatgttgaaagtatgtaaaattcatgaaactttaaaattggatagtgatttatgatttaaaaatgccttatgtacacgatctttattcaccttcagatattattattctcaaaggacaaatttagaacttaggcttccagtagttgtaatttaagtttacataataataactttatttcaacaactaaaacacttccggtattgtttgtgctgaattcccttttttatggttccaaggtttctttccattaattgtttaggccatgttttctttttagtgttgttccattgaagcaagccctctgtgaaaatcacgggatatgagtttgactggagaagggttttcctggctatgatcaacttttctgttttcgattatactagcactgacctttctaggcaagcgctaattgtgtagaagttctatttccccttataattcgataccactttattaagaatttttgacatgaatcaaccatttttagatgttgcagttgagttagaaacataaccagactttttgttttttactttttctttgaaatcttatgtggtttctatagcatactcgattgtagtatgaatagcattgattcagcaagaatgatattccaaggaaattctttagctatatttaaaattgacgaaatagaatgatgcaatcaaaatgattctgcatttcagcaaggcagtgtctaaaatgttttctgatattcttgtgaataatatgtggaaactgaagcataatggcaggtaaattgcaactgattgaaaaatagttcacaaagaatattgcatagtggattaaggtcaatccggaaagaagtctctagcagtgcaacagaggttttcttatactcaactatcttggtaatggcttgatggaaaatgtaaaatccaagcttatcagaactgcatgtggtccaaaattgatagaggtggctaagctggttactaacaagttcagaaattttaaaggtctctatagccttgaccatgaatggcacctacatgaagttgcttttattattcatatccacatgttaaaaaaaaaaagtccatttgtgctcttctggaaattagttacattgtttatatgtttaggaatgaatatgaagacaggaagagaaaggccactctgaattgcagcaagttcgatatgaacatatagtgtaatatggtgacaaaaaaggttggctcacttttacacaaaactcatagaagcacataggtctgttgcttaacacacatttgggtatttcattgacaaatgggtgtagatgcagagaagggagagcagaatggttaagagtctgagaagattttcagaagaggaatgtcccaagtaaaatctttccatctgaacaaggaaagatttagggaaggcaatcataaggactgtcctcaaattttcagaagagtcgttatgttaaagagggactattctaaaggctgaaggtggatccatagaagaacatgacaaacaaccaggtttgaattttataatatggagaaaatagctcctctcctcacttcctccccatgccattttgagttgttcagaaatagctgaattgtgtttgagcaacttgcttctggaaatgaccatgcagtgatcagatgtacagttagtgagggatgctttatgagggaatgcctctactgagaggaagttaagactcatcaactgtctagccatttgtcagttctaagattctaatattatagtctattgcttttagagtgcatacttgcatttaaatttctgaattcttaaaatgtcaagaaaatgttaaatatataaaaatgtgtttttaaatcccttctgggatttaaaataaaaacatgtttgagacaatcctcacacatttttggcaagaatacttagatatttagcatggattttccacatcatcgtcaattgcacagttctaaaacatcttgtgttataacacgcaagaatactttataaattacctgagaaattttcaggggattcatagtggccataaacctggaattaatttttttaaatatttttctttgctgcatatgttaactttttggcttgtttgccatatactgacctaatcatttagtaaaaatgattcataacagataaaatgcatggcatttcaacatattcaaaatatttatatgaacatattcaacactgaatattatagatgtgatagaattaataaaatttatataaattttatattatgttatatttcacatatcaatgtgtacagatttctggtctatcttaagatttttctaccctaggatttcatgcaaactaatgaactgaatctatatcaagggatgctgggggctgggcaaggtggctcactcctgtaatcgcagcactttgggaggcctaggtgggtggatcaccttaggtcaggagttcaagaccagcctgaccaacataacggaaaccgtgtctctactaaaaatacaaaaattagccaggcgtggtggcatgtgcctgtaatcccagctactcaggaggctgaggcaggagaatcacttgaaccctggaggcagaggttgcagtgagccgagatcgtgtcattgcactccagcctgggcaacagagggagactctatctcaaacaaaacaaaacaaaacaaaacaaaaatttaaaaagatttgcaacttatcatctatccagtttgcagtagggccttatttagcatctagaaaccatgtgaaaaagatcaggaagaaattattgtaaataattattgtaaatggttgcacaagtggtttaacttctaatctagaagattcgggtttaggatttgtttacagttgcaacttgagcctcgatagctaaacaggaatttaggcagaagctccgtttcagtaaatgagaaaacaagacagagtttagagaaagataaaagtagattttccaggcttagtatataccaagcagatagaaataaaactaattctaggctttccccattggtaagactgaatttagaggtcagaagttgtgaaggaaattggtggggttgggcctatatgcattggaatgtggtaaatgaatgaatgtttacagtgagtaaagaagataaaaaaattcctgctcttgtggaactaatatttagttgggatggagatgagcagacaggactatgatgaatatatgatgaagcaacaaaagaacacctatattgtataaaatgtagttgatgaaaaatgtcctggacaaacaaatacaacggggtaaggacagtcaggagttctaggaatggagggaggttgatggctattttgttggtaaaggttggtaaaggttgacctctttgagaggatctcactttggcaaacacttgaagatgacgtgggagtgatttgtgcagttatcagggggaagagtactctctgtacagggagcaggcctatgaggatctaagcttggagcatggtgagaaggctcagaggagaaatgggaaactggaacacatagcattgttgaccttaattttaaagattttgcctttttgtctgagtgagatgaggaggcatcggtgagttttaacagagttaaataaatgaataaaatcacaggtttttttgtctcaaatacgcactaatccatgggactagaccaacagtccaagcatagaattattttagatttatctcttgtcccaaacactccactgatagaacacatttaagtgattctacattcaagagcattccacttcaaccatcttatcatggtgaagctcagatgtgtctttgtaacactcttttcttccctttggcaactcagtgctattccattattcaaaatatatcagtacctcagaaacaatttgtgtgcagggaacttccgcagcttttaaaaattttgctccagtgtagttagaaatatgacagatttttaagggtaattttaaatagtatgcactttaaaacaaaaatgaattattcacaatcccacatggacatataggtactttggagttcccttttttattatctatttcaatctcagacgctaaagtttagacacaattgttgaaaatgacatagtgatgtattgatctgatgatttcttttatgatatgaaatttgaaatgctacctgttttacattcagaaacttattctatgttctgtttccatttttgttactgttttaagaatcacttgtaagctttaacaataacgttttggactatagtaatgcaattttggcctaatttaattctgtcatttagaacaaaaaaggtaaaaaaattggatagcttttccttctctctccctctcttctctttctcccttcctttcttccttcctccctttctttattttccttttcccttagtattcttcctgtgaataaaataaggtaattaaaatagataattctaacaaatataacatttaggaagatagtaaggcaaaactttacttaaatcttccttattaaaagccacaggtaattactatctaaagatagtttgagacatattttcagggtgagttaaagctaaagacatttgcttgtcaaagatgtataatatgggtttaaaaatgtttttctcctaagtaatcttgagtgtggatcttaatatgggaactttatgctatttggattttatttggacacgtgacatttacaaaagatcattgaggattgcctattaatgggttattattcataatatcggcctctgtgacatgcctaatctagttcaaacaacaagttaatctatgcaaattcctgatgatgaaaacctcaggagctatttagtgcctggcacttaggaaatgtaccttgtgcaatgttaagtatgtctctgtatgtgtagtccactcaactgacccccgaactgtgtacctccccaaggctcttcatttagctgcgtcttgagtgccagatggtttagattggtataataatatgtagtgcattgtgagcattaacacatttacttacgtagcagagctgtttagtagattaatataattatcctcagtttgtagaaggaaaatatgcccagcaacttgtcaaggacaaacaaaaattccaatgcttattttagaattagaaattaaattacggtcctgctcttgactttgtagatgctaactatcacctcttttggacttttatatatttatctttcataaaataccctgaggaaaaaaaaatccatttctaagttatgttagtctatcatatccagagattcatttggtattatggaagaacaaaaaataaaatgtgtagtcttgaagggtctttttcatttaaatacacacacacacacacacacacacacatgctgcttattactatgtagacatatacacacatgtattacttaaaactatgcattaattcaaatgcattcatcaaattttagtgtttacattcttggaactttgattactggacactaggctataagaaaatattaattgattctttattggcttttctgaagtaactttacagaagttacttcagcaagctagaaacaacggtatttattatactgtataatgaaccctttaagaatagtcaatgtgtaaatgtcagtgaatgaaaagaacaagaaccaaacagatatacctaagaatcagagcaagattaatctcaaaattccttctgaaaagatgaaaaaccttgacatcttcataaaaacatttaaagactttcatttgaagttgaactcagttaagacaaaagtcttccaatctcccagattttgagagggtgtatttgtgtatgtatgtgattgcagcaccagtgcacatgtaccatttacagcctagcactcacaggacctaatttgtatatttagtatgttttctgtttgatttttgttgtcttaaggtattagattttgtttatcaaaatctttgaataagaaaatctaaaaattgaatttctagaaaactctagttgccttgacaaatgattatggaccaaagaataaattataaatgagacaattataatattccatccagtagctatactgttaaaattccaaggtataatccctttcgagttgcttgtaacttagaaggtcctattctatagaagaaatagagttagtagagtttgctgcatcaaatatattttttcaaatgcctacatattatagttgacacaatttcctggctttattgccttctgtgcaattttcaattattggatgaggctgaaagtttgaaagagaatatgaagcagtgcaattgtcatttcagtgagctacctcatctcattggtttgtcgtggtacatatgtaaaacactgaatataaaacatgaaacatctagtaaggcctcaataaatgttcattttcaaaatgcctcaaaaaatgaattaaacctaacaacctaacatgacattctctggctgaaagaaacactcttctccaacatcatgtggtataccaaattcagttgagactgtttgtgaaggaaggaatttgcttatatacttaaacacacaagtatttgaattctaattagaatttgtgctgcagtatttctttattctcaactttatagcttagcctacaataaaaactcttatcaatacgtacctctttatacctttagtttccacatacagtactcttctttggaggtaactgaatcgtagaaaacgtatggacttaggagaaggctagactcggatccatagccaagtcaccactttactaagatcaaaagcctgagtcaacggagttaaattttctattcgtaagataggtttaggttagataataaatgtgaaaatacttgccagctaatcagtaaatactagctcttttcttctttattttatgagcataaaactaaaaaaaaagatttgctttgcatatagcatatcctttttgcttaagaacagcaaaatattctaaaaatttctttgaggagaccctaagagactatagatggcaaactatttatctcattgccaagagattgaataattctgtcgaggttacacagcaagtcagtaacagagataagaagaaacacaagttcctataattagctaacagttatgttagtagctctgtgtgagaagtgatttaaaacaggcaacatgatggaaatttttgcaataatttgtagttattcatacttcaaatgtggtacaataaacgttttttctaggaatctcattgttgaatatgtatttattttgttgataaactattttttaaaaacttctttaatacttataatatgtttagataaatatatggcatatagtaagcacttcataaaggttagttattattcttagtctatgaagtatatgttttcattgacatctgcttgggtagagatgacaatgtggcgtgtttgacacacaatgtaagttaatttcagcatggccttcagtggaaagtctaattggattgcagaaaatctctcaatatagattgtctttatttggactctccctaattactatagtaaaaaaaattcttggaatacattatttaatacaactctggatagggaggattcttagtgtgtctacttgtgtattaaatttttagtgtgtctattttgtattaaatctactattaaaaaaaccaccaaaaaacaaaaccaaaaaacctacttcagaaaatcatatagtactctaacaaatctctagagaaaactgcttttctaaacttgggaacgctggattttgaaaatatttcagacaaaacacttcttaaaggcccgtttaccatcaaaaagtttcaatcttgcctaacacataatgtgcaaatattcattttttcattctgatacattagaaaagtcactggatttgtaattggaattccaaaatataaattttccctctagctcttcctaaagagattaccttaaacatggataagtcacttaactattctgaaattcaattttccatctaaaaaatgacaatgtaatgttcgaatctatttcatggggttgttataagggttaaataaggcagaccatacaaataccattattaatactatttgttattataataaatgacagagttggtcttaggcatcattggttatgaagttttgctccaccccctttctttgttttttttccccagtggctcctaaccatttgttattaattaataatgttatgtattaatatacatatatgtattaataatgttgttaataatgttatgtattaatatacttagttctcctgttttcaaggacccatgacacatagctttcaaacatggcacaaattatttgtttagtaaacatatacatactactgcataagaagaaaatatggtatctgaaagtgtacatcagcttcctacaaacaagtagcaaagagtaagtattcagtgaaattataaaactatcataaaaatagcctaagggctctgaaacattctatgtcaagattcctttttatcctcttaaaaataattgaaactttgatttatggtatatctactatttgattgtattaaaattaaaattgggaaatttaaaaatgtttactaattaatttaaaataccagtaataaaacaattacatgttgacaaaaagaacataactttatgaaaaataattttatatccaaaataaaactcttcaatgtctggcttaatagaagagaactggattctcatttctgcctctgcgttcaaattattacatgttattttagtttaaattattttggtttaagcatattaagaaatatataacaacaaacatagataagctattggaaaaaagaggagtctgtcagtgccttttaagatagctgtaaatattctttgattctataccaaaactcagtaagtggtagttttcaaaagattggctgcagtgtggtatctgaaactgcatcaacgatatttttgtacgcttttatattaaaatctacggatctatcttacacctggaaagaattttacccatgtgtgatgttatagtatcattcatagatcatttggaagatactgatttactagttatgcagatcagccacaacttgacagattttcttataaaatattttaattacattttttatgactattgatctcaccagaaaagtccctaaatattagaagctgttaatctcacaatggtagagacaaatttttcagaatttttattttcatttgtaagtttctgtagttattgacaaattttgttatttttcttgaaatagttactttattcattcttaagaaaatgtttatcaaacaaatgagtcttaaaaaccatagttagatcctttttgtagtacatagggtattccacgaaaaaagtggctagtttagcttgcagctgaaaacaactgtacaaatgcttttcctcaaatcaaccatcatgcttcagtatacagttgatgttaaaaagatgtacccaagatttaataaatttaatcattgttactacttcatcaagtacattcatctgtgaaactagttgtttttttcttctgggagtgtgtggtggtgaaaactaaactgaccactagcatggtttagtacccctgccttgatttgtgctaatgtaccatcagtgtttcccaccactattgcttttgcaccatcagtgcacatgtcaacacaatgaaaaggcagataataattaaatcttgttactaaaaggatttttgaacttgtgtacctatggataatgtattgtggactcccagggattcacagatctttctttgagctctacagggttggactacagttaagttcctcactgcctgcctcttcaccaattctacaaaatctatagccatatgaaggtaaattttgcaatcagaaaaagccaaaaccacttcagtttttacctcaggtctagtctaggagagtgataccatttctttttaagggggaagaaatccagaaaagcttcttctgtggaaaaagcaggaagtgttaaaaccagccagacatacatatagaaatcaaaatctctgccatatcatctgcccttcttaatttcctttcacttgcccaaactatagtagagatagtgtacttacccacagttggacatatgatgttattcctaatagacttaaaaagtgaactcatggcggggcgcggtggctcacgcctgtaatcccagcactttgggaggccggggcgggtggatcacgaggtcaggagatcgagaccatcctggctaacatggtgaaaccctgtctctactaaaaaaaaaaaaaaaaaaaaaaagcaaaaattagccgggcgtggtggcgggcgcttgtagtgccaggtactctggaggctgaggcaggagaatggcgtgaatccgggaggaggagcttgcagtgagccgagattgcgccactgcactccagcttgggcaacagagcgagactccgtgaactcatgagcaaggtttagtacaaaggaaacatactaatatctgtaattctgaatattagcagaagagatttttattccttgctgagctcctgaactcacatcaggaggggtcctttgttcttttcatagaaagaattcctgttggaagcactggatatcgtatttctcaaaatatggaatttccttcatttatttctagcctttgaagttttgtgatttctaaagcatttaaaaggttttgtaatgttgagaacctaaaacgtgattcttttctctgtgcccatctcataccattgtatgtgtgtcatatgatggatctggtttctttttcttatttgttgggagatgtccagagactcaaggatctatcctttgaccaaatttttcactcttcaagggcctcatactgctctgatttcagatgtatagatatattgcttatcaaacactgatgggtctgaacatgagtggtagtaagatatttccagattaagtagacaaattgtgcagaactttttagtatcactatttaaatgactaaatttttgaggtttatgtgtatccagcccaatatgtcctctccttatctagtataatttatctttaaaaattagactggcttggcatatgtcagattttgtatttaacagactttttatatatttctttgttaggaggtgttcaatgttagacaaagtgaacagattactttggaatccatgtcctggtcctgctgaataacatgtcctcaccctccttccatttttttttttttctgccatacacattccagtaacactgaaagagttaattgatgtgtcccatctttattgcttttgtaaatagctatagatacactttatatgtagataatggtatgttttaaaattctgcaaaaatagcttttcaattctctttattctctttctcaagctttgataaaatatttttcattcaacttttagggactgattttctccatagagttcctgatgtggtgctactggagtgatgctgagaaaacattattctaaatgttttttagaaacattttttagaaaacatcattcacccagaatctgaaattttatctttatttatttattcctttggataaaacattgccctcacaggctattcttttctaaaatgtttgctgtgctgttattattcactttaatggaaattaatttatctgctgacctcctttttgacagtttaggactgtattaagttttcagatctgctcggtgagaaatagtgaaataaaactagttaacatctatggaatacctaactatgggccagcactgctgtaagcatgtctcatgccttaatttatcaaaggtagatgctattaatctcatttaacagaagagaaaactgaaatgcaaaatgttaagtaactttccaaaagtaaaacaaccagtgaactggtagagaccaagatttggacctaggtagttctactttgtggcccattcacctacccatggcagcgtgtgacctcaaccctgaaagagtacaaattagtaagtaaagggcttcctttagtgacatacttcagaggtgattttatttcccttttttgtgagatttcctatgaaaagattaacaatttaaacaatatttgccatttagattcagcactatgtcctgatatatcagaagagtctatgaactttttttttttaaagactccttggagatagcaatgaatgaattcttaactgtgtcaggcatgcctgaattttttgagtcatataagagtttgtagcactcctagaattgttaacttaattggtaagaatgtgctttttttctctttgttgttgtatgaagtgttaaaccaaaaataatcaaggcccagggcttttcctggtccattaatggatatatgacaagtgatggcaaaaggatagttacagttattaacttaatcattaattggctcagggtatccccaaaaccgcagttggaactgaagtgctacaaaaatgaccattttgttgttatagcttttcttcacataaggaaataaataagcaaaaagagggagtgtcttatctatttgttgatcaaagatcttgtaattctgcttatggtaactcccagagtagagaatatcatccagttggccccctttatgaacttggattgcaatggaagtcctatcggccagtttactagttaacaggagctgtagtactagagctatgactgcatcagaagtccagcagtgtgggcacaaagcagcgcagcacttttgaagttagacatcgagagtttgagtcctagattcacaccttgctggctgagtgctgttgcaatagtgctgttgagtgagttatttaacttctttaaacctgatcatcctcacctttaagagaatgaaaatagtagtgcctttttaaggattaaatggaattaagtatttaatttgtattcagaagaggatggaatcatcattcaaagactttacaatcagtggtgttttcagcatggacaactggagctttaacttaaaagatctagaaactgggcttgttggccacagttttagtgtgattagaggtggtcatagggtagtcaaagttgccactatcctggttatggatggtaatagaactgcctatttatttgatgtcttcacttagttgtctcctaggtccttcacagcgaacatttgccaggattgaacataggtactctgcatttcctcaactcttttcccatcagcttttcccaactcagaaaatggtaccatcattcaccccttgaatcaaatttgacatctagaagttactattaacttctctctttccttcacctcccagattgaaataatcagcatgtctgtcatccacaccaccagagtttattccataaatatccacatctttttgtccctattgccttctagaccacagcactctttttttgcctatgcaacttcagcagcctcccagctgctctcccttcttttctcttttccattttacaatcaattttccatgcaataggcaaagtgaactctgaaaatagtaaatcagattagatctttcctctgcttaaaacctttcaatgcatttctattataagaataaattctaaattcattagattttaagtctattcatgacagctcttgtatttttctctgatttcaaattattctctttttctgttatttaccagcaacagtaaagactttttttccgtctcaaggcctttgtccttgctgttcctctgtccagagcattgttccattagatccctgatggctgtctccttctcaatattccaatctcatgtcaaatgtcacctcttacagaggcctttccagaggaccactttaaattagcttctgtcaggcactcatctccctgttgtaatttctttgaacaattaaatgtttatcttgaatacccttgtttatttacttttcttctttgttgtttgtctccccagactgttggaatataaattttgttataaaatggccttcatctccagagctgaggagatacataaatattttttattttgaattaacacatggctgtgttcaggctcttctgaatgtaattccatggaggaggtcaaaattggattcctgtatgtagtgaatctgtcccgtttatgattttcagttatataattagttagaagaccaatccaatcatatttcagataaacctcaagagcaattgctatggcagagaactagaagggtatttaatcaactagttccttttccaagatctttagctctttaacagttataaattaataaagtatgttatataatgctaggactttttgtctttcattgtttctgttgctttatctccagcttctagtctgacatatggtaggcactcaaaaattggatgaagaagcagctctttttggacagaccaagagtgttgccttttaaaacattttatgtgtactttttccccctgatccttttatagtatgaatgaatgtttgtataagacataaatttctacaaatactgaaacacagtatggacagatatgagttattattattaatatcacctagataatagataaaatattttagaaagtgaggctaccttaaattatcttgcttcttgagttttttttttcccctctaaggatattccagtaagagttgagcagtatttaagctttggataaggaatgcatatttcttggcttagtcagaacttttctggatggaaggtctttttggatgagaattatactacataagattaaaatgcccatttaagatgtaaattatagggataaaatatagataactcacatggggtgatttgattggcatctgttttcatttttctttgtttctttttagataccaccaaagtccttcctatttcaggcaaaaagatatgttttaaaaaccactcacaaggcctctacaatatgtcagataatgcatgtgcgtgaatgtccttggatgtgtatggtctcttgcttgaagttatcagccagcaaaatggtgaaatacttagaattaatcaaacatctggaggtcaagaaacgcagtacctatattcttctccttactttaagaatgaaactaataaaaaataaggcggagctggcccttcagcaaaggagggatttttattatatgagtgaatttgagagaaagggggacaagaaaagacctttgagatcagggcccaggtctgttttgttactactgtatccttactgcatagcacagtgcctggcacctagcatggtcacagtaaagattgaatgatagaaaaatagaaaaggaagagctaacttttaggaaggaacacttacttcccacttacagttattgaaaaaactatgaagatggttaacatcatgatactgtcggatgtaggcagttacaatttctactcaacgatagaaaaaagaactaaagagaatttaccaggacatgaaagaaaggtgtaagatcatggattcctgaaacaggatgttccaattaaatatttaaatttaagtgaggattgtaggagtttaacagctatttaaaatacgccctgctgctttccttcctaggttctccacaccttcaaagctcatcacttggataagattgcctctttactttttccaaatcaatctggttcatccattttttgcaaaaatgaaaactcccctctttcactaaggtatttgagccatcaagaacaccctcctgtctaggcatggtggctcacagctataatcccagctctttggaaggccaaggcaggaggatggcttgaggccaggagttcaagaccagcttaggcaaaatagtgagatccctgcctctacaaaaataaaatgaaaaaattagctgcgtgtggtggcacatgccagtggtcccagctactcaggaggctgagatgggaagattacttgaacccgggaggtcgaggctgcagtgacccatgatcacaccactgcactttagcctgggcaacagagcaagaccttatctaggaacaataaaaaattcattattcattatttgatccaaaacaaaaacatgttatagactatctatagattcaattttcaaaaatcctatgcttctcatctctaaatattgttataatactgcaattttcaaattagctttcacctttaagaaatgctactttccatattggaatgaataattaatatagaaccaaaatgcatgtctgggatttagaaaatcttgggattctgtttccatccttgcttattttttattaagctaagtcattcattttaagaaatgatcccctttaccccaactatagaggtatatactaccttatatactaccatacttaaaaggttagtgaagaggcatagaaagagtagtgaaacagtgaaaccttctagatgccagatgctatacaaatgtgaagcatatgacaccagcatggtgaaaaaggaagctaattaagaccatcagatagtatttgattttatctctccatagaaatcatgataactatgttacatagttactgaaatttagacattaagtttgtggaatctctctgacagttatattagctaatcactaaacagaaattttaaaagaagtatttaatattaattctcaagtcttaggagaatatttagctaataattctacagttgactgcagagtttattcattatttaattcataatgtcttttcaatcactttactgtttcttgattcatgaagaatacatgccaagtgtattagtctgttctcacactgctgtaaagaactggccaagactgggcaatttacaaagaggtttaattgactcagttccacctggctggggaggcctcaggaaacttacaatcatgacagaagggaaagcaaacacattcttcttcatgatgtcaggaaggagaagtgcagagcgaagtgggggaaaagccccttataaaaccatcagacctcatgagactactcactatcctgagaacagcatgggggaatcactctcatgatctaatcaccttccaggaggtccctcccccaacacatggggattacaatttggattacaattcaagatgagattttgtgaggacactgagccagaccatatcactaagagaataaaaatggacacagaatgccactttcctattccctttaaatatttccagttgaaagtatttccatgacctagtgagttcttagagaattcaatcactattgatgtcccaactggtataataaaagaagaaaacacataattttgagacaaattccacctttctcacactctcagcatataaacacataatcgaagcaagaaaaatgagaaaaaatcaaatatataatatgatgaagaattttacactattcattatgacatgtggggccaaagtgacaaaagtaattggacaaaggtagactcagcaatgaggacttggaagaaatgagctttcagtcccattttaaagtagaagagaaggtagggtatcaaaagtagggtgcgctacgcaaagtggagggtgtttttgttgttgttgtttttagagacagggtctccctctgtcacccatctttgcccactgcagccttgaactactgggctcaagtgatcctcctgcctcagtctccctcagtgctgggattacaaatgtgagctacccaacacccaatgttttcttgattgtaaaagaaaattgatggtttctcatgttcaccagagggaaacatccattcattttatcaatgtgtttaaaataattcttactccttctttcactttaaagtgtttaactcatttttgcattctattcataaatatgaccagtcacaacttagaatatgtatactgtattatttcatattaacacacacattttgttcttctataatagatttgtgtatggtttcatatattagagtgttaaatattgaatttattgtaatttacttagtgaaatactgatgttaacatctagtatgtttatttgagggatataggaggcttacagtgaaatcatcctttcaccaagatttctttgtaagacactgttactggaattgtgctttgtgcattacatttcattgacgtaattttaaacttccattctacttcactacaaatggaatttcattatatctgactccacaataagtgggttccagaatcgttgacatttagtagaattacagatcttagtgtctttgtacattctgtattaaaatgcattatgtgtgctttcaattctgttttaaagaaattgccattgatttacatggttgtatggaagagttttgtttaaatgccattgcctgatttcctggtggcttttattttccttctgaaatcatttacaaatatttcttagggtattggctactgttggtttgaaatgagatacaacttatggattataaatatgtttgtgcaaattttctctagcagtaattctaaaacctttgtggacattaagctgtaattgtagctttctcttgcaagcttctttatcctctgctttattattcccttgtaggaaattaagtattttatataataatgcttagaacatctttctcttttaaagagggaaattaagataaagagcttggcaaatataggatctttcctggattgtatgtttctgagatttggtgacagagcgtctgctgtggaggatggggaaggacggatctgggctgaagaagtagacagagacagtggactttggttttaagaggcctgctgctgggatcttctcacccatccctagcagagctcagaagtaggcatccagctgcaggtaattgtgttttgggctcaaaggagcccttagagtgccagacctaaagaggcaactcccgataagagtttcaatagttttatccattctagaaccgccatttccttaagagtctgaggcccagggaccaacgcccaggacatatatacactttgataggaggaacatttcaaattcatccaggtcaagatcactcactaggtcttgtgcacctcctccgcctcttttctgtctggagttagtaaccacctcaaaagacagctttctgactcgtcattataccacctacagtcttacttttagcttggtttgagggtgtcctgttcattacttacagaaacagatttggagtgtgaatgcccttaacaccagttttaataagcatttttaattctacaataatgtgattcagagaatttttttttcctttgtctctatctccctagatagaaatatgtggaggttggatttcctgctgagtttctttatttttttcctttcttttttttttttttttttttaagatggagtctcaccctgttgcccaggctggagtgcaatggcgtgatcttggctcactgcaacctccgcctcccgggttcaagtgattctcctgcctcagcctcctgagtagctgggattacaggcgagcgccaccatgcctggctaatttattcttgtatttttagtagggatggggtttcactatgttggccaggctggtctcgaactcatgaccttgtgatctgcctgccttggcctcccaaagttctgggattacaggtgtgaaccacagtgcccagccttcctgctgagtttcttagcattattgccaggtcggaacttaggcatagtaacatgaaacatgttctgcatctgaaggccagaatataataagcattgttaatttagttaaaggaaaaggctgctgttgaaggttagacttcttgtgtatgtgtgggagataacagaataacgtctcttttccaagatgcatatggttttcttttgcttatgtgccaattttaatcaatggagaaattaatatgttaaatgaaataattaaccattttataattttagtcggatattggttgaccagtacttatatgatggtataaagttctagaaactggataactttaaaaatctttccatataatgcattatattctgggtcatagtttcctatattataactgctaaacaacataaaccaattttattttcaaaatcaatctttggggtaacttctacttagagccctgacctaataaatgatgtacgtgtttatttctgacacgtattttgataatcatttagattagtcttatttatgtggatatgtgtaataaaatttctttggaaaatatggtttattgagtttaaacctcttacctccatttcactttcctaaattttaactatttttttctgttccattgcaggcatagtaccaattctgtgtcaggcattttattcactttgtttcaactgttcttgagatcccggaggattaggactattgcagttataagtctataactgaggaaaggaagcttatctggacaggaagatatttagagtatgatataaagacagtctctttttaaaaacagcattttaaaggtataatttcttttttgtttgtttttttcgtttttttattttttatttttatttttttcttttattattatactttaagttttagggtacatgtgcacattgtgcaggttagttacatatgtatacatgtgccatgctggtgcgctgcacccactaactcgtcatctagcattaggtatatctcccaatgctatccctccccactccccccaccccacaacagtccccagagtgtgatgttccccttcctgtgtccatgtgatctcattgttcaattcccacctatgattgagaacatgcggtgtttggttttttattcttgtgatagtttgctgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctattgtgaatagtgccgcaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgactgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgcacagaagctctttagtttaattagatcccatttgtccattttggcttttgttgccattgcttttggtgttttagacatgaagtccttacccatgcctatgtcctgaatggtactgcctaggttttcttctagggtttttatggttttaggtctaacgtttaagtctttaatccatcttgaattgatttttgtataaggtgtaaggaagggatccagtttcagctttctacatatggctagccagtttccccagcaccatttattaaatagggaatcctttccccattgcttgtttttctcaggtttgtcaaagatcagatagttgtagatatgcagtgttatttctgagggctctgttctgttccattgatctatatctctgttttggtaccagtaccatgctgttttggttactgtagacttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctgtttgtctgttgttggtgtataagaatgcttgtgatttttgcacattgattttgtatcctgagactttgctgaagttgcttatcagcttaaggagattttggactgagacaatggggttttctagatatacaatcatgtcgtctgcaaagagggacaatttgacttcctcttttcctaattgaataccctttatttccttctcctgcctaattgccctggccagaacttccaacactatattgaataggagtggtgagagagggcatccctgtcttgtgccagttttcaaagggaatgcttccagtttttgccaattcagtatgatattcgctgtgggtttgtcatagatagctcttattattttgaaatatgtcccatcaatacctaatttattgagagtttttagcatgaagtgtggttgaattttgtcaacggccttttctgcatctattgagataatcatgtggtttttgtctttggccctgtttatatgctggattacatttactgatttgcgtatattgaaccagccttgcatcccagggatgaagcccacttgatcatggtggataagctttttgatgtgctgctggatttgttttgccagtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgtcacaatttcagatcctgttatttgtctattcagagattcaacttcttcctggtttagtcttgggagagtgtatgtgtcgaggaatttatccatttcttctagattttctagtttatttgcgtagaggtgtttatagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctgtctcttgtgggcatttagtgctataaatttccctctacacactgctttgaatgtgtcccagagattctggtatgttgtgtctttgttcttgtcggtttcaaagaacatctttatttctgccttcatttcgttatgtacccagtagtcattcaggagcaggttgttcagtttccatgtagttgagcagttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctatcaggtccgcttggtgcagagctgagttcaattcctgggtatccttgttgactttctgtctcgttgatctgtctagtgttgacagtggggtattaaagtctcccattattaatgtgtgggagtctaagtctctttgtaggtcactcaggacttgctttatgaatctgggtgctcctgtgttgggtgcgtatatatttaggttagttagctcttcttgttgaattgatccctttaccattatgtaatggccttctttgtctcttttgatctttgttggtttaaaatctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcatgatgatgttagctggttattttgctcgttagttgatgcagtttcttcctagtctcgatggtctttacattttggcatgattttgcagtggcttgtactggttgttcctttccatgtttagtgcttccttcaggagctcttttagggcaggcctggtggtgacaaaatctctcagcatttgcttgtctgtaaagtattttatttctccttcgcttatgaagcttagtttggctggatatgaaattctgggttgaaaattcttttctttaagaatgttgaatattggcccccactctcttctggcttgtagggtttctgccgagagatctgctgttagtctgatgggcttcccttccagggtaacccgtgctttctctctggctgcccttaacattttttccttcatttcaactttggtgaatctgacaattatgtgtcttggagttgcttttctcgagaagtatctttgtggccttctctgtatttcctgaatctgaacgttggcctgccttgctagattggggaagttctcctggataatatcctgcagagtgttttccaacttggtttcattctccccgtcactttcaggtacaccaatcagacgtggatttggtcttttcacatagtcccatatttcttggaggctttgctcatttctttttattcttttttctctaaacttcccttcttgcttcatttcattcatttcgtcttccattgctgataccctttcttccagttgatcgcatcggctcctgaggcttctgcattcttcacgtagttctcgagccttggttttcagctccatcagctcctttaagcatttctctgtattggttattctagttatacattcttctaaatttttttcaaagttttcaacttctttgcctttggtttgaatgtcctcccgtagctcagagtaatttgatcatctgaagccttcttctctcagctcgtcaaagtcgttctccgtctagcttcgttctgttgttggtgaggaactgcgttcctttggaggaggagaggcgctctgctttttagagtttccagtttttctgttctgttttttccccatctttgtggttttatctacttttggtctttgatgatggtgatgtacagatgggttcttggtgtggatgtcctttctgtttattagttttccttctaacagacaggaccctcaactgcaggtctgttggagtaccctgccatgtgaggtgtcagtgtgcccctgctggggggtgcctcccagttaggctgctcgggggtcaggggtcagggacccacttgaggaggcagtctgcccgttcttagatctccagctgcgtactgggagaaccactgctctcttcaaagctgtcagacagggacatttaagtctgcagaggttactgctgtctttttgtttgtctgtgccctgcccccagaggtggagcctacaaaggcaggcaggcctccttgagctgtggtgggctacacccagttcgagcttcccggctgctttgtttacctaatcaagcctgggcaatggcagacgcccctcccccagcctcgctgccgccttgcagtttgatctcagactgctgtgctagcaatcagtgagactccgtgggcgtagtaccttcccagccaggtgcaggatataatctcgtggttcgccgttttttaagcccgtcggaaaggcgcagtattcgggtgggagtgaccagattttccaggtgccgcccatcacccctttctttgactaggaaagggaactccctgaccccttgcgcttcccgagtgaggcaatgcctcaccctgcttcggctcacgcacggtgcgcgcacccactgacctgcgcccactgtctggcattccttagtgagatgaacccggtacctcagatggaaaagcagaaatcacctgtcttctgcgtcgctcacgctgggagctgtagaccggagctgttcctattcggccatcttggctcctcccctaaaggtataatttctataaaataaagtttttttacacataagaaatgtatgtgacatttgacaaatatatatatacccatataaccgtcagcccaacaacaacaaaaaatagaacatttctcctttcccagaaggccctcactgtttttttgctgtcttcttccacagccctgaaactcttatctgattagtttcatctgtcttagaatttcctttatatgaaacaccaactaagtacttttttctgtctgccttctttcacccagtctactgtctgtaaaaatcattcatgtttttgcatccatcaatattttgctccttttaatcgctaacattttccgttgaatgaatgtacctccatttttattttattggcctgttgatgacattaagactgtttccagtttttaattatcatgaataaagttgctatatacaagtcatgtacaagcttttttatggacatatgttttcatttgtcatgtttatctgggagtaaaattcctgggttgcatggaaaaaatgttcgtttaattttataatagacaaattgttttctaaatgaaggcatgatcttagtctagtaatgtttatttacttctatcaacatatgtgtttggtaagttaattttttggataatgaatgataccgtaatggatatttttttctcactacttcttcctttctccctctttttacacaattaaaaaactaaagataaaagttggctctatagggaaaggttttattttttacatttctggcaaatttgagatttctataaaattcttcataggtatataaaacagagtaagtatattttgtttaacttttaaagcagggtattattcatttgttagttgtttaaaatctactataattatgggtaaggcagtgatacaaaaggaagaaaagaaaaatcccaatttattcattaaataagaatgtgtcaatgcattttgaatgagaagtcattttaaactccaaatacaaagatgagcaagacgattttttaacctcaggaatggcatagtagggaaaaaagtaagtgtatgtatatcattagattcatacagtcaggctgaatgtggaaagggctttaagaaagttattaaaattgtttttacattctggggaagtagaaacatttccatctaacaggaacagggcagtttcacagaggagttggaatttggactgagttttgaacagaagagaatttcgatgggcagatcaggaaaagagcagttcaggaggagggaatggtgggctgtggagcatgggcgaccagaaaggcagattaagttaaaacagggttgacaaattgggagaacacaggattaagggactggaatttaagtttagatttgctttaataaagaaaaatgttactttgtgatgagagaaaataagctaaaaattaaaaatttaaaaaccaatccactctgagagattaattaaagtgaagatggggtctgctaatgtgttactgaagtgaactgcagagtacagtcactggcattgatgagtctagatgctgtgagaaagatcattagcgcattgacaattctaagtagctggagaccttttaaactttcaacttccatatttttagtaatttttcaaatgtgattaatttagcccatgaaaacacaccccatcattgatataaccaatcattataattatttattcgactggtgtactttgtctctaaatgacacatttctatgaaaaaaagatcagtttcactaactcctcaggcttctggctgtgacttttcataaatgtctgtatgaacgtaagctataactttgcttcattgttgtttagatgacattaataattggttttacttactgactatgggcattttaatacaagattccattttaaaagtgtgtacttgtagcttattgcaacacagtgaccaaagacaccatattcttacttctggaatcaatttgtgggcattgttaacagtatcttcacaactgcactagtcaagcaatcagagctaagctttcaaagcagattagaggaagcttattagcaataaaatatagtcaaaatataccaggcataatcatatttttatgtagtggaattacctcagcacatggagaatctaaattaaatgagtttataattgaggtttgtgtgcaagggaaaagaaaattcgtctgttatggaaacgctctatattttttacattatagccaaagtcttagttaccttttgagggtatctgtaggtgccattaaattcagctatcctcttctgctgtgggtataagcacatggcaaacccaggcaaaaattagaaaaataaaaaggattgtagagaaatggagatataaaaaattaataagagaagaggcaagctaactcccttatccatttttttcctcaaggttattaacagaaattatttccaacataaatgtccataaataattttgaaaatctagaaagaaattgcatttctactttaaaaatagctttctatggctgaaggtttgcttcagttgttttactgtcacaactcccaaaaaccagctggttctgggatgtcgtaacaatttgatacttcaaaccaatggtttgtgctcattggctccctggtgcaaacagggagataaatgctacttaaatagtaggtgaatgtaattttgcactttagaaaatgtctgcatgtttattagagaagtgaatgctgaaatcagcgaacaaaatgtaaagtgagcaactaagaaatacttataagggctcacttgtattatttaactgtgtaatcctctatctcatatatatgtaatactttcttcaagttcattatagctcccgggcccagtacatcctagtccagttccaaccatgtctaattttaaaatagctatgctcacttcaaacgaagatgttgctatagctttattttattttataggcttcaattttaaagttgtatcacctatagataacaaagacagctttcatggacacctcaatttagaagagtcttataggcactttgtgagataaactgtaagtgtatgtgctaatcagataattcttttactagagactttaggtgaagatagcaaatcttctaaaacagactgataattaaactgggttgatcattattgggttcattattatcaaattgaaatatgctttattttgtaatgtttaaaatgtgttcttaaattcagtagaatattaatattatattatacttttccatttttaaatcatattaaaaatagcaaaaatattacttcttcaaaaatgctttatacttcatgtatattactgattttaagtaaaagtacaattaagacaattagccagacctatttatgagtagctctaattggagcagcttgttgctggaccctattcagtggtagagataaggttgagatggctgaatagttcatctaatttgaaatactttggtgtcacatggaccttttcctgaataccatggctatgtactcactatttggccaaatgctgaaaatgaacatatatttgcctccgtcaaaatgttttgtaaatgttcactcagacattgacataaacaaggcagaaaggttaatggataaaaaattctttttctttaaaaaaatacatacacatacgaattttctctcttttagttgctaacctgctttttagattagtccatggttatcttggaagaggtgtgggagaacaaggtgagagctaaggaaggaattctatgcaaagcgtttctgattctcttagtattttgtggaacagcatgagacatgtcttccagttgtgtaggataagtacagcccactgaacactgcttaccagcagtttaccacaagccagttataacatcaaaaacatcggaaccctttcttttcttctatatttgaataatgataaatgccttcatgctgtgtgagcactattgaagtgtgtttctctgcaggtaaacttggcagtgtcttatataactacactcgatgggagtattacttaaacagtgtgaaatacattgtctgataaaaattgtatcacaatttggaatgacgtttatgcaagtggatagtctgccagttattttatagtctaaaaaaatgaacctgtaaggctacagtataaaatccaagtctttatagttgtatatttgtagtgaaaacaaccgtgggggaataatataagcttaatcatttggtgattagtctaccaactattaatgatgagagataacctatctgttctttatttctaaaataagatgtgtaatacagctaattagtcactattttaaaaggaatttaaatatagttttcattgaaattcaaatatttaattgcatgtgtacctaatgcctaattatttacatgttggctgatgttctctattatctaactgctgtgctgttcttaattgctgctagttcatctccgcccatctcccttggtgatgatagtcctgcatttcatggcaattttcaatagcagtttaatggtcttaagtgggtagcataatagccaggtgaacaacaaaaaaaacaaaaacaaaaacaaaaaaactatttggcaaattgggatatgagaattgaggccaaaacttttagtccttgccaattttttttaaaacttcaattatcttgattcatattcccatttgttgggttggtaggcactccaaaataaatataataatcagagagaacaccaactgtaggtactagttttagcaactgaaacaactggcgttaaaatcactgagcttctgttacatgaatacctgagtattatgtggctacttctgaaatggagtatgcagtgctcttataattgggcatttcagttgaacactgcttcagtaaagtaactggcatttcaagtcttccttctgtagtgattgctttgtctttattcaatgattgcttttttaagttagaatctggttgcatagtgctccatggttctttcctatgcagtggtgtttctcagtgttgatgtggagaagccaggagacatcctacaactctgagaagcatttgatgttggcagcagtggctgtgaggttagcccatgaacttagggctagaggtgagtcttaaccttccaattcagcatcttttccatctgaacattcaagtcaaatgggaaacctgttggccctccagctggatctttccactgttttaactggaatgaattggataagttataaggcagatggtaagattggatctgatgggatggagtttggtgaagtggaaacttttaagcattaggtttgagatagctagggagtgttgacctctctttccccctgacattatcctcacatttgtttttattccaccatatctaccttgatccacctgattcttttcatttttttctttcattctctttgtgctggctttctttccttttttaaaatcccatggtatctcatcatctcttcttgtcctcccattctacaaatagaacatgaaattgaagccttttttaaaaaaaaaaaaaactaattacagaattaatatatgtttactatgtacttactacaattagaaactatatataaacaaaaaagagagcttgcccatcaatccacatgcaaaattggttgagtaccttgaagatttgtaatagtatatagagaagaacattatttttcttaactatttaaaagtgtattctgcattctcaattaaaagtcattttatcttttactttttcttttattcctttttaagcaacaaatgaattaaatttcctttgttttatatatgacctattaacctcaatggagaaagaggctccctttgtttgcttcaggacttacatattgttacagttagtccttaggtaaatgaaatgagaagagcttcacatcagcactagttcttccccatggaattttagtttctccacaaccactttactgaatgtgtataattataagaattatttcattttcttacaactttttctctttattttatactctcaccctattatctgtcctttttcttttttttttctttctttctttctttctttctttctttttttttttttttttgagacaggctcttactccgttgcccaggctgaagtgcagtggcaggatcatggcttattgtgcccttgacatctcagtttcaagtgatactcccacttcagcctcttcactagctgggactacaggctcttgccaccccacctggctaatttttctattttttttgtaaagatggtactttgccatgttgctcagactgaactcctgggctcaaacaatcctccccacctcggcctcccatagtgctaggattataggcatgagccactgcacctggcttttatattcttaatatttcttgtttcttctatttattttctttactttaaactcgttgttataaagtggtatgggttaatcaagagtgatggaaagattagctctgtttttctgtgtgtgagtgaaagatttagaagtaagaaaatataattattcttcttcccaaagtaatgatgtttaccaaaacactggtaacattactttaaatttcctaaatttataattcaatttagtaaagtaggacttctgaaatggatttttagatatattggggaaaaacaattcaggatctaaggtaaactttttaggatgtatatatatttgcatgccattcatggttgtgtttatctgaaaacctaatacatttttatcataaaaatctacataattctaaatcatctcaagtgaaattagaattaatataaagaaataaacaaatattggaagttaaaattttcagatttattaggtgttaaactgaatttttcgtcttctactcctatcctcccgtaaacactatctagaaaattgtcacccaacctattgtagaactaaaaacctagtggtcttcctcatcttcattgtcttcattatttccactacacgaaacattcccttgtaacaaatataatattcacagcattgtgcaaaaaatgtacattttaaatttctagtataaaatttgatttgtgactctgagcccccagtttccttagggcaaacaatatgggtgctttcagttaattttagtccaatccagtaatttttcagttacttttccatttaaaacaagtagttcgaggttcagccttctgatcattttcctgatatggaatctgggagcagcagggaacataagtaatgtcacggtgtcaggattgggaggtgtgcattttggatcctgattaaatgtatcaacgtaggtaatatattgtgattgtttcaaatagtggagatcaggaatccttcctggtacaaattcagttccccacagtaacctcaaaattgacttcaaacctactgacttcaaatctgactcatgatgtttctcctctcccatcacttttcactgtgttctgctgatctccatactgtttcctcaatgatgggcccaaaaaatgctggaagttttcttctatttctctctttgagaatcatgaggcactcattgggattgtggttcttggattgtttccctctttgtatgtatttatgtatgagccatatacaatcaactgttctctcaatatcaagaggtagcaattttaaatgttctgtgttttaaactttaatgtataacttacgtcagtcaatcctgataataccactattctcactagtcatcaacatcattatcatcattgtcatcatcatgtaacaattatataatggttaatattggccacaaatcaatcctagttccttaaaatctattagttgagccttatgaaactgccctttttgtcggttcaaatggtgagtagaagcaatttcatatggttcaacttattattacttcaatttccttacaggcttacagccaacacagtgattcaggccaccatcatctcacaactagaaatcatcactgtggccttctaatggatattcttgcttgcaatttagccctcccccatttgtttgttgtacttcagctaggttaagctttataaaacacaatagtattgagctattcctctctctaaaatgctgtcatggcatctgattgaccttagtataaaatccaagctctgttaatgtgatttataagtcatgtagccgtacatcccagttagtctctgacagccctggtttacaactgctgccccagcctaattaatagtggtgttccctttattctcagaagtggactggtttagatgatgaattacatgaccaccttatttataatgtacctcatgctctgccctgtgcagttctctccagcctcatctctcaccactttttaaatcataaaaatgagctgtatccattctgaattcctttggatttatggaatatatcactgtctctttcagttcaaagcctgtgcccataatgttgtcactgcctaaaatatctctctgttaacctgactaatgcataccaattttcatgctcatttttcttttcttttttttttttttgacggagtcctgctctgtcacccaggctggagtgcagtgctgcgatctcagctcactgcaacctccacctcccgggttcaagcgattctccttcctcagcctctagagtagctgggactacaggcgtgtgccaccacgcccagctaatttttgtatttttagtagagacaggatttcaccatgttggccatgttggtctcgatctctcgacctcgcaattcgcccgcctcaggctcccaaagtgctgggattacaggcgtgagccaccgtgccggtccctcatgctccatttttatagtttctccaagaagcactttctgacctctagactagtttgaattttcctatttctgtacccatattggctctattcttcccctaatcaaacccttttcccaattaaccatgtttatatcctagtttatgtgcttccttttagcatgtaccattgtttctctagggccttataagtatttgttatacagacattacatatatatatatattatatatacatgtgtgtatatatatgcatatatatgcacacatgtatatgagagtatgtgtgtgcacatgttgaacaaattcatgagacaaaatacaactttaggttgcttttggactttgacatctgctcttgactttttatgttgagaaagggatgttgagagtatgaagcactatagcaagggagaagaaaagaaagagagaccagaaaagggctgattattgaatatcaagaaaggaacacatagaaaacaagtaagaggctttgaactgacaatttggatggacaactacattccatttctgatcatcgatcctgtctttgcactattgcttgcacttatcttagcaggggcacttaaaaagcctgaaacgcgtatcttgcctgcaatgtacaaacttatcagaacatctcatatagtaacataattttcagtataagtatagataggaattacgtttaaatttgagtaagtattggactaagattatctctccttttttaaaagttggtaagttatgttaaacaaaaacaaaacaatttctaaaatgatgactaaaagtaagggttgtttaaatccattttataagatttacttccagaagatgaaagtgggaagctgaagtggcatatcatttctaagctatttttgtaggttgaattgcatccttcaaaaagaaatgttgaagtcttaaccccaggtaactatgaatgtgaccttatttgcaaatagggtctttgcaaatataattaagttaaggtgatgtcatactggtttagggtggaccctgatccaatatgactggtatcatagaagaggggaggagatacagaaatacagggagaaagctgtgtaaagatggaggcagagatgggagtggtgcatccacaagccaagcaatgccaaggaaagaagcatggacattttttcttactgtgtctagaaggaaccaactaggctgacattttggtttcagagttacagcctcctgaactgtgaaatgaatgtctgttttttttttttttttattattattatactttaagttttagggtacatgtgcacaatgtgccgattagttacatatgtatacatgtgtcatgcttgtgcgctgcacccactaactcgtcatctagcattaggtatatctcccaatgctatcccttccccctccccccaccccacaacagtccccagagtgtgatgttccccttcctgtgtccatgtgttctcattgttcaattcccacctatgagtgagaatatgcggtgtttggttttttgtccttgtgatagtttactgagaatgatgatttccagtttcatccatggccctacaaagcacatgaactcatcattttttatggctgcatagtattccatggtgtatatgtgccacattttcttaatctagtctatctttgttggacatttgggttggttccaagtctttgctattgtgaaaaatgccacaataaacatacctgtgtatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcccctgttgtttcctgactttttaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtccttcgcccacttgttgatggggttgtttgtttttttcttgtaaatttgtttgagttcattgtagattctggatattagccctttgtcagatgagcaggttgcgaaaattttctcccattttgtcggttgcctgttcactctgctggtagtttcttttgctgtgcagaagctctttagtttaattagatcccatttgtccattttggcttttgttgccattgcttttggtgttttagacatgaagtctttgcccatgcctatgtcctgaatggtaatgcctaggttttcttctagtgtttttatggttttaggtctaacgtttaattctttaatccatcttgaattgatttttgtataaggtgtaaggaagggatccagtttcagctttctacatatggctagccagttttcccagcaccatttattaaatagggaatcctttccgcattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaactctgtgaagaaagtcattggtagcttgatgggaatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttagaatgtctgttgttttaagccacctagtttgtggtcatttattatggcagtcctagaaaactaagatacctaaattaggaaacaaatataactatattaaaaggggatagtatatccaatatatttaatacagaaaggatgaagatatagatagtagaatgatcagaggaataataatttttttcccactgttctcaatatcactgctaattcctataagaacacaattactcaatcactaatctgctgtagtagtctgattgatgctaagccatgctgcaggaatgaataaacccccaaatcttaaaatcttagcattatagaggtttatttctcaatgatgcaatgacaaatacaggtccatctggtgactcagggtcccagttgtcctccgcttatgatgtttccaactcaggaaatgccttttatggttgctatggcagaggaagagaggagtggggagctggcacctaggtcttcagtgcttcagctaggaagtcatagtcatgactctgctccacatttttacaatctaagaatagtcagatgcccctcttaactgcaaggggctgagaagtgtagggaacacaagaatattttttgagagctactatctctgcttacatataatggcagaagaaatatcctcctaaatctattaaaatcatactatgctctcaaagattctagctgctcccttaatttgatattttatccctgctataatttttacaagcttcttttcatatatatatacacacacacacatatgtatttatgtgtgatgtatgtatacatagctattacccaagtctttccattaacatggtgttatatttgtccttaccagaactactgactgctaacaacataaaactcttttccatccaaaatcattcctatttaaacatttattagtgttcaattctaataccattcaactgctcataaaggagaaagaggaagagaaggaagaggaggagaaattttccaggtaagtttatagagtaaaggaaacaacctgccattttgattgttttgagtatcaattaaattatcagttaataattcaagaaaatatatcccaggaaaaaaaaaatcccctgtataataaactaaagcttttttaacatccttcttaatccctcatatgaaaaatttatactcccctcttagatattaataaaagctcaatgtacaggtagctagggtgccccccgtcttccctgctggatttgtaggtcctgctcatgcagaggggttatttcccagcatgtggatgctctatttgactccactgtaggccaaccaccccttctcatcaatcatgttgcaattattttttacacaattacgtcttcttttagagaagagaattatttaaccagaaataacatcaacaagccttttacagaatatacatgcttaagtttcacaccatattgttgagatattttaagtgtttaaaaaatagtatgtgaatatatttcggttgtaaaaaattcaaaggaagctttatacccattaggatggctgccataattttaaaaatggaaggtagaaattggtgaggatgtgaaggaattagaagccttatgcattgttgatgggaatataaaatggtgtgacaatcatggaaaacagtatggagggtcctcaaaacattacaaatagaattacaataggatccaacaattccacttctgggaatatgccccaaataattaaaagcagggtcctgaaaagatatttatacatctctgtcatagtagcattatttacaatggccaaaaggtgggagaaacctggctgttgacagacgaatagataaataaaatgttgtgcatgtatacgatggaacattattccgtctgtaaaagagaggaaattctgacacatgctaccatatgaatggaccttgaggacattctgctaagtgaaatataccagtcacaaaaagacaaatgctgttatgattctacttacctagagtagtcagaatcatagagacagaaagtataatggtgattactagcggctgcagggagagaggaatagggagttattatttaatgagtaccgagtttcagttttgcaagatgaaaagcattctggatgtgaatggtgttgatggttgcacaacaatgtgaaggtactaatactactgaactgtatacttaaaaatggttacaatgatgaattttatgttatgtgtattttacaatactttaaaataattcaaaagtaacatcctcactcccagtgctctatacagagaaaaccaatgtctttattctttagttctgcgtttacatagacacaaattctcacatagcaatatatggtttattctttgattcatttttttttcacataaatgctatcttaatgcatatcttgttctgcatgttcaacaatgtctcagtcttgccatgagaaacggagcagggaaacttcctgggcctaaactgaataggccattttattctcttctctgccacattctttgtggttctgtctccactggactgggactctccattggtcctttaccaatgagccattctattctcatgaaatattcatgagaatgtttcaccagatctaggatttctacatattacttctaacatttccatatttctttgcctaaaattttccattctatttgaaagttgtgtgccttttttctttttctttttatcacctacatggggaggtagagtgttggctttcaaaggtgaaattgcatctttccacaactctgagttttctgagttttgagtctgttcttgacttcttttaaaaaaaaactctttggtcatggtggcaatagaggttagagtatgaataccaactcctctcgtttaggcctctgttctttagatatggtcattttaccgcttcaaggatcagaacatatcatatcccaaatttataatccccagaggtaactcagatatgtataattctttaataacaatctgatttgttctcaatatttaaagtgaacccaagatgaagagttggaaaggaaatttttaaaactctaatgctttagtaggctctcaaactgctgacagctcaagtgttctgtctctttggcaacatataaaaatccagaataacagttaaatattccacagctaactattatttaatactaatattatgtcttggttaatggaagacaccatagaccacattttgaatatttgtgctcctttttaatattggtaatcctccttctgagataaattcaggaaatctgacctttctcctcagcccttttgaaataaagaccacttttccaattaggaatatctaatgtagtgttaaagctcagagttgaaaagatgttttagtattcatcagatataacgttgtagtattattggtaacattgtgaaacaaattccagtacacttcagctctgctaacaaagatgaaatagagaataaagtaggtgtatgctgaatcttattaaggttgacatccagtttgaatacattcatcctctaaggtatagttttgggtataaaccatcgagcaagcacaaaacagtgaagctgagagctgcagaacatagagatctggtggattctaaaggactgagaatgatcgatggctactgaaatgaagtgtgaaatggtatccatagctgatatttgtctttaactgataaaatggctaaagcatttcctggtcaacacaccactctccctcctctcttctcattcctctagaacagtggccttcaaactcttttcttgataacaaatgcacttaaattggagaatatctctctttctaacacacacataacaaaaatgtcatgagatgtcttaaatacttagacattttacattcagtgtactccaatatttctattttatattcttttttaaatactggttttgacctattaaatggacttcaagaaatttttcagtctcatctaggcacacagatttaaatattacttctatgttagtgacctcttctgtgagtaagctccgtctctaactttctatctcctttggatatccttattcgcatattccttccagaacgtacaacttaacgtggcttaaacttaacagctaaacattctccctctgaagtatcccattctttccacagtcctcacccacctccatcaagttattttcctcctgtttccaaatttctgctgagggtcccatcagtcttccaggtgtaaaccattagattcctactagatccctatctttcttcccgttactatatcagtgagcaaggtcttgattctatttcgttttttgtcacaattaattattattaatagaaaataaacacttattccagtttcaaagttgttataattgaagttgctaattttaaaaaatgaattttaaataatcacttaataatccttctttgactaagacaatgaaatgtggctttaaaaaaagtaatcagcaccatttgcttataggtctttcagaatttgttcttaaagtttctggaactttcctctctgtaaagtacaggaaatactgagctacactggaaagcctctctgggacaggcaatggggagttaagcagtcatcataaaggaatcaatgtacattcagcatagtgacttggactacacaacaattccttctcctctacggtagctcaagagagacatgcttctaagcacagaggtatgagaagtctcagactgttatttgctgttagaattggtctccccatctaataacagtaaatctctggcacagatgctattggtccttaatgtcctgtgattttaggaaatagtttggatttagtttaatttattcagaaatcaaacatgtttaattaggttcactgctctggcagagtaagggtatgctggtttagtatctttataatatatatataatgagtaggtaaatcatagtcttaaatcatacttagaatactatattatttaaaccaatatctatttcaacaaaatgtttataaataaaaacagctgatgaaactaaatccaaaggtatgacaaagacgactcagctctatgttgcttaaagaactttaaaaagcatgtgcccataaagccgttcaaggagagggaaggaggtccccttctccttattcttacgatagaattcctattggggctgtgccagaaatgagcacttctaagtatttcagagaagtccaaagtgttaaaaagtcttttatgcaaaagaacgtctttctgaatcagtgaatagtaatgctcatcagaattttctaataacacaaaaacaaagccaagtccatacatttgatcagttgtcaaagtaatgggaggtggactattatgtcaaccttagtcagagctcctgctggcttctttgtatacactgttcaccaatttgagtaaagtggactttgtgagagaatagtgtttgatggccaggacctcttttgggcatttcttcctaagtggaatacacaacagataagggagtagaggaggtaatacagggaagctactcattccagctcagaaggagcagaaggagttagatgaagcccatatatgcattcaagaagccaatggtatcctctagctgtggatagtggctaatgtggtcatccagaatccacactgtggaccgcagcagcgttttcccgtacagatccaaaaactctggatagggatttacaggatccaatggccggtagataaaatgaatggggatagttacagaggcaagagctcccacccagcgccttctgagcttcttcctctgattgatgtactgtaagagaccgtcaatggctaagttcccgtcattgatgcggatccctgcccacatgtcccacagctcactctcacagagccaagtacacggcccaaagactggggtgagacctcgagagaatacaaagaagttcatcagtcatgtgaggatgagtgatagcacacctccatctttgagtagcttttggagaaggagtggacggtgagtctcaggaaagatacctccatttgacagacagactctttatggtatgccgaccagatcgattctgcttgtacctgtagagaaactcctgagcgacaattatctccatagtcatgagacttgatcctgcagttctggagccccagatgccgcaaaagcgcttccacgatgctgacctgctcaaatatggaatagtgatgcggtctcggtttgtcactgaagccaacgccaagaaatcaagggcaatcacccgatgaaacctcaaggtcagaccttcccaattcttgtaccaatcgtagctggatattggaaaacgtgtaaaaccacaactgtctcctgacttccaaccacacccacagagtcttggtagaagatacgcagtcccttgtaagtgaaaaacttgcctgaagacttccacgagtgaagatcaggtgacagctgagtgtatgggatgtgcaggtacgcagcaagcaggagcgcggcccacagccccacctggacccaccactccctcatcctgcggaggcgatctttgcgcacggcggcgttatcccacgctgccagcctcggcgttgcagagcacggggcgccgtggcgcccgcagccctgcagggccggccggcagcggggtctcaatcagcagcccacagcccgcacagggcggcgccgcgcccggcagctacagccactctgacgtgcacggcggcactgcgtttgctaggcgcgactgccacaagggaagtgcccgggtgtgctggttgccgtggcctctatttctaaagtatttcttatattttcctatttcttttcattcctactgcttacaccctcattgactgaactattgcaaccgcctcttgaggtgactgaaatattcatagatattgcagttattctccttttgggcatatagtaggattacatttgctcacccctgaaattaggcatagacaccgtcaatgaaatgtgaacagaactgacatgctttactcttagattgaatacgagttttacaagccagtgcataattcgccatgctatagagacagatgatcttccagatggatgcctgagtgtagaatatatagatcagttccccccacccttcacacatgggcccaaaatgtacacggagcaggagcaagaaatacacgtccttgctatctttgttagtttaatccacagagactttggagtctgcagttatacagcatcctagcctgtcctgactgatatgatcccttaactgatttttctactcaaagtctcttctccctccgattattctacatcactatcatattaatctttctgaaatagaactctaattatataaattccttatgaaaatctttgaatatttccctgttatcttcactggctttcaagaccatcacagtgtgcatctcaacttccttttaaaacacccacggtttccctacgtgtacacacacactttctaacacgttcgcttttctgttcctatgattctaagatgctctctgctagtcctgtctaagtgctacctattcttaagtaacagttcaaatgccagtatctctatgaggctttttctggatctctgcaaaaaaaaagggacaagaaacaccttcctcccaaaggaacaaagaatggcaattacttataagtaagccagattttagcaattggaccatttttgtcttaaatataactaacctgtctctatagcttacaaggtattcataaattcttcaaacaaaagaaatttatcataaaggatacaggtaaaagttctgtgaaattgtttaaaaaataactaaataaatgaattcccaaatgattttgagtctttattgtagttcttatcacactttgcagtggccatttctagcacttttcaggcaataaatggtcttctttcacttccatattattgaaaattcttttgcataatgcctagcaaatatcttaatgttgaatatctgaatgaatgaatgaatgaatgaacgaatgaaattaaggttgcattttattttaaaactaccgtttttttcttcagaaatcacaacgaggcaaatgttgccaataaaatagttattaagttaaaaaacataaatatctgagaaatgaactgagaaaaggagaaatccttacaggacatgaatggtacaggagaatagtacatatcaaagggtgaactctgggtcacagcttgtgggatcaggcaagaacatgtctagtcatagtctttcaaataatcttattaaaaattattttttctaagatccacttttactcttttctctgactaattttatttagctttcaagcatttctttgtggcttcagttttgacttcagtttttaaacaatttaaacaaataaaaattacattacagaattgttacttttaaactcttactttccacggggactgttattgtaaaatctgttcttattcttttaatttaactccattattttgttttaaatgtaatgattgttcattatatttttctccaactgctttaaaagcaccaatccttctttgctgtatatgtatcaaagtccataaatattctttgacattatcctagccttgaataataaaaggaaaaaaacctctcacaactttttattctacaaaataatattaaaatatgcccctatttttactgtaaatgtaatcttcacagcaacagtcaagagaacaagactgagtcattcttcatcacacattgcaagggctatgtctcctctgttgtgaggagaatattgccctgcagcaatattctcacaagtggagctctgggtcattgactgcacttttgctaataagaaatcttcagtaggagtgactgggccttgtgcaaatctctccagtagtttcttccactagtgacgcattagagcctcagaatcaatcactcaacaagtgtttactgaaagcttactgatacccagaccttaaactgttaccaaacagaatgccagatatgggatataattccagcctgaagagtttatgctcaagacaagacttacatatattacagagaagcgtaacagagcaaatgattaagttctaagtttcactgtacaccctaaaaaaaaggagaaattgatatggaacatgaatagtataggaaaatggtccttaggaaggccagacatgagagggtgagctctaggtgaccacctgtaggatcaggaaagaacatatctagtcctggagttaagatttctattttttctagatttatagaggtataattgacaattaaaaattgtgtatattctagatatgcatgacgatttaatatacatatacattgtgaaatgattaccacaaccaaattaattaatacgtgtatcacctcacatagttatcactttgtgtgtgcgtgtttgtttatgcatggaggacatttaagatctgtgtttggaaaattccaaataaacagtacaatattattaactatagttactattctgtacattagatccctagaacttattcatcttataactgaaactgtgtaccctttgacccaaacctctcatttaccccaattcctggcaaccaccattcattccaccattctactctctgcttctatgagttcaactttttagattccacatgtgagtgagatcatactgtatttgtttttctatgtgtggcttatctcacctagcacaatgcccttcaggcttatccatgtcattgcaaatagcaggatttccttctcttttatggctgaataatattcctctatctccctctctccctctctttctgtgtgtgtgtgtgtgtgtgtgtgtgtgtgtgtgtctgtgtgtctgtgtatgtgtgtatactatatttactttatccattcattcactgatggatacttaggccatttatttatcttgactgttgtgaatgatgctgctatgaacatgtggatgcagatatctccttgagatactgatatcaccttttaaaatatatagctagaaatgggattgctgggtcatattgtagtactattttcatttttggaagaatctctatgcttaatgctgttttccatagtggctatgcctatttacattcccaccaaaagtgtagaagggtttctttttctctgtttcctcaccaacatgtgttatcttttgtcttttatataatagccatgctaataggtatgaggtgatatctcactgtggttttgatttgtatttccctgatgattaatgatgttgaacactttttaatatacctgttggccatttgtatgtctctttttggaaacatgtctattttttagatatgtttaggtcctttgtccattttgaaattggcttattttgtgttttcttgctattgagttgtatgaattccttatatattttgaatattaactcctgatcatatatatggtttgccaatatattatcccataccacaacttgcctttttattttgttgattgtatcctctgctgtagaagtttttagtttgctgcagttacacttctttgtttttgctttcattgcctgtgcttcgggtgtcgtaccccaaaaatcatgaccaagactgatggcaaggagccttttctttatatttattttagaagctttatggtttcaggtcatacatttcagtcttgaatccattttcagttgatttttgtatatggaataagataaacatccaaaatcattcttttgcatgtggatatctagtttccccaatacagtttattgaaaagactatttgttccccattgtgtagttttaatggcctagtcaaagattagttggccatatatttgtgggtttatttctgggctattccgtttcattggtctatatgtctgtttttatagcactatcacactgttttgattaccatggctttgtatatagtttgaaatcaggacccatggtgcttctggctttgtccttctttcttaagattgctttggatattttgggtcatttgtgatttcatatgaattttaattattaaaattcttattcttttttttagaactgttttttctacattttctttctttttttctttcttttttttctgaggtggaatttccctcttttcgctcaaggtggagtgcaatggtgcaatctcagctcactgcaacctccgtctcctgggttcaagtgattctcctgcctcagcctcctgagtagctgagattacaggtgcacaccaccatgcccagccaattttattttttgtatttcttagtagagatggggttttgctatgttggacaggctggtctcaaactcctgacctcaggtaatctgcccacctcagcctcccaaagtgctgggattacaggcataagccactacacccggccattttttctacattttctaaaaaattgccattgaaatgttgagtgactgcattgactctgtagatcattttgggtaatgtggacattttaacaatattagttcttccaattcatgaacacagaaagtctttccatttatttgtgttgtcttccatttctttcttcaatgtcttatagttttcagtgtacagatctttcacctccttggttaaatttattcgtatatatttcattatttttgacgctattgctttggtttcttattattattatactttgagttctagggtacttgtgcacaatgtgcaggtttgttacataggtatacatgtgccatgttggtttgccgcacccgtcaactcatcatttacattaggtatttatcctaatgctatccctcccccagccccacaccccccccaacagaccccaatgtgtaatgttcccctccctgtgtccatgtgttctcattgttcaactcccacttatgagtgagaacacacactgtttggttttctgtccttgtgatattttgctgagaatgttggtttccagcttcatccatgtccctgcaaaggacataaactcatcttttttatgactctgtagtattccatggtgtatatgtgccacattttctttatccagtctattattgatggacatttgggttggttccaagtctttgctattgtgaatagtgctgcagtaaacatacatgtacatgtgtctttatagtagcatgatttataatcctttgggtacttaattcttttttggataatttgttgttaatatagatgcacgactgattttcatatgttgatttcatatcctgcaactttattgaatttctttattagcttctaatagcactttagatggagtttagggtttccttcatataagatcatgtcatctgcaaacagagacaatttaccttcttcctttccaatttagatgaatgttatatctttttcttgccgaattgctctgactaggactcatagtactatgttgattgggagtggtaagactgggcacctgataaggttaggctttatgtccccacccaaatctcatcttcagttgtaaccctcatcatccccataatccccaaatgtcaaaggaaaccagatgaaggtaattgaatcatggaggccagtttccccgatgcttttcttgtgatagtgagtgagttctcatgagctctgatagttttataaggggctcttcccccttcgcttggcacttcttcttcctgctgccttgtgaggaaggtaccttgcttccccttggccttctgccacggttgtaagcttcctgaggtctccccagccgtgctgaactgtgattcaattaaaactttttcctttataaatcacccagtttcgggcagttctttatagccttgtgaaaacgactaatacagcacccttatcttattcctaatctcagaaaagctttcaacttttcactattcagtatgacatcagctgtagacttgtcatatatgtcctttattatgttcagatacatttttctatacctaatttgttgggagcttttatcatgacaggatgttgaattttttcaaatgctttttctacatctgagatgataatatgatttttattctttattctgtgaaagtggtatacagtagtccccctttatgcatgggggatacattccaggacccccagagtatgtctgaaactgcagattgtactgacacctacatatagtatgctttttattctatgtatatacctatgaaaaagtttaatttatgttaggcacagcaagagattaacaacaatagagcaattataacaatttactataataagagttatgtgaatgttgtctctctcactccccctcaaaatatcttattgtattatactcatctttctccttgtgatgatgtgagatgataaaaggccaccatgattagatgaaatatggtgaacgacataggcattgtaacataaagttaggttattattgattttctgatgatgcatcagaaggaagaccatctgctttgagcgacccttgattattgagctatgacaatgttgatggttggatgccaggtgcatatgatatcaatgtccaacaggtcggttgtgatacagtttggataccctagaaaaaggaatggttcatctcctgggtgggaggaaacaggacagtgtaagatttaatcctgctactcaaaatgcacaattcaaaacttatgaattgtttttctgaaattttccacttaatattttcagaccatgattgagtacaggtaactgaaaccatggaaagtgaaacaaagcataagtgagaatactatatcacatttatcgactcatgtatgttgaattatccatttattccaaggataaatccctcttaatcatggtgaatgttccttttgatatgccgttgaatttgatttgctagtatttttttgaggatttttatatctgtgttcttcagagatattggcctgtaattttctttatttgtagtgtccttatctgggttagcattgtataatagttacctcatataatgagattggaagtgttccctccaagtgtctggtcttgaacttttctttattgggagatttttttttctgatttattctccttactcattatcaggtactcattacccaaatttgttcagattttctatttcttcatcattcagtcttggtcgattctatgtgtctagcctttatcaacttcttgtaggttattgtatttattggtgtataattgttcatagcagtctctatgatccttttttatttctgttgcaatgtctcctctttaatttataattttatttagttgaatcctcattccttttttcttagtttggctgaaggtttgtcaattttgtttatctttaaaaaaacaattcttacttatattgatcttttctattctctttctagtcacaatttcatttatttatgctctaatatgtattattcccttcccttttctatctttgtcttagttttttttttcctatttccttgaggtataaagttaagttgttcattttagatctttttttttaatataggcatttatcaatgtaaacttctctcttagaacgtcttttgctgcatcccagaagttttggtgtgttgtattgttattttcatttgtctcaagatacttttgatttctctttggatttcttctttgacccattggtcattttggagtgtgttgcttactttccatatatctgtgctgggattaatatttctgactttttagccaggctgcctgtattctaattacaacttcaccacttacaaggtatttagctttaggtaagccatttaaactctcagtgcctcagtccccttatctgtaaaaatgagtaatacagtgatattaataataataatgagagtatctacctccctgactgattgtgaagatgaaatgaaatagtcagtagaaagtagttagaatagttcacagcatacagtatttattatttttatgattaactaatgttttatgaggtccttagagtgctagacactgtttgcatgaattattttatatgatctcaccacaaccttataaaaaagtttttattgtccgatgttttagacggcgtagttataggagttagtttcagccaccagttgtatatagagaagctgctaggcaaacataagatttttttaaatctagcacaaggacctgaactttaccacatctgtctcccctgttgactatcaattcaatgcctaggtcccatgagggaagggtcaaagcatttgatgttaaaatgtacttctcagaggatgtccttcggagaagtattctttctcttacttatgttttgttaatttttgcttggttttgattgtagacatcagtttgtaatcagaaatgaagggaaggtcctgggagtaccaacatttaagagtgaccaaaagaatggaagccagcaaaagggatagaattctatcatcttgactcccaaacctactccatgttgatagtcttaatcttagttaatgatccctgctgcttgatccaaaaacctaacaatgacttcactcatttccctccttctgcactgttgttacctcttcagggacaaaatttcaatactttccacttagactttcactactgacttctaactcatctttttgctttctcttatttggaacagttattcagcttaccctaagtccagagtgaatttccaaaaaatcaaaggttctgcaacttttcatttctcttcaattccaactcaggttcacacgtttatcacctagtgtagaagggctttcctccacagttttgcttggcaaactccttttcatccttcaagactcaacaaaattgttgccttttcatgaaaaaggatactcttccatccttctgatattaataattttttgttcttgtgtccatgatagactttgtcataatgtattacagtttatcctggaggaaagcaccacaagaccaagagtttcctttttttttttcatcccaatgcttgatacatagtagccatttgataagtacatgttgaatgaaagcatgaatttataacatatataccttcacctgacttggagtttcataaggaatgcaacagcttccaattcatttactttctttttgcttaacaaagtatctgacacatagtacaaaagttaaatattataaataaaagattaattgcacagatatttttaaaggagacagaaaagatttgaatatccaggaattccacccaacgatgaaagacctataggcggttacaagtaggtaagcagagtccaaaatgtagggtcattttcaatggcagagaggaataggagagtcaataagaagcaaatgctcaaggagcttgagtagagacgggaataggcatctctttattatcttattggctgatttatacttcttgtaaaataattagcttaagctaattatctaagaaacaagaatctctcctaggcagattcagttgcctttcctggttctccctgagtgctctgagtaagccccaccattgccttctagaaaaactttctttcttctttcttgcccactcccatctgatcccttcacggcatccagaatgatgatccaaaagtttgggtccaaatgtgatgcaaaagtttacagtggtctaccatggttcctttacaaaaaaagaccaaaaatgttctgccattcttgctcatcatgattttgcctcagtttttcaagttatgttttgttcataatggatttttttttgtttgttttctgaatgtgttctgttccttctactgccttaaaaagccctcatcactgagtcttcctactacttccctcacctccacttaccctactgaattttcaaactgcaagtcaaatattacttccttaggggaatctcatcagactgtctccctagaccaccacaccccacccaacaactagatcacatccctttattaggggtactatgttttcagtataattgcaattataattattgacccattgaatgagttgattcatgtcccttccttctttattataagctttaagagggcaaaaactatttctgtttttcttaccatctttccctctttagtgcttccacattgtctggtacattgcagacatctaataaatatttgtcggaaggaataaatattagtgagagaataaatgggtaatgcattcatgagtgaataaagattatatcatatttttgtggtaaatattttgtttaccttcaatgactgaaacaaagagttccatatcctgaaatatgacctgaaagccatggaatgaaaggtttgataaagctggacgtggtagctcacacctgtgatcccagcatttctagagaccagggtgagagaatcgcttgagctcagaagttcaaggccagcctgggtagcacaataccttgtctctacaaaaaaagaaacaaaattagttgagcatggtagtacacacctgtagtcccacctactccaaaggctgaagtgggaggattgcatgagcccaggagttccaggctgcagcgtgctgagatcatgccactgtgctccaggctgggtgacagagcaagagcctgtcccccccaaaatttttttaaataagaaagttttaataagcagaatattagtttaattatgaatgagaagagatgtatagcatttgtaggggtacagaaccatgtattccataaaggaagaagttaagagcaatgatgtggaataagcatggggcttttaagaacttgtctgaaaagaggatattctttggtcaatagttgaaaaaataaaataagccttgctggagtggagcaagtcaatggaaagccttcacagttaggtggagcatttacactaaatgactttatttcgaacattcaacaaacactgactgattgtctattggttacccgccatataatgttaggtgctggggaaatagaagtaagtagaatgaggtgggggaggttcactgtggctcttggaaaggaaaatacataatcaaagtttgtgttagaagggtcaatctgaaggcttttgaaaaatggatctgggatagggaggatgtttgttgaatgaatgaatcaatcaatccaattaattcaataaactaatcatgattttagtgagtattctatgaaccctcacttagtttgattaccttgactgtgacatttaactttgtatttcactacttctttgcttctcttacattcagttaaaaatatttttaaaatacaattttcaaggttcagaaacaaaaaaaataaatgacattctggaaaaaatagatgtgctcagaactaaaaaataaaaataatggagatggtaaatatataagtgagaaatatgatgatgattttcattaacaagatacaccattaaatatattctcacgtgatccaaagtaatttcgttctctgtgcccagcgagttggtatctactgatggtggtttttcaaatgcaccgtgcagttagacgtcatcactgagacctcaataatagacctccatcactgagaagttcagaggtagaagatgcagggggacaatgttggcctgcattaatcttagcttgaaaagaggatctttagataacactatctaaatttagctgtgttcaaaatgctccaccacagaagagcagcaaaaagcaatctcattaaaacaagctcagaaaacaattccaagatatatgagtaaaagcaaactaaacaacggaagcacaaatagtatgaccttctcttgacttctacttgcacagctctacttattcaagctctgtttcggacattaagcttttttcatagccataactttcgtgttttttccatcatcctgtctattatatttccccttttatcttttattgagttcttttaggagaaacttgaaaaaaaaatctctataaatggaggttttttactcaagagcttttaaaataacagtacatcaccagatcatttttaaaaagtgttctattgtagttaagtgaatatttattgaaatttttctcgtcttcccattgaagactacagaaatctctttcttccagttgagctcaaaaggaaaagcaaaaaaagatggacagaagccagaaatgctgaataaattagtgtcctttttatttactttttaaaaactatgaattggctcatttaaatagattctaaaagtatttgtatgtgggtctgaacactgttgtcatggagattaaaacatttttgttgttgttgtgtacagtggagatggcagttttcttctagttgatgcttctgtagaataaaaaaaaaagtttagctgagaaaggtaggtcttaatggaattgttaatatgtagtcttattttggatgacattttaaaatcacttacgtatttaatctgtggattgtagagcatgctgggaagttatcaattccattggtacctgcctcagttgcagttcagccttaagtacttaccaaagggagctcatttggggtggcaggggtaaccgaaaagtgtgggagctgaggtattgtttgagagcctgtgggcagtgtgactgctccaatcgtagtttcagtgaggaagagcaccatctgtgcaagattttctcagatgtcctctataagactttcattgtcatcagttctatgtgctctcaaatcattgctttttcttctttattttgcacataagctataagctattttttaagacatataggttttatttctgtgtgatcaaaaactatgtctcgggcaacttctactttttggaattaacaattattttctttgtggtcttgtgtgtgtgtgtatatatataaacacatacgcacaagaagactgtctctctgtttgtatatatacatacacgcacatataaatacacagagagagtgtgtgtgtatatatacacagagagagagagagagagagagagagagagagagagagtcagtcttgctctgttaaccagctggggtgctgtggtgcaattatggctcactggagcctccacctcccagactcaagcaattctcatgcctcagccttctgagtggctgggactcccagcattcaccaccacacccagttagttattgtactttttttttttttgaagagacagggttttgctgtgttgcccaagctgatcttgaactcctggacctccagcaattctcctggcttggcttctcaatatgctgaaattataggcgtaagccaccttgcctgaccatcgtccatatatttttgaaaatgacctaggaacaatgagactttttgaagttttttccgtttgctaacttatcagagaaaactagtggaaataatatcaaaaagaaatcatcaaatgctacccatggataatgtacaagaaaactcagcaaaattatttggcacagatgaagaagacaagaaaaatgtctgctttgtgagaataccatagtaggtccttcagacaggaggtactttattaagaaggagcaattctcattaataaagatttagagagatcacttataagatgtatttatggcagcaagctcatttggtacatgtatgtatgagggaatcaagatctgaaaagattttcatcggttagagtgatacgtctgttatgatgcaattaattgtgatatactgtctactggagatttgttctccaaaacctgacaatctagtactttgtaggaactaatgtgtataatcttagggggcttagtggacagaaagttcattagccgttggtactgtgataggggaaaaagcaaatgggaccttaaacaatatgaatagacatggtttctcaaagaatagtctatggttcacctgagcacacatcacaaaggatgctgacaatgcacagttaaggtaccccacctagattaaatgaattaattttggacttgggtttagatatttacatttttatcaggacttcttatgttcaccccaaagtttgcaaaatgctcatctaaaataagaaagatgataggcctgatccatcttctgtttactaggttaaatctggaaaatataaacctcaggtgccagacttcagagggatatagaaaaacaattactttttgcattagtccattcttgcattgctaaaatcctaaagactggataatttctaaagaaaagatgattaaggcgggatgcagtggctcacgcctgtaatcccaggattttgggaggccgaggtgagcagaccacgatgtcaggagttcaagaccagcctggccaacatggtgaaacctcgtctctgctaaaagtagaaaaaaaaaaaaaagaagaaagaaagaaaagacgattaagtggttctagattctacaggctgtacaggaagcacaacagcatctgcctctggggaggcctcaggaagcttccaatcatggcagaaggttaaggaggagcaggcatgccacactgcataaacaggagcaagagagagtgggaaggtgctacatactttaaaatgacctcatgagaactcactgtcatgaggacagttccaagggggatggtgctaaaccacttatgagaaatcagcccctattctccaatcatctcccaccaggcccctcccctaacattggagattacatttcaatacgagatttgggtaggatcacacatcctatatcacttttggagaaagagtggaggtagctctgaaggtttgttacatcacagcatttgaggaatggctggggtgatggcaaatatcatacagaagagcaggcgtagacaagatataccagttgttttcaaatatctgagaaaatatcagtaagaagaagtatagtcatgagtgtgcctcacttgcctaaacattttgattaaaaatgcattttagtagatttaattatgcctttttcctctggtgaccatctgttaaaaatttttaaaaccttgacctatgaaaaaatttgtcagtaagatgcatttgttgtaccaaacttctcagttctggactttttaatcagtgtagttgccatcggactcacccaccagcttgcctgctaatccatctgatctgtgtcactcaaatacagcaggcagtgaagaacagctgctttttcttatttcattctccttctatctgtcataaaatccaggtaccaataactagggataagtgttttaccaagagcagttatttcaatagcttgaacttaaataccagattaattttcacagaataaaaataatgtttagtataagttttaataatggcatgtagatgaaatatttggacttggtgacttttaagttgtggttgctttttaaatgacttctctgtttgaggactttgtgtatacacatttcctatcacatttgtggtaggaagattctaagatgaccctcaagattcacaacctctggggtacacatcctatatgatcccctcctgttgagtgtgattggagcctgtgaatatgatgggacatcattcccatgattaggtaacattttacaacaaagtagaagatataattcggatataactcaggtggctaaattagttttcttcaagctactcaaaaggaagattattctgagggcacccaacttaatcaagtgaactcctaaaagagtgtctagttctcagagagcttttcctgctcttgaagaagcaaataatcatgtgagaaggccacacagcaagaggcttaggaggcctctagaagctgagagcagcactggattgataatcagcaagaaagcacagctgagctaacatggagactgcagcctctctaggtcgacaggaactgattatcaatgaatgttgttttaagtcactacgtttgtgataatttattatacagtaataaaaaccaaatacaaaagattaaaaagaaatctaagttgaagatatcttaaaccgaattgcatttaatacacctaacctactgaacatcatagtttagcctagcctacctttaacatactcagaacactcacattagcccacagttggacaaaattacctggcaacacagtacactgtggaatattgttggttcaccctcatgaacatgtggtggactgggatcctcagcttgctgcccctgcccagcatcacagagagaaatgtgcttcatatcactagcctggaaaaatatcaaaattcaaaatttgaagtatgatttatattgactatgtattgctttggcactatcacaaaatcgaaaaatacgaagttcaaccgtcataaattgatgactatctgtaccaccaaatagcccattactcaaatcctcaactttttctcttcaatgtatgtgacctctatttatatagtcaatacttcttgatttgaaaaaggattggatgataatagaagtgaaaagtttgaatgattatactcatttttctttttctttatctataaaccagcgcccagttggaacatttccatattttagttctaaggttgtaaattgctgaaagtttaggttttcttattgatgattctctgctaacatttgataagtaggtcccattgaatatcacaattaatctatttaagaaggttgagagatatactgttaaaccaaagggaaaatggtaaatgaaattacaatttatatttttcccctaattcatgggcattgaatattaacttagtggtctgcacttgtagcttgttaattgtttgacatctagctgaaaagtaaagtgttatatcacagatagcttttctaattgcaaacacatcaccctgtttattcattggttcactaagccttaattaggtatctatcctgtaccaaatggtatgccaggggtgaggatacaaagatagaatagaactttttagtacaatgtgaagaaagaaacataaagaaataagactgctgaagtattttaactaccaggtttgcacgttgacttctttatgcttcatttggattttctgaggctttaacgttttccgtttttaagactaagctcaagggtcaactctttcatgaaaattaattgctatttatgtttccatctataagaagagtgaaataaacaatgaaatctaatgacactgaaaagtgctttcaatgtactgttgagtgggaaaagccacatttttaacttgtatattcagtgtgatcccaattttataattttactctcaatccatatatgtgaatataatacataggaaagaggttggaagtaattcaatcatgaggttaacaagttttatctcagatgagattgtgtgtgatttttaaaaattatatttattctacctaataagcatttattacttttataacctgagagataaacattattgaaaaagaagagcatggatttaaagcgaggatgtgagactgtggctgttacatatttttttggtttggaccttggttaagaaggcaaagagggatagagattgtgggacatagagggagacgcaggcctgaggacagttacagtgttataaagggagaggcttaagtatcattataatatgagcagaaattgcaaagagtgagaagctaaaatggaagggagacgataaatagctcagcaaggtttttagggaagcagaaatgactcagatttgaaatataggtgacagaattagccttaaggaggagaaagaaaagatcttttgagactataagaaaggaggtgagagttgatgtagccataaaaaatacagagatgaaagggtggggagttaaaagagcctgtgtatgtagcctaaattcttgctatgaactagaaagccaggtcattagccgaaattgacaatgggataggggtggtcttggggaggttaaggctagaaaaatccaagcaaagcaggtaacaagaggacttgattccagactgtgaacagatttgaggcagggtcagaaagccaccctgaaatttcagtgctataaacctgtagtgggaactctataggaatactaatttctcccttcatcaacaaagatattatactggtcctgtgaagaggcttagtcacttcccagtttatgtatttcaagattatattcctaaaacacagaagtttttcagtttgttccctaacctgaccccagtctacctgtttccatccaagactatcactaccacttctaaaccacctccagccacacaaaaaacacacactatgcttgagtcattccaaattacacaccttcctctaaacattagtgtgaaattaggacatttgggaaatgtgattgatatgatttgcatgtttgcccccttcaaatcgcatgttgaaatggtattcccagtattggacgtggggactggtgggaggtgattggatcatggggacagatccctcatgaatggtgtagcaccatccccttggtgataagtgagttctcccttagttcccatgagatctggttgtttaaaagaaattgggatctccccctgctctctcttgctcccactccctccatgtgacatgtgtgctccagctttatcttctgccatgactggaagcttcctgaggccctcaccagaatcagatgtctgcaccatggttcctgtacagcctgcagaacagagaaccaattaaatatcttttctttataaattacccagcctcagatgtttcttaaaagcagtgcaaaaaatggcttaacactgtgatatttggtattttctagtccattagtgcacatccccccgatgtaggataaatatggtatgaatatttgaatatttttatgagtaataattaagcttattgaattatcacaactccagtgagataagtctaattttaatatcattagaaaggtgaagaagacaagaccagcgagggctactaatttctcaaggacacgctcatcctcatgtgagagctggaactcaaaaccagaccttgactttgtcaaaatgcacttttggttcccaatctgatattaggtgcagattcttctcttctttaaccaagggccaaataatacagccacccaccccaccctgccccagctctccttttagaaccaaactgttgctctctcactttagtgaggtggaaggaagactatttcaaattgactgatgaattaaccctatcgaaggtcagaaaaatgttagataacttaagggggaaaaaaagaaaataaatatcaaaatgtggaaatgtttgaaaaagaaagacaagaaggataggggaaaatagagaagaatagagagagaaaggaagaaagaaaggaggagagaagggaaggaaggagaatgtttgatgagcttatgaaggatgtctctttgcaactgagtgtgaatttagatgggattacataacatgaaacaaaatgaaaagaagaaaaaacagatacattcagtgatttaaaaatggggtaattctttctgtttttatttcacaagtcttttgtaacttattttagagttttaaaactttgtagacatatttaaaatgttcaattttcactaaaacaatcacatttttaaacataagggcatatatttggtgtgacaacctaacatttgccaccaagtgttaaagatgaaccagttttaattttaactagacgatttgaaacttttttgatatacttgagaatttgggactaccaaaaaacccctaaatatgatcctttatattttttattacttctaaaatattttgattctaaacaaatatatgtaaatactatgtggagaatttagatactaaaaatttaagtcaaatattgtttaagtacttacaatatgcccgggactgtacatgatgctaaaagtagccagatgcaatggttactgacttcgagtggcatctttttgaaacagagggcagaaatgaataaatctgagataacatgatgtgagcttgttccatactggagaatggggcactcagagaaaagagtgtgtgcaactgcaggtggggagaagctttgggtttggcactccaggaagatatgttcaaagcagaagggtaaagggcactgattgttcaagaaaagtgagtagtctggaaagggtcattatttcagaagcaacataccaagaaggaggcaggaaaagagaagacaaaacagcagcatggaagatgggtgaggagccaggccacgtgggtagaacttgagtatcataatatttctccatctaaattctactaggactagaagtcttatggacattttatttactctacaaagtgcccacgtcagtgacagataaagagtcaacatctgggagtagcttaggtgggttccacatggcccaggattgaacctctttctctcccttcttagctgtttgacctcagtcaagttatgtcacctctcatgcctctgttttcttgtctgtaaattgggaataataaggtaataataagtattgtgaggattatatatacatgtatataataatacatcatatataacattaatatttattaacacacatatataatctgcacatatgtttattatgtatgcccatatatatattacattatatattcatgtatacatatacatgtaaggtgcttaacagagtccctggtaccaaataagcactgaatcaacattaactattattatttggtttatctgaaacattcaaatggtatagcactaaggccatgtaaaaatatcatgtatttcaattattgaaactttttcacatttttgggtatccaggatagagaaggggaggaaggatctagtcacataatatttgagagtcagcaaattctttcaacaataatgtgattgtatttgtctgtgtgagatttctatgatggtcattttcatggagccagtcaagcattgactttgaaattaggcagatatgaatttgaaaagtagttttccctccactagccgtttgaccttgtacaagtgactttaactcattttttattattaaaaaaatagggattttttctttgtaagatttttcaagaggattcaatgtggtaacaggtataagtgcctgttagagggcctgtcatagataaatcctcaatgaagggtaactgttactaaaaggaagatataaggagagatatgacactacttccaaataaaaaccctggttcaatattggagcatggggaccccctttaagagaagcatcctcccagcataatgtccaaaatgaaaatatttcatttgtaagcataagaaaggggtcattttaagtgaaatgaccgacttatcaagccagtccactgaactgtagcttggagtctgagttacaaagtaatctatagtgatctgagggagtaatacaaactccaagttaatgactgtagaataaattctactgatatttgcagtctagtgtcatcaaggctaattctcctttaaagaggcaaaagcttcttattgtccccaaaactgttgatatagtatgtaactcagcatgtcacagaaatgttgtttatccactttggctattttgtttaaaaaaaacttttctaccctttttatttatttatttttaaatttctatatttcataagtaaaccaagcctcaacactcggcatttcaggccaggtatggtggctcacacaggtgtgtggtaatcacagcactttgggaggcttgtgcaggaggatcgcttgaggccaggagttcgaggctaacctgtgcaacatggggagaccctgcctctagagaaaatgaaaaataattaggcaggcatagtggcacatgtctgtagtccctgatactcgagaggctgaggtgggagaattgcttgagtccaggagtttgaggctgcagtgagccatgatcttgccactgtgctccagcctgggcaatggagcaagaccctgtcttgaaaaaagaaaacaaaaacaaaccatttcaaattcaaacatatttttctgaattaaaaaagaaaaaatactctctttaagtatatgaaaaagcaaatatctttcctagagtatattacattttaacagctcttgaaaattcagttaagtggtctagtgcttgtggtaatctggatgttagctaacaagaataaaaattaattccatacgttatcaacagcaaagaattttggagcagctaccataaataagaaactgctttagatgctggagatctaaatttggtaagatataatttcagccctcaaggatctagtttgttaagaaacataggcatcataacaaataaatgttcttgaattcaaaaaaaattaaagcttgattgttcagaaagcaatttcatctatatttaggagatgtttacaggtgttatattttataatgcagatctgagttcactttttgtacaagtagaagagtcacacttttatattaatagtgataatattattaacactgttggatttcttccatgtactgtcctagatattttacttattcctagaattttatagaataggtcattttgcttatgttagccttcagttgcaggtgatagaaatccaaattgagcatctattgacacctctattgatctgtccagggaagtacagaggagacctgccttagccatctgttgaccagaggaccaatcacatcaacaggactctcccctctctcttctaagctttcctctttgttgtctttattttcactagggttttctctgtaaggtgcctaaaatggctactagtagctacaggtttaggacctggtccttagcagtttaaatcggaggaggaaaaatacctcctgttcttaaagtccctattaatctctgttggccttgcatgggtgatgggcccaaccatgtaggaacacagggcagcttaggtcacatttccataaatatcagagaagtggtattgcctgatatgtatttcatagctagcaaatgacaactggaattgaagtccatgcttcttccgagtgatcactgtccctctaattgagtacctttcaattgaacctgtttcctggcgttactttaattttgtgtgaaaaactatcttcttgattttaagtaaaagcaatgaaaaaaggccctctaacattttctgctcacaaaaaaattagctttacagatagtagacttcatcagtagatacagtctttaaggaagaaaaacatagtttgtataaaatattactataccctttactatgtaatgtctcctggattctataataattggtgggctgtgtggtctgcttgccatcttccaagatgtgccccttattgaaaaaacaaaaacaaaacctatgtctgtagtatgtatatttgtgcatttaaatgtttgtgcccatggacttgtgtgtgtgtgtgtgtgtgtgtgtgtgaatgtatgtctatatatatatgtatggtgtttgtgtgagaggcaaagagaagagaaaaaagaatgacgttagcttatcaatatattataataaaattgtgttgactagtttctttatcgttctcttccaaactgataaaaggacaatttttggtgtgcggtttaaaagaaatgaacttttccccctatactgagggcaattttaaaagaaggtagtttctcaggtgtttctagtcaaaatgacaaacctacaaagtacatttgcattattttatgtatactttactgatagagtcctttaaatgttgagttcaagctaatttttcttaatcttcaaaaagtttagggatcaaattgtatcctgcagatttttgttatgctaaatttcatttcatctcttcttctttagttctacagagaagttaggtcaagattgtttgaaagtagacttgagtccagaaacttgtctcttcgaccagtggattatctaccaatttgaaaaaatatagcatgcatgtggaagaaaatgttacttttgcatgtcagcatgttgtcattattattagaagaacacatctttcaaagaaaggaaacataaactccataatgctgtctgatattattcttgaagacggctatcattttagctgttataaaacaggaaggaacatcatggagcattagattataatatctatagtcccactagcacaccattaaataaagtgaaggtatgaatatttaaattagaatttgttttttatactatattatgtcaggaagaaattgcaagctctggaaattctttgtgtcttaggaaaatgagattctattttttatagctctttaaaaaaaatacctgcatcagcagacaattggtaacagtcatcatatttggtgttatttagcatttctcaaaaacatggcagttgtttttatgtgggtgtggcatgttggcatttttacattatcgattccttgattcaatttctactctgtgctgacctgtcatatgggataaatctaactacagcaaagctctgttattcttcagtacagtacaacagataagtaagccagatataatacatttgggtgaaaaaactacaaaatcatagagggggatctttttaagagcttttaaaacaatcttttggtttaaggcagagaagtattctacaatgaaacactagattgcataagataagcctgtgcctgttccaacttaattttctttgttactctaagaactccccatatatatgtaaatttcagcagtgttaatgggctttctttggtatgtcagaagaagaatgtaatttgtgaactagataaatctataaggcacaggtgtgagcaaaaaaaaaaataataagaatcactcctcacaaggaaatactaaataacaattattattgagatgtttcatgcattttttttatccatagtagtaagtactactatctctataaagaggaaaaattcaatccaacagtcattaaagttgttctattaaatgtagtgataaatcttcagtttgtatttttaatataagatctgagggataatcaaagcaaaggcttatgtggatagggcatttattacataccaggaaatgtcctgaactctttacacatgattcattaattttctgaattacacttgtagataggaactattgttatcctcattttatagacaaagacacagagatagaggttaagtatctttactggggccacacagctaggaattggcagaaccaggatttaggcactaaaatctgtttatttaaccactagcctacatggccattggaaatgaattatacagagatgaaaagttttcgttatagattccctcgttgaaactcaaaaacagaaggcaaaatatgtaaaagaactcaaaactgagaatatttttaaaaatagaataaaatgtcatagaaaaaaatcacatttaagagtttctttcttctattacttttaccattgcagttatgggcgtttggatacagtttgggtttaataaaacccccaagtttggtttttattaaaataagtcaatctatcattggtcaatacatcacatttatctctcttttctagtagtgtcaaatctgaggagcaaatatatagctactatacaaaaatcaaagatttaaaagttttagcattgcattgagctattaatcattgtaaaaacattttaaatgcctccattttttagatgatagctacacattaaagatggggtgtaggtagggtggttgatcagtgtatctaaatagactatagtatgcaaaaacattcagtaaaaaatgttccttgagcaagaagaaaaaataaagacagctgatcaaaacacatgaatttatatgactcagtaattcttacattatcataaatttcgctaccacttttatgaaagcaattcacacaattcacaatgtgaggagcaattaccatcaaagatacataataatatgccatgtggtatatggagccacaggatgaagatggcaggttttcttgggccatcaattttactcaagggcattttaaaataatattttaatattaaaggaagcatatgatactgtagaataaaatttatttgcatttttaaaatctccaacctgactcttctgtgaaatttcagagctgtggctgttaaattggaactatgccaccagaccctggggtatgtctatttattcttctctgcctttagggaatttttttaaaaagttcaagaagccgtgagataatgcagccttcatagttattctgtttgtagattggtagtaaatttttgatacttattatgaatccaagagtggaggtgaaacatagcactggatatttttatatgtgttggtctatgtcaatcaaataggagagataaaatgatagtcttgttagtgaaagaaaatagggacaattaatgtataataaacttaaagttacatgatatgacagcatagaattaaaaatatgtctgtctagtaatttttttctccttcgcaattattgctttcttcataggcttttcctattgttctctgtcaagacactgcagtctgttttaatcattatcatctactgcttctattttacttgttatgtcatacaaattcatgtttggttctccactaatactgtttcaagaggtcacgaagaaggtatttttttttttaaaggaacaccaaaatcgaatgatggtatgatggattttatgtgtgactgagcttgtgtggagtgaagaaaaattcaaaataaattcctctctgagacacactgcatggaaatatcaaagcagtgcaattctttcataaattaaaggttatactctcattctgttttgggtccatccagaagatgataatgtttcgagagcagcagtttctcaggacactcttctgtgtttcactatggtaccaagaaatttgccagggaaagaaatgatttgcctttattctgtcaatattatcaaattaagaatgtttttccaaaaattcttttaaattattgagtgtttattatgagtatttatgatgtgcaaggtgctaggctaattgctggttgtatataaaggtatttggactccagtactattctatttttattttgtagtctgtgtgaatttataaaccactaaatcttacaggtttaatactcaaaactcctcttgtcttcaatatacctaccatagactgtaagggattatttcgagtagtcagttggggtttgatatggtgttaattctttatgcatttacatcattctatcaatttcaagtgtgttcttttattctttttcttttttctttaatttttccaggctgaaatagttatcttttaaagtctgttctacagcagctgctccaccccagtcattgcctttagctttctctagattgccattaggccttcttgaagtcgtgcttattacagatatgtgaggagtgctttttttagggggggaaggggagaaacagatgtagaataatccttttttgttgttgtttttaacacccttttctatgatggccagtgtttcactgatgatcttgttggctgtctccgtggctggatgagttgtctcgaagagcagtttacactcagtagtgaccaggtccttgagagctcttagctcatcatcctttaagtatagtttggagtattcttcccaggctgtactacttcatgcatttttttttttttttttttttttgcctattgtatttagagtttttcctgaaatgaatttctcactatgtatttgactatcaagaagagttgtatcatctgcaagtttgaggtttcacttgaaaatcctattagcccatacagggaataattcattccagtaggttcttaatagcccttccctgttccctgtttctaatccatttattgctctttaaagattaccatgtactcctttttcttattataaaatattgcatattcatattaaaatctggaaaattcatagaagcagaaataagtaatctaatgaatcaaaaacaatgtcaagtagtgtttcttaatcattacaattatttatgaattttggttttaatttttcaacatttggtctacttgatgtgtggcacacattgttctatgaaatccaaacagtgttattgtaaagtctctgggcttcttagagcaaaagttttaaaaccatcatttatatgtttaatatatttttatctatttctagatttattttaaaggcagtaaaataatctaacaggctcctgggtacccatggtgtttattatattatgaagaaataaaatattactcatacagtcgaaaccctacaattaaattcctttccctcccttcagagggaacctattataatgtgtgatttgtgatcatgaatgatttcaactagtttttctgatatttatatttattctgcaccttcaccctcatcatcatccttacaataggctttatcttttggaaatacatataatattgatgtgctctggttttaatcatcacctgcctcttgcctcagcaagctctaggttgtattttaaaggagattaaatatattttcactgaatttaattgtatctaagtaatacctttcgaagagtcaaataatacagaaaagctcataacaaaaagttgcaattcttccatccctccttcactctcagagacatgactgatctatctcagctgtttcttctagcatttacccccggatttaaaaataatatatttaaacaactataacttaatttaaacattttagacattatctcttcctttcctagtatggaagacaaagattgagcactctcatctgaccctcacacatttctgcctacatcctgcaacatatacttaaaataaatatataatgctaacattgttaaaaccatataaatattactcacagctgagctctgtggtgcactgtgtctctcttttcttttttgtacatcgttgcctggcattaataattgctttgttttgaaaaattagtcttagtttactacatacattttactaattttaaactacactttctgacagaattattaaactcccttcagtatgtttcatcacatttggaaatctattaattgatgatttttgttattatttgtgtttcattgttaagaaaaccatcctgatgcttttctctcccacatttttgtagcttccttagaaagagtgaagaaaaggtaaatgtttttaataaattatgtgtctgaagatgccttaattcccccctcttttagatatcagctggctctagaattctaggtagaaagcatctcttctcagaattttgaagatattgcttcatggctctcaattcttcactcaccttactctatgaaccccagggtctttacatcccttgaggactgaagtgtgtttccacttcaggtgctttgcactggctggtcttctatctggaatgcttctccccaagatatcttctggctaactctcttttcttcttagaaaactgctaagatttaccattcccaatgagccgcctcttgtccttttatttatttttgcaaactgcccctgcccactgccattcctggtctccctaaacaagtcttagtatttcttccctttctcttttcatgttgaaatacactatatagtttacttatgtattaggtaaactttttattgcctctctctgtactccccaagctacttcttgacccttgaaaaaatgtagattccatgatcgtataaaatttttattactttaaaaacttttctaaattaataaattataaaaaattaatatattcaaagcaactagatgtatgcctaaacacctagaaaagtgcctggcgcatgttagaaattagaaagtatttcttatgaacagttttatgatttttcacattgaagttgaagagtcttgccaatttcccctatcttatatatgtgatcagatttttgcctctgtaaacttttaggattttatcttgaccccaaatgttctgtagtttgatcacaatatgacctgtgctatgaattttttgacccgggaaattcatacacctaacttaaggattttaatttttcattattaattatttaacaatgtgttatttatctatggaactcttctttgttagatattgaatttcatggattaatcccctagctttttgtctttggtttattttgattactctttttttttttttccttttttttttttgagacaaagtctcgctcttgtcccccaggctggagtgcaatggcatgatcttggctcactgcagcctctgcctcccaggttccagcgattctccggccttggccccaccccgcccccgccgacccccatgagtagctgggatttcaggtgcctgccaccaaacccggctaatttttgtatttttagtagagatggggtttcaccatgtgggccaggctggtctggaacgcctgacctcgggtgatccacccgcctggtcctcccaaagtgctgggattacaggcgtgagccaccacgcccagccgatttctcttttcttttatttccttttctttatattctattgtttcccctggggagacctcctcacctttatcttacaacattttaaatattaccataatttaataattcttttgtgctttgagtagtcttttaaaaattaatatctcatcctgttcttgttttgtgcatgccatatgttttgctagttctccgagaatattgactcatttttgaagtttttaatattatttttgcctttgtttcctctgttttgttttctttcatgggagatacaaaatttctgggaaaattttgctgtccaataatgtttagctgagacactaaaattgttaaatctctgtatgtcacgaaagcatgttaactcaaatatgaacaaggtatcatttcattggaagactcccaaatatcctctcggtaggctatttttatggacaggtattttccaatctttgtctgctagcatttttgttgagaacggagtatgagctaaggatgagaataatcacactctacaatatgtagattttcactttttcatttttagtatgaattcttatcctcacccctcatccttcactgcatggtaattggacactttcttattaaatttccctagagaattgtattagggttctgtagagggacagaactaatatgatatatatatatatatatatatatatatatatatatatatatatatatattagtttattaagtattaacttatacgactgcatatatatacatatatatatgtatatatcatgggagtttattaagtgttaacttactcgatcacaaggtcccacaataggctgtctgcaagctgaggagcaaggagagccagtctgggtcccaaaactgaagaacttggagtctgatgtttgaggacaggaagcatccagcaagggagaaagatgtagactgggaggctatgccagtctctccttttcacattttctgcctgctttatatttgctggcggctgattagattgtgcccaccagattaagggtgggtctgcctttcccagcccactgactcaaatgttaatttcctttggcaacaccctcacagatacacccacgatcaatactttgtattcttcaatccaatcaagttgacacttgtattaaccatcacaagaataaattcccagtggtctcttgccaggtcagcaatgggatagtaacgaggtttatagggttggcagggggatctggatacctaactaagattttgcagcctcaacacttactctagccttgtaaattatttggtacttaaaatttcagagacattctggggatcagcagctcaaataacacttcttgctgtggtttgctcctccccttggcagacacatcctatccccagcttcctctgctctgggctagtaccactcactccatccactttccttccatcctatattaatttgttgacacttcttttctgatgtcatcctctggaccatatatatatatatatatatatatatatatatatatatatatatatacacacatacacacacacatacacatatttatgacttaactcttattttagaagatttgtaggttataatagcatttaagtgtgtgtgttcatggtcaggtttaaccaaagtcctaggcctgagtatttcaatgtgaagaacaaacagaatatgatattactttcatacctctatttttgatagtctgtgattctgagccctatctatgctttcagtcaaattaccaatggtatgaaactctttaattttgtgtgtctcacgtttagagggtagcttaagaggttctttaactgcatgactattgtgaggaggatacttatgagttgttcttcatttccatggggacaaggacaatgaaaatacagtataatacattcagagtgttattagaagttaggtagtaccttttaattgttaaacaataaagtaataacattgctcattaggcatgtgcttatgaagacaaaaaggcctgatttactgatttagtgatttagtccaaggctttgacatccatatgatgtggacctctgggtactaaagaagtctataaatcccaatcacaactgtgattaattacaaatatcttatgcatgtatttctttagctaaagacagaggtagaatcaaataaaaattactccaagtttactggctctatttctcttcatttgaaaacagaattttctcaaaaggcaaaggaaaagtttgtcatccacatctcttattaatgaaagtgtaacaatcatatactcacatttctccttctgaataaaacaaactactgatgagagataaagataattatttttagtacctctgttgtcttttaaatattccttttttggaaaagcaaaacaagacatgattatattgggagaagaatggtgacccaagaactagatggccttcttctggtacggttctttcactatctggtgtatctctgaagtgtgatcaaaggtaactgatcataactagataatcgttaaagcccctatcctccctccctttctgtatttttacctttcttcccttattgatactaagaccttgatactaagttgttcacaactggcccacattctaggttgaaatgatggtgcatgttggagacaaatgtacaaataaataccatatggttatattactactgtgaaaatgtatgtagaaaatgctggggtaatatggactattttcttaataatctaatttcttacctagtagacagtcaacatttccaatcatggaaatgaactagtgtccacataactgaaatccttcacatctggctatctttaggccctaaattatgtgaaattcactgagtattttccacagagttgtttactgttgtaaaatcttaaatcaaaatgttacatcaaaggaagagttgcatcaaaagaacctcagcaaaacctcaaaacaaccaaacactccacttgtctgtttaaattattagcaaaagcagctctgttatcccagcttctaagctaaccagactcatcattttggcctttcatgtatgcttttcctatggccaaaacgtccacaaattactaataaatgctgacaaggagagaggttaaaaccaggaagccatgccttttagctgacaaaacattcattgaaatgctatctgggtgaagcactgagaaattaatcatctgaatagtctaaattatagtacatgaagaatgcaacttgctagggagacataccttcagcattattcgaggttaatttaaaccaacatgtaaatgtttgtatgcttcatgtgtggtatcccaaaaggttgtgttttctcttttgatctttgaatatgctgatcgcctttcatgaacagtggcattcaatgcactttgaaaaaaacacagtctttttctttgaaggtaagttgtaagaaagagaaatcattaaagcctggagtgcagaattgttgtcgactgaaatggtatcaagtgagttgaatgcctcatattttaaaaatgggcatgatctctattattactaacaaaaaaatctgcattttatgtgatatctgacatgggaaagggatgcttgatgagtagccaatgatgttgaactggctgtattttccgactgacttgtttttcttatgaaggcagcattttagtaaaattgtgtttgtctttctttctgataggctctaattgaagtttgaaggttcattacacaatgcctgggaatatgttgtcaaatacaattcacctctcccacagtgaatattggcatgattttataggacagggtactctagagctcagctgtcataatatttggctccaatttcattcataatggacagaatatctacaatgttttgaatccctactttcaaatgtcagcacactggaacaaatattaaagaatgggtttgaatctaagtagatgagtatttccttgaagcaacatgttatagcctaaatgttgtttccttcaattatgtttaaacaatgtaaccttaaatgtttcacagatgtatcacttgaaatccaaaacacatactactcatcaaagtcatctttatttaagcttaggaagaaaaatagaaatctgaaatgtttgctcttagtccacacacacttctcatctggcaggacatttctgaatttatttgggaaattgaatatatgtcaggtaggtttgggttgctgggtaaatgagtgtacttcagtgtcaggactgtttttattaacagattttataaactggcttggtagtttccagttctgtggcaagaacaatctatcataataaacctgtaacataaaagtacagaatacattcctgtttcaagagtctgtaagaggagtcccctcatgaacagtttatatgagaggattataaaatgaagttcagcagtagcacaagcaactgcagtgaatggtgtgttgttaaggttctttaaatcatgaaaaaaatatactttcaaggatttattaatcttactccaaatatatatattttggtaaatagcaattggaaagaagggtttgtatttcttagaagcactgagctgaccaatatattggaaaactaagtaaagcaggccagtgatctctattctgagtgaaatattttgctctgtttgacatctgggtgcaatgatggctatgtcagtgtcactttatttttctcttgtgcaagtttgataaaactctttaaatactaatgtgtattttagaaaacacaaattctgttatattccaggaggaaggaaattgccttaggatatgaatcagatttgataacatgaactatcttatttaattattctaaattgaaaacatcatgaaagataattgggatttttccatttttattttcctcttgtttcttgcttatttgaatcattcgttttattcttctttctacttaggctaagctctcaaaaggaaaggagatgtaattcaatgtatgtaagtttctaagtgtaggtatttttcaacaaacacataaacaatcatcgatgacattattacttatgtcacataaaaactgtgtttaaacagattaaaaatattttctggagagttttatttattttacaatgtttacaagtgaattgtcaagatgtctcccaatattatttcctttccagacagcaatctttaaatcctgcttgagtcatcttttattccagttttcctttttttgagtgtaaaggcaataaattataacaataaaagacttatactctttgtcccatagtttctcttttctgttgaaatatagcttgctctttggaatattaacatgtaaaccagaggtttttttttttttttttttttgaacaatctgactattctaaaacactttttaggatatcactaattgtcaataaggaattgagatccacagataaacttatcaggaacagaaaattgttttgaatacatttttaatatttaaatagtcacagatcaaaactaaatttttttttaaagattctgttgaataggtaggacttcacattggattcaacctggtatttaaaatgcaaatactttttgatttctctttttgctaagtaatattctaagagattagccatacattttaaaatgttgtgactgtttttgtgtttcatgtttgtataaatgtagagattagacacttgtttaagatccttaaagatctgaggtaaattatttttgggaaatacaaatttctttctgtaatttctaccttctgtgaacaacttcttgaagactgttctgttgctcttggtttatacgcaggtcccttaaaataacaaaataaaaaataagaaacaatacataaggacaaagactggaaataaaagaaaaataatttaaactcaagggattttcttgggtaaggcctcagagaatgttccagctgttcttaagaaagacattgtatataaaggccacatttagctgaatagactgaaaaattcttattatttgagaaatgattcaattgttgtctcaatgctaaatattcataaaaactatccattcattaatcctttttaaactgaagtaattagaaaaagcaggtcaatgtgcaaagaaatgggcttttcttcatcaaatggttaattctttattaaatggttattctttaaaatgagcaaagatgagctcagcaaataaggtacttgtaataatgaaagtactatatgcaggaatactggctttttgtttttaatctgcaattagttaattaaatttcattgtagatgtattgcataaaatacatttgaaaggcaccattcttcctcataatacagctagtgaaggtccaaatttcagtgactcaagtgtaggtgggaaaaagtcctcacaaactttacgcaaattgttagaaaagcttatgtaaacatgactactatgaatacagaccagggatgtgccccagagtcaatgagttcaattcacttgctgccacaatgctttcaggcctaggctctttgcagacagagagcagcatcagggaatgattattacctgtgcccagcagggtttgttcaactgctaatggtcaaggtagattcaagccctctatcattcccagagacatacaaaatcaaatactgacttaaagagaaatataaatgaaataagttctaaaaggaaaagaaaacaaagaaatgtcttttacaaggcactaaagaaagacacaagggaacattcatatagattattttattaaatatttattgagcaaaatatttgtgccaggcactgttagattggcctcatgagctttgcatgggcacccacttgctatacatcaggcttggaaacatactcctgaccagcatttatgctagacatgatttatgtctcatactgtgctaagggggtgactaaaatctatattgaccaatacttgatgagtatatttgacagatgtttaaaagttaaccctgctcaaaaatgtaacgggatctttactaatcaggatcataggtttgcatgggttcctaggaggaaaagaatgagtgggaccagtttatacaccaagcatcaaaggactccattctcaccctagggaaacacggattttactgctcaggggatgatgaaaattggattccgacttttacacctcagattatttctattaattacacctcagattatttctattacacctcagattattatctcagattattatctattacacctcagattatttctattattcagtcttagccgaagattcccagccccaggtccatcgttgctcaagggtaagatcacagacctagtgcctgcattatttcccttctgtgcaaatcgtgagggccaattttgctctctaaaaatttgcattaaacagaccaatcactagattccttctacagatcaaaatgcatttattcaatcaaacaaaagggaatccatgtgaggcaactaaggaagggctttccctccagtctggtgagcagtggctgtggctctgctggctctattttgtgaggtctttataaatgaccacaattaagctgtagatgtactcatgccctagatgtaaccatccgttctggggaatatggcttgataaacccattggtgtctaacacttattcatgtcactcattcattcattcatttattcaaacaaatatttttgagctcttatgaggtgccaggcactgttctaagcaatgggaaaacaggagtaaacaagtccccattcttatgatgtttttattttagaggggataggaagaaggagaaaaagccaatgaataaggaaagaaataaatcaacaagataatttcatataatgctaaggatgggaagaaatgaaaacaggtgttggaatagatcatggggtgggagttaattgaaggggtagtcaagaaaggccctgctaaagaagtgttgggttggttagagcccagcaagggacttttcagctctggagatgcttgtagagaaatgcagaggtcctaatatgggaatgaacatctcatgtagggtatagcttctcatgtttgaggaacagaaacaaggccctaaaggctctaatattgtgagccaggataagggcagccagggtaagggcagatgacatctggagacaggtaggggccaggtaggaccttgtactgtgtacgtaggaccttgtacatgtaggagtcagatcacgtgggaccttgtgcttcgtttgaattttattctaaatgttgggaattgattagatgattttaaaaataatactttcttaatactgtgtcactctgcctactctctgagaaacagatcataaggagacaagggttggaggcaagcaatgcttctacagaagactttggtaggttcggtttctataatttccaagctctgcaggagaccactacagcttcctcctcagttactcttatttacttatgggcccaaacccctgagcagttaaaatctggcatcaataacactatcaattctggctaacaccttggccagtgagaagggttaatataacaggagggaagatgacagacggaaaaccatttcttttacctcttttttggtctccacaggttgacaataacatgttgtaataatcacatgtatgcaatttaccagaagttttgaaatcttagattaccactaacattccaatttctaaagacagtggacatgaattcctgcagctctctgagaatagattttagctgttaatattatattacaacttcctacatagttgtaaaaatttaggttaatgattcctgtgaatttatttttatttttttgaaatggggtctcactctgttgcccaggctggagtgtagtggtgtgatctcagctcattgcaactttgcctcccaggctcaagcgatcctcctgcctcagccacgagagtagctgggattacagattcacgccactacacccagcaaacttttgtatttttagtagatatgaggtttcaccatgttgtccaggctgttctcaaactcctgagctcaagtgatccacccacctagacctcccaaagtgctgggactacaggcatgagccacctgtgaatttaaagtaaattaatattatgtacacagaagttacaataaaaatgcttctatttggataaaacaaaaaaattaaaactactgtaaaagtgaaagatactacatactttaggaacaactggtatttgtatgcaagtgggcctaaatctaatgttgtgtgaagatcaaagccaagtacaattgtagctcatgttgcagttatttcgaggtctcaaaagggataacaacaaaaatctataatagaaaacagaatctgggttaaaatcagtggaaataatttttatttcagaattaaataaattgagtgaaatgaagtatctggctcttggaggaaaatatggtatcttattctttaaatgtctttaaatttataagtcataagctgcaagtcagtagcatcattatgttgatgaattacccagtttaattcttataaaaattgaaattatcttctgaactctaagtcatattttagccacaggtatttttttgttttgtttaatcaataattcctgaaagaatgaaacttattcgacttttattacgtgacaaggtttaaaaaaatttgcttgaataaaacattatggagtctgaattcaaagcataaaggcagaaagtaaagtatgaagatctttcaaacgtctgtcacttttaataattttgttctatgttatatgacctacgaatgttaagagtctgtaagagtttcttcagctgcatttgattttaccaacaccttgtgggtacagttaagaagatgacttatttgaggctttataactgaaattggatatggttcaaacgttcaacagatataaacatattttaattaagaataaatatttttataagattgctgaaatgacttctctcaaaaatttatgccggaacatcaacaaataaatttgcattacaaaatagaaaattcaattgtggaaaatcatattctaacttattctgatgaagtagttcccttgtcaggaagctttttcttaaagtgtgttttatgatttgtgatagaattaccatcactaagtcgatcattgcccattggttagtctacatgtactgccttttagtgacatgagttcaattctaattaagaatgagaatagcctataactatgaacacagatagctacatgtgtctctagtgagaggtactagtcctctttgacatttctcttaaagcggaatttatttggggtagtgatggttttactggtagccataggggaagataagaaaagggggccaagatattcatttctactgctggcatgtggaatgctcttttcctgctccatgccagtctctcacttgatttagaaagatttgtgcgtccttagctttgaccatcaagaagagtccatctcctttgccttcctgtgcctggtacctgaaagacctagtgaagactgaaagaaaagtttttattttcttacatagtgaaagcactttgaagcattttgttacacatatctataatttaacatgataattatattgatcatttacaattctacacattattttagcaagtaatgaacgttcttaagtgcctagtgttgtcataggtataaatcaagtaggatacctgccctcaagaaagtgtataattttatgcgtagagataagagatgagtactttcgcagaaacaaatgaataattatataccaacatggagaacttaagctcataggtgaatgtgggaatatggaggagaatgaaaatcattgccaggtgagtgatcaaagagtgcattctagaaaaggtggtacctgtacaggggtttggaggatgcattggtattaaataagagagaaattagagggaagacacatcttccaggcagagtgtctagaagcagagccagcagcagattttagtgtaagcaatttattgaaaaagtcctctcagaagatatctatgagatggtaagaaaagctgaaaaaggtaggggagaaagtggacaaagatgtgatctctaaagttgagcctcagactgatacatggcatggtctggagggaaaattgcaccacagaaagaggtaccccttaaggaacaggatgccaggattttacccctcatatctgtcagttatcggctacaagtccaaggggcagggggaagtgcaagtgatgtatcttgctggaagtctcagggtcaggaggctctcattcaaagaggcaggtctctggaatgatgcagctgcaagccattagcagccaacccttgcctcagctgagagatgggtaccaggatgaaaggcctggtaaagggttatggctgtgccaccagtggaatttcctacactgggaatatacatgctaggtgcatagaatgttaggtgtgagaggggagaccagcctgttggaaagtattcattaatgcatatttgtcaagaattctagctggtaacactttattaaacattagatattgctattttatgtgctttgaagcaattacactgtttgaaaaaccttattttgtaaaaaaaaatctgttctattcactgtctcacagatttaggacagtttattaattaagaacactagatttcaagtcaaacagacctgaccttaaaccttgaccttgttctttgctgtataaatggttttgtatgagttacttaaccacactgagcctcaaattcccatcagttatatgtggattataatgtctgcctcatgcttgttgtgaacattcaatgtaatcattcatatgaagaagcaatgaacacagggtctggtgcacataaatgttcaacaaatgatagacattacttccttctggatgagcaaaaccttgatgctttcagtagaaggtatttggaactatggttgaatcttttctgggggtattgatgggactagagtcaggatgaggtggatgaaatgccaggtactttcatctgtatgacttgagagtgtatgcatcaaattttgcaccctcgagcacctctctcacctccacattgaaaaaaatacatgccagattaaaaaaaatgaaattggaaaggatggtttgtagaactgttagagcatccataaaactcattacaaagtaaaatatattagtaataaaatgattttagtaatacctcgggaaccactctaattccaaatcatctctctgtctcttgtaatggctttccaatattctttgaaaaatattgaggttattttagttatgatattggtactttgatttggtttaaatatccttttattcttgagatatacaatttcaactgaatggcaactatgacagagttgaaaatgtacagaaaaataaattatagattagacaacgtattaatttaaaagcagttgcaagcaagttactatattgcaatgaaaaaaaagttcctaaaattggtaattcaactattgctgtcctaatagctgaagtcatttttatgtatggcaatcctaaatcaaagccatcataagatgctgcagacctcttaatagcttggctccagtgataatgagcccaggacattagagctcatttgagagcaggattcataattttttttactgtgcaattttcctacctctggctttgtctcaaagacatagccacacatggagaaggacactgataataagagagtttgacattctttataatttttcttttgccaggatccttataatccttgaatcaaaatgattgaagcagttatttttaaaaatagaagctagatttaaaatgtattattttgtgcctcttttgacattattttgtttagagcacctttaaaaactctactggtgattaaaatattgaaactataacagtatttttggcatgatttttaaatacttctttcagctatatacttctctaacttattggcttattatttgatttaattgtccttaggcagtgttaattatgagagtttgccgagtttcttcttgggaatttgagaataaaggatgcgggaaagaggaggtgggtggaggatggatataaactgttttttcaatgtactgaaggcatttcagattaccagaagaatcacagagacaagggaccatttagccatagggttaaacctgtcactttacctaccccacaaataagtaactatggcaactcactgaaagtgcttagctaccatgggagtggatggagttcgtgctttgtggggacaatgctgtgggacctctatgcccccatccataagggaccctgggaattgccttctagcagagaggccaactcacatttcaaataagtatttttccctcctcaactgcttttctaagctttgcacattaacactgacctagtgcaccatttaaaagtcctaaatatatcacacagtcgccagcccaatcaaggtgagtggtcagacaccagcatgctgtgcacagtatgctagttggccttagagtaatacagggtacaccatttatgtccagttaaccaggtgaccctctagttgctttattaagcacaggcttgactgtcaaacaggtcacaaggaggacaaaaagtgtccttgcatcgtatgaaaagagttgcttgaaatcacagaataccctctattaattgctaaaatccaatttccacctgaagacatgcctccatgactcgtgagaaaaatcaattatttaggtaaataggatctgcaactcaaacactcagacctattagagtatctagcagcatgccaggagatagactgagctgcaagataaatatggaaccatcttgtggaatataaatttcagttaaaggttttaaggagtatataataaggaaagcattgttttatattaaaatgtattcaattatattatgggatggaactgaaagttcacatgcagttttcagatgtgtcccccaaagttaatatatttcctgggtactcattcacactcttctgccaatagtattaatgctttgggaaatgtttgagaagtgttgttccagtggaaatgagcctgtgggttcactgattcatttatccattcattcatttattccttcatacagtatatagctttcaagccacttttatggactattttattaactttgaatatcaaaaccaataaaatagactttgtgtctgctttgtgacacaatttaatgagtaacaattttttttttttttttgagaaggagtctcactctgttgcccaggctggagtgcagtggcacgatcttggttcactgcaagctccgcctcacgggttcacgccattctcctgcctcggcctccggagtagctgggactacaggcgcccaccaccatgcccagctaatttttttgtatttttagtagagacgaggtttcactgtgttagccaggatggtcttgatctcctgacctcgtgatccgcctgcctctgcctcccaaagtgctgggattacaggcctgagccatcgcgcctggccatgagtaacaatttttaaaataaaaataaatagcaaatgatgagtaaagtacaacaataaatcaaacaaaatgctattaggaccatatggcagaaaaacaacagaatcttagaagagttagggaagacttcccaaaggaagtggcaattaacctgagatttttaaagatgagcaggagaatttcaggcaaataaaacttgcagtggggttgggagtaggtggatggaccatgatattccaggtgaataattgagcactttagcttgggaggagggccctaaatgagaaagtatatgacctatttcaggaactgaaagaaatttggaatgcttggaatataaagtgtggggcaaatgatggaggacaaagaggcagcagggataatatagtttggctgtgtctccacccagatctcatcttgaattgcagttcccacaattcccaagggtcatgggagggacctggagggaggcaattcaatcataggggcaggtctttcccatgcttttctcatgatagtgaataagtctcacgagatctgatgattttataaaggagagttcccctgcacatgccctcttgcctgccaccatgtaagacgtgactttgctcttcaagtactttctgccatgattgtgaggcctccccagccatgtggaattgtgagtcaattaaacctctttcctttataaattaccctgtcttgggtatttctttattagcagcatgagaatggattaatacaaggcattagagggaaagagtggggagaggtaaagttgaaagacaagcaagaagcagatcatgaaacgctttgtgagccttgttagtgagtttcagggaaatccctctaactgcaatgtggaaaatgaattggaaaagtcagaagaggaaaattcattaaaaggatgtgaagtaattaaagggatttaggataatggcctgaactaagatggtggcagtgggaatgaataatatgaatggactgacaggattttttttgtattttgactcagcaggtgttggtagcattagatatagagagtggggaggaagaaggctctaggcatgatgctcagattgctgatttggttaaaggaagcagagaaagatacatctggagaggaaacaagaatccccactttttgttttgttttttccagttcctgatagatagccatgctcaagtgtcccagtggcagttgagtatttagagtcaaagctcaggggagaactctagctggtgataatgatttgggaattttggcataaaaatactcatttgaacccagggaaatgggaggtaacatccaggataagcttgtagaaggaagagactgtgtagtaggaacacagggaaagatatcaacaccagagaggaagagatgctttgcttgagggtgtactctacatttaaatttttctctttgagagaagaatcatgacaataagaaatttgatttattccatatttcagattgttttgaaagtggtatgtcactaatgaaaggagtgtgaagtgaatactgttgacattcctgagaaatgtatctggggggccttaaaatctgtaaatatcataaatatcatacgaatcctaagaaattctgggatttaaggatgagtgggagacttaggttcttggttctgtgttgtaagtcattctccaagtgtagcaggaccatagcactgatgaaaatgatttatacagtagtcttatgatccaatgcccatgtatgaacaaaggttactgttcctgtcttctaaattggggttcccagtgtaatacaggaagactactgtgtgctagtaaacagaaagcacaatccacatttgaccatattttcctcgttggatgtgtttatggatatattttattctgcttttatctttctgagattaatgccttatctggccttttttcctatgagtacctttggttataaagaacttcgcattgctacattatcaattttcagcctctcttttttatttttaatttctttgccacctcttcttaatacataatgctctttcttccttcgttcctccccctctctgtttcttccttcctcctttctttcttgctttcttctttcttttctttattctttctttttttttttttttcaaggtcttgacgtgttgcccaggctggagtgcagtagtgaaatcatggctcactgcagcctcaacctcctgggctcaagcaatccttccacctccgcacccccaagcagctgggactacaggcaagggccaccatgcccaactaatttatttttgtttttcatagagatgaggtctcactatgttgcccaggctgctctcaaactcctgggccaagtgatccttctgcctcagcctttcaaagtgctgggattacagacatgagccacctcacccaaacttttctttttttttgagagattcttaaactagattgtacttacgataaatgttgactgattcattaccttcaacagtgctttcagcctctgatggttcagagaaatgattgtgtatactttatatttcacctgaatcaggtttcggttgagacaataattttctgagtatgtctccacttcacaaaattaatttattttcaacttttctctagttttaccactgttttgataaataatcttacagtggaggaagacttattgaaacaatttcatcacttttttttctcttgtttgcctcagagtatggttgattcattctctccctaggttggagccattgcagaatcaatattttacttttaactgactccaaaatatatacattctagctaagtactttcagcactatgagttgtccttcttttaaagagaaatttttttaaaatgatatcattaaaaacaagccattccatgatttattgtataagagaagataagtacggagttgtaaacctgcaatagaataataccctggatatccaccttcactgatgagtttaactgactcattcttacctgttaaccaaatgcttttgagagtcaaaggcagggtctgagaggaattatcaatgaatatttgtaatgaatcattgaggtcgcttgtgaatagttgaaacttccaatattaaggctgtgtaggccaagaatctagttatcctttcagaaatttttttttctgaccacctactctgtgccttaagcaaaagtacctgcccttctttctttcttttttttttttttttttgagagcatggtgtggtctcggctcactgcaacattcgcctcccgggttcaagcgattcacttgcctcagcctcctgagtagctgggattacaggcgcctgccaccaagctgggctaatttttgtatttttagtagagacaaggtttcaccatgttggccagactggtcttgaactcttgacctcatgatctgcatgcctgagcctcccaaagtgctgggattacaagcgtgagccaccatgcccggtcagtacctgcccttctctaaaggcacttgcttgcagtctttggaggagataagctttgatcaactcatcaacctaatggcaagtatcatttgacttgagaaaagataagaaacagggttctcaatagtgtgatctacaagatagacagcagtcagtagacgcttgcttctctgaggaagtgactcttggaagaattagtaagagctaggtgggcaaattcgggtaagacagaaggttgagaaagatgttttcagagaaggctccacaggaacatagttcctctcctgctgtattatggagagaacatggagccttcagagatataaaaatgtcattgtggctggaatgcaaagatgaagggaaagagtttgaattgaggaagggatcagagcatgcaaggatttaaagattactttaagaatttggtgcattatactcattaaatgatgtttgccacttgggtcaacaaacattctgtaaaggcttagatagtaagtattataaatattgcaggtgatatggtctctgttgcaattactcaactctgctgttgtaagggagaagcagatataaacaatatgtatgtgtgagtagatgtttccataaagctttatttacagaaacaagccatgacagtatctggcatatctcctgatcagataaatcctcatgttgctgccttatttcccaatgtctccgtttgaactagtgcagggatattttggagactttagcaatgcctagtcagcaagcatcagtgtactttagacattgaaaatcgggttaggaaaaaaaaaatatggactgctttgattttcctttgaagtaatgtcacaagaagaaaacagcaagctggttcatttgccaaggaaggaagagcatgaaagacaaaatgaaatgccagtaactaggtactagaggaaaggagtgctaagaaaatgttcaaaagggatcttgaaaagcaaagatcacttggtagatgaacttgttcaaagtgttcgctaactcacctcttgcaagaacaaactatcttgcaaggctctactgcaacatgtctgatacacagcacctgcagtcaacagactctgtagttgcaaagtattgagttttgtgctcaagctatagaagttaatggactgtcataacattgttcagatgaaacccagcaaagcttaacagactaaggtggattttgcctccccttttaatccagtgctaatttctttgagtaatctcagaaaacttttttatgctaaagtgattcatttataaagttcttgtcaaaacaaccagtgtatttaaaatattttggaattataatacaggacacaaatgaaagaagatatttatactaggcagatgggctaggttatgctgcaataatgaacaaccccaaaatcttagtggttgcaaacaacaaacttttttctcccactcacaatacaggttcatcatagtcagcagggggctccaggaatcataattgctgatatagccacctgacagatcagtaacctcagtgtagctggtggccatgagaaaaggcgataatcatctttcatatcaaatattagaacaatgcaagagaaatatggtgattttactctctatatcaatatcacacacactaacacttggtgtgcattttagaatatcttgctggttcccagtaaatatgtcaactttttgcactatataccgcttgaaatgtcaatactgcacaaatacgcgtagtctgctgacagtaacctgccaggttctagacttccatattgattactgttagcaaaatgtgtaggtgaaatttttgtagggtacgcacgtgaccattcacagaaggcaagaggttctctttggaatttaattttctgtgtgaaaaataaatcacttttttgtgtgtgtggaacatttctcatggaataatgggtcatattaggttaagtttaggaaactgatgtttattgagctgtgcacatatctgctaaaggaatttcacatctataaataaataagcttatttttccatggtgtcagagagataatgagactttcatataaaactatttttgccagctgaaatatcatgattgttattctaatatttcctccacaaagacttagtgaactgcatgtccattttagaaagtaggagtagatattttaattttttcttgcttcttgagaactactatcaacaataaaaaaagctttgattttaacgtgtatatcttaagatttcttttgatcaatactaatgaaaataaacctgaaacgcgaatcattggacaaatgtgagatttttcctttaatttatacattaattgatgtaagatagtatttagaaagtttcaatcctttccagttacaattgtaattgtcacttacctcaaactaaacaaacggactctttcccatatttttctacttggtgaaggacattctaatcatctagatgcctaagtcagaaacctaggcatcatcccttcattctttctgttcctcacagtcacacttaattaattgaacgattttcggtccctacatacttcctgatttcctcccctgtgccctactgcttctctccctaactcagataatgatttctcgactatcctattttaagatcaggctattttgtctccttgcaatgatctctctataacctagtaatatcaagccctaatgaaaagtctttggtcggcttctgtcacccaggataaacgtgaaactcctgagagttggatctacttcctttcagcatctcacccttgcctgcacttctagcctccactctcaaaactctttcacacatcatttgaacctgagacattaaaaatgccttccagggcttggtgcagtggcacacacctgtaatcccagcactttgggaggccaaggccagcagatcacttgagctcaggagttcgagaccagcctgggcaatatgcgaaaccccatctctaccaaaaaaaaaaaaaaaaaaaaaaattgctgggcttggtggttgagcctgtcgtcccagctactcaggaggctgaggtgggaggatcccttgagttcagaagttcaaggctgcagtgagcagagattgagccactgcactccagcataggtgacagagccagagcctgtctcaaaaagaaaataataataataatactgccttccagttcctccaaaataacatgtctttccttggtaaatactcttcttactgctttcagcagacattcaacccacaggtcccaggtcgttgactcattctcatctcttaattgctagccaggcctttgggaagccgttctctagttcctactcagttaggcacccaacctctctgctctcatagcacataggctgtccctctaacatagcatgagtcacacgctttccaaactggtgtttacctgcttgtcttctttactgcattgctccttgaggtagcaaggatgtcttctttattagcttttttatactgagaaaattttaaaatacaggaaaagaaacatgataaaatatatacccacattcctaactcatagaaataactgttgacattttgtcatgttttcttttcttactagagaaagaaaatgagataaaactaacctgcatttctatcctacttttctgcctgtcttagaggcaaacaccaacacaggtttgttgtcaatttccttcccattaaaaatacttttacatacctactgtgtatctatagccaacagatcttatatttatgtggtgtttgcgtttttccaattttagaaatggtttcctacctttcttaacctacgacttctgacaattttatttcaaaattatgccaatatgtatagatctcaaaaacataacattgagtgaatatgccaataggtagaatgtcatgtaaagtttaatttttgtcaattttatgagtgaaaattgtatatcactgttgtttttatttacctttttttaccagtttttttccagttttgttttattattattttattttattttattatactttaagttttagggtacatgtgcacaatgtgcaggttagttacatatgtatacatgtgcctgctggtgtgctgcacccattaactcgtcatttagcattaggtatatctcctaatgctatccctcccccctccccccaccccaccccacaacagtccccagagtgtgatgttccccttcttgtgtccatgtgttctcattgttcaattcccacctatgagtgagaacatgcggtgtttggttttttgtccttgtgatagtttactgagaatgatgatttccagtatcgtccatgtccctacaaaggacaggaactcatcatttttttatggctgcatagtattccatggtgtatatgtgccacattttcttaatccagtctatcattgttgtacatttgggttggttccaagtctttgctattgtgaatagtgccgcaataaacatacgtgtgcatgtgtctttatagcagcatgatttatagtcctttgggtacatacccagtaatgggatggctgggtcaaagggtatttctagttctagatccctgaggaatcgccacactgacttccacaatggttgaactagtttacagtcccaccaacagtgtaaaagtgttcctatttctccatatcctctccagcccctgttgtttcctgactttttaatgattgccattctaactggtgtgagatggtatctcattgtggttttggtttgcatttctctgatggccagtgatggtgagcattttttcatgtgttttttggctgcataaatgtcttctttgatgaataatgagatttaactttttcccattgaccattcacatgttcccaactctgaatttctagtaaattcatgtttttccagagaatgaaagagtgaatggccactgtcttgaggaaatgggagtattctagatgcatagtcaggcagtgtgattagtatagtgcaagaatggtaggaaaggatggagaggacaatgggaaaacaccttgctaaaaagtttggattttgtcttctagtgatagaaatgtactgatggtccctgacatgggtaacagctgctttagagctgaatttcaagaatcagcttgtgaacaatgctttggagattaagacagtaggaaggagaagatttgaagcagtaaagtgatttagaaaactatttcaatggaccagacaagaaatggtaatggcctgaaatgagtggagggagtggaaatgaagtcacatggctgcagttgccatttattggagaaactgaatttcagggatttggatcaggtcaaggtatgttatgcacataaaccaaatattaatgatatttatttagtgtgcaccagtgatatttgttttttccttcgctaaactgaagattaaggcaatcagaacctagtaaacattgctgaattcaccattgtatcccccagtgctaatacacaaaaagtatacaatgaattctactacctacctttcgcagtgtggctatccttgcaaatttcaccctttcccttcctttcagtcattcttgtttccccatgctccatagatcatttagccaccacatctttttgtgttattttgttttctgcaatgatgctggtataattcagaactactagcaaaatctcatctctagcttcatgtgatattttcctgcttataaactacccatattcttgctgtgctatagtcaatatgtgtaactcttctgaggcctcctcattcattgcagatgtttgcaaacttacctctcttcttaagggcccattcgtatgtacttaaataggaagatcatcagagacaagtatccacatgtgaactcccttagctactgttcttttctctaaatttctctttttctctgttcaaaaaatttccaactttcaactttgtggacacttctggaaaaaaagaaagtcgtgtcttaccaattttgcagaattgaattacaagtttctcatactaagacatttttctatggaagaaacaaggttcttttgtagagatgagaatttaaatgatttttttttttttttgcaatgggaagagagatttctcactagtcttactggttttcatctgactttatagtttaaaattgatagccattttgatggcaacacacatggtttagttaaattttactccgtcctcagttttcctgagggagtgtcagctactgtgttttctttacaaaacaacataaattccatgtatccaccctgggaatcacttcactgcgttgaatctggataggaaataaagattcatgaatatttcacaatttactaggaaccatcactttcttgctcttccgtgtggattttctactaattagttacttggtatgtctaagatacgttatttttattatacaaagactgtatcactttttattcctttgatataaatcataatacagtgtctgataagtacagctttttaaaaactcttttcatagactgtcttattctttttagatttatgcccatgatgtgcatggtcctgaatgtggaatgggtctctctgaagaaaagtgggtcagatggttgcttgtgcatattggaaagaaactgatagcttcctggtctcttttgaagggtgctgttgtaaaatacagattagtcaaggtttacagtgctgttactagcctgaacacttcaaaccaccatgcagtttaaaactattcagtgcttatggcaaaattcaggtcttttgatgttggggcaggagtagacattttattggaatgtaaggcaaaaatagagatgaaaacattgaatcatttttggtggggggattgacttaccttaataataattttttatacctttaaatccagaaatgtcaagaaaatgacacacaagaacaaaacaaaagaaaaattcagtttagagcctgcttaaaaatctgacattgatcttccaatgccttaaaaatgtttttattatgaaaaaatttgaacatataaaaaatggaagatatggtataaggaaccctcaagtacacattacttgcttcaataattatcacccatcaactaattttttttttcatctgtaaccctaccaactgttctcctttcccactggaatattttgaagcaaatcatcatatcatataatctgtaatctgcaaatatttaagtatgcatatctaaaagttagaattctttttaaaatcataatctcagtataatgacacactaaaaaatgaacaataattatttcatcccatcaaatattgacaagctattattcttttactatatattggctagaattttatgtaaagaaaagcttttcaccattgactcttatttacctacaggtagaattcaaacaggaaagcagatcaaatacttgattctttctttttatttcccagtttttagaaaaaatgagttggtttactagtatcctttaatgataaccagtttgctttttgtatctctatgaactcatagattttaaatatatttgatatgtttcgattcattgcagttatgattcttttcaataatcaaattgtctcatctttggttggtaagagtgtcttcaacttggctttctagtcctttaaactcagttttccttaatgattctcatgcttttcagtgttaagatgtggtaggattgttttgcatatttcctgtcctggttttagaaacagtcatttcttggaggagccctggttccttatagtgaaaaagggtatttcaagaccacaggtcggtagggctgttcactgttaatatgtaggttgtttctaggtcttttcagtggatcaggtgggaaatatatatttcaaatagagaaaatacattatagtttattctgacatgcccatttaggaatatgaggcttatagttaaattcattaatttcatatttgtatcttttttctcatccactgaaagttttgattcctaataacttatttgctctatcatagctctctatatatcatttcataataataatagaaatattatcatatacaacatagtggctgaaatgactttgaaagatttcttagccacgattttatatttataaagcatcccactaggcatctacaatcaaattacctttttttaaaaaaaaatcacttgaaaaaattattttatggttaagccaccaaacaacttcatttgcttcatttgactttttgcctgaaagtattttaaatatttgttttataatgatgtaaaaacttttacatagtttcaaggtcaaatttgcaaaataagttatattcagagactagactctctagatccattcatcctgttttcttcctcactaatgtgtaaccattttatttagggttatctttccatttgttagaaatattatatatataaatagtttgtttaaacagtccgcttaagaatatttttctagtcttttgctgctacaaataatcttgcaatcagttgttttgtgcacgtgtcttttgctttttgtcattgcatctttaggatagtttgtttttttttttttgttttttttttttttttgaggcagagtctctctctgtcacccaggctggagtgcagtggcaggatctcagctcactgtaaactcttgcttcccaggttcaagtgagtcttctgcttcagcctccctagtagctaagactacaggcgtgtgccccacacctggcttttctttttttcgcatttttggtagagacgggtttcaccattttggcgaggctggtctcaaagtcctgaccttgggatccaaccgcctcggcctcccaaactgctgggattacagttgtgagctaccgtgccctgccaggatagatttctaaaagtgtgattactcagtcaaaaggtaaaagtagataaatttattagatgttgtcaaattcttctttgggagtaatgccattttccaatcctaagatcagcatgtgagaatgtgttctgtttccataggttctccaacaaattatattgccaaactttatgttccaaagctttgtggggatatgtctggtagttgattggggcagagaaaatgagaaaaacttagtatgaagaaaagagtcttaggcttgaaattaagacacaggtttaattcttgaccattgctgatcacttgtttcaccttagacaagtcagccaacttttttcatctgctccacagatctgtggtaaggattaaatgagatgacatccatgaaacatatgacagaataccttgccatagtggctactcagcatgtaagttttttgtttgtttctttgagacagagtctccctctgtcaccaggctggagtgcagtggcgagatctctgctcactgcaacctctgcctgctggattcaagtgattctcctcccaaatagctgggattacaggcatccggcaccaggcccagctaattttttgtatttttagtagagacggggtttcaccatgttggccaggctggtctcgaactcctgacctcgggtaatctgctcgtcttggcctcccaaagtgctgggattataggcatgaaccactgtgcccggcctagcatgtagtttttaaaaggcaaagcaattgaaatttgtaaagcatttggatatctacaaaagttatttgacgagaacatacaaggggacatctcttatggactggtaattttaggattgtctacttgatgttaactaaatatccttcctaatgccaaaccaacacatggggtaagaataagtgatgctggactaaaaaaaaaatttgatttctctatcaaatgtacttttaggtaaaaaaaaatatgcaaagtataaaatatttgtatgggcaaatgttttactaagggtgtttgggttattttctattgaacaaaacctgctaaaccagcataagatgcactgaactaaagtgcagcagagatgctactgtcagcaagagaaggattcaaagagaggaagcccaatccgagcattacctggacaattaaacagtcagttattgggattttcacaattcttagcttttttaactttcacaattcttagcttttttaactttgagttttaaaaatcatgatggagagaaatttagttcttaacttttattttctgggcttgatgaagattgaatttcatcagagatgagctaaacaaattaaaactgaagcatttaatttagaaaactcaaatttcttcagcctaaaattgttcatttaaacaagtttgttagattctcaaattaataggatactgaataaatatgaaattattctttcctggaaagttaaatggaaaaacaggacagaatcgctattttataactaatacatattaagtcaagaaatagtaaaggattatttgtcttcaagaaaacatcctgtaaagaatggcaatgttggtggtatatagatgtaaaatgcttaaaaagaatgattatctagaagatgttatacatgttataattatctttaagtctgccttctctaattctgtaagttaaacacaaatattgatactttaatttttaaaatatttttaaaagtagctgaaaatggggctccatccttcaaagttctaacaatacaatttatagtaaagaatatgtatgagaaacatttgttcttagaagttcagaaaaatcaaatatataatatgaagatagaataatgtagagaagttaaagaggagaaaggggtgactgattctgaatcaagtgagttttagcttcttttaagtgaaatcatgcatgctcctcacatatgctaatgtataaaacatcaatttatagaatagtatttgaattacctgcctaggctttgcaagcctagacctttgaatttgcattcaaattcttgatgtacattttctagctgggggactagaaagcaagacactttcctttcagtaccttgggctccccatctattaagtggagatcattaaaatctgccttgcaccgctgtcctaaggatttgagataaagcatacaaagggcttggcacatagtaggtgctcctaaatggtaactttattcttcacatcaggctttgcttatacttataaaagccagttttgtagataatttgctgaatagaactaagaatagttataaatattgggttagtttatttgagctgctatgataacataccataaactggatggattataagcaaagataatttatttctcacagtctggaggctgggaagtccaagaccacagcagtggcaaattcagtgtccagtgagtacctgctttcctgtttatagacagcacgttttttttctgtagcctcgcatgatgaaagggagcaagagggacctctttcagacgctggtcacctccctaaagccccacctcctgatatcctcacattggagattaggtttcaacatatgaattttagggggacacaaacattcataacatagaaaatacatattattttaaaatgctttcttattctttattatgaccactattaaaaccaaacagaaaactgtagaactagccaaggtatcttacagagatatgtttcagaggagtgtttattagattctgttgtatacactatttgtttagctttttctgttttttaggtcctcggcctatgctattacagaaagaatattactctcttttgtatttactattggtttcctgagggaagcaattattttaattattgattatttatggtttaatggggaaccattgtattctaactcacaggaataaaacaataacaaataggatgcatgcaaaatatctcataaatgtgtacctaacaaataaaacatacatcttcaaatacgaatatgcatttagagcctggcttgctgtctgaggtcttaacttgttctgtgcttcaactccctattataatggatgctacacatggaagctcttgggtcaccattggaggtaatagcgccctatagagttttgtgtctgggaagaagtggactttgtagttaggcgattaaatatttaccagcttgccttaagccaagtacatgttaaaggactattttgtattattattttgtttttaaataggcccctttctctcatatttatcttgccttaattagggagtttattgtttattaaaaagctttaatctgaactactttcattgtgtgggtgtgtgtgtgtgctgtttgaaacaaatgaactaaaaatgtttttaattgagctgcaagtgaagacttgtcaatacataaattatacagtattatatatctctatatatgcataaagaggatattttaatcagcacatgtccctgtatttaaaagttaaaagaaccgctctacagagctaagaatacaggtattttaattttttaaatgattataacgggggaaattccactgttgtttctttagtgtttgatgagggattgtaatctaatcagtttaaacgactataaacacagcgatgatcatttaagttggattttgattcgaaaagtaagttcttggaatttagggtattgcacaatctgtcccatacaggggaaaaaaaaatcacctacttgtgatttttactaatttttttccgtgagaatagaatcctgctgggaagcttattttattctcttagatttgcttcctcctttttttccccctccggagaacgatgactggtttacaaatagcaatttatatcaactgacacagtcctttttccttatactgttgatctcagaactgttctgcagtcctgaagtatgaaacactattgccattttttggtacagccagtgctctaaaaaatgtaaatggatgaaagcgattcaatctattatggaagcagaaacatcttcctatttgctttacaaatttttccgagtaaaatgcagtcaggtttgtaacattgcataaaaacttgttttagaattctttacactaaattaaagatgataaagcaatctgcttttcatactaaacagtgaagtgaaaagcattattttaaagaaatatttctgttttgttagtgtacgaaattctgtaatagtggctaacttctttaggaacctttttaggtgaaacttatgattgactatgaaatctattctaggacaaaataaaatgagaatagaattatatgtctaattaaatgatatatctaggcaaactaaccattcaagttttaatttttatgaaaactttctatgtgcccctgacatctgtacatgtgtttaatttccagtgagctcaaaatacttcaagtgatctcatttgagtattaactagggaaatacattcacagtccagcaattttcttttatgtctacattattttaaatcatagcatagattttccactgtgctttatgaccagaacacatttatttgcaaagtattttcacttaccttatattgtagtatgtagtataggacaattgatacggtcaactgtttaaaacgtcagatgcaatgatagagccttagcatttatagatgtagcattcacagttgcaactctttcagtttcagacatttgtgaggaatctcataggtgtgtaatatggtttgaaatttgtgaggacagcaattcgtgctctgactctagtcattggcggccagtgagcaagcgcaactgatcacccagtatcaacttcacaatgtggtttccactaatcggcaccttatattaatttttatgaaataataaaaaccttatttcatagcaggagcgggtacccaaaaagtagttaaatggctaatcctttacagtttttatgtttttggaaatttgtgatctcaagactatccctcaagaatgtcaaggttttgctgaagttaaagacatttgttattctgtggtcagattatttcagtagttgagatgtagtctcacattaagggagaaatctgcaaactagaaatggtttgcaaatggcaaggcaaagcattcaaataactgttacatgtgataaaaatctcttttgggtttcaggatgacaaggtacagggcccagggactggcatttaaagagaactcctatacacacacttaaattcaacaaaaaagtctgtattctataatatccaattaccttaattgtgtagtggggaaaatgaagagttgaatttctggttagctagactagggtaggaagacaccagctctttgtttgttttgtgctttgacatttcaattttcccgcttggctttgtccttctgtcttcccttgacattgatgattttgttgtaggtacgtcacctccttgaatctactgatatgaagagaaagctataactaaagttaagacaatgttaaagtaaggtccaattctcagttatctacagggctatccaaaagaaaaatggaaatttcatttaaaatagctgcatcttttaagtaggaatattttgggctattatatgccagactcatcactggtgctatttaatttctcctcccatcaatgagagctctccctgagacacattgtgagatctttctgaggatgaaatcacttaaccccagcaacgccactgattattttcagctacaacaaccacacttctatgcacacacatcaatcacgccaaaaaacattctgactaaaaagctcaaaagaaaataattaagcattctcttttccatatgaagatattactgaccagcagaaagtggaaaaatgtatacataatgtttatagatactgacttaacaatgagtgaacagttgcgtctcacaaatttcagcagcgttgtcttgacagtggatcatggtgcttctgtgttgctaggcaacccgaggggatggaaaatttaaactcaaatttacttatgtatgttagattttagacatattatattgagagtgtattacacatgtcattacaggctagttgtacatttctattctgtcttttatgtgagtttctcagtatatacatgaaagacactctgcctgtatccttgctcctctatttttgaaaattaacatagtcctaatatgcatttttatggttgacagtcgtggtatatgagagaaaatatgtagcctttgatgtaaaaagattgtttttaaaaaaacataaactttacaatatatgcttgtgtgtgtcagtcagagggggaggtggagagaggcagtgtttctgaaacaagagatctatgaaagaagggaacagtctgttagttccacctggttcttctcatttaattactataattaatatatgcagaagaaaaattaatagggttcttaaatccagggagatattaaatgtcaaaaatgtggatatttgaattaaagactaatcaacttgaacaatacattataatgttaaagaactggtagcatattaatttcaagtgagagttttaaacttgataactgcagtggttttgtgaatccaattttaagagttaaatgttgtgtcaatgccatgaatcagagaatagatatttataacaaaagatctgtatgaaatgatgcataatagatggtgatggctgaagctgctgaaaattgatggtctaaatcaaaaggatggattaggaatctttgcggaattattacagacctgtagttttgtgagaaaagcagagaatgtcaaggtcttttacttcaaggaggatttgaagtatttgggggtatacattattgcattagcttagtcagtttacagctagctagacagtgcaaacttgtgaaggaggatgttttcagtatatcacactaggatcatggcaccagtcctgaagaaatagggggaacttttgatctccatcataccatatacacacctatgtgtgggaatgctaatgggatagaatctgatacagttagggtctgaaacactacgagttcttatggtactttgattcaatatttagttgagtaattcttgttcacttatttgtattatcctcattagattgaacctgtataggtttatctttgaaactaaagattaaattgaatttaagttctactgtattttttatcaagattatttttaaaatagcttgtatcacaggaatcctgagtacatacctaatactatcctctactgtatagaaatttagtaataatgaaaaagtatactcctggatttggttttctgggcagagaaaattaaaaactttaagcaggtatcatgtagaataacatactcaacagatattattttgtgggtgacaatttttatagacattatatgtcagatgaaatagctaattaacattaattctattatatttaacataacaccctatatacctcggtgaataaagaagatttctaaaggatgagtttaagaggtattgataaggaccagatatttagtaaagaaatcccatgattccctagatttgtgactcttcagtgacacatttaattagttaatgctttgtgaatcccagaattctttgtatatactgtgatataccatatttttgtcatagtaacaacaatttaattctgattctcctatagatgaatctctgcgttctatctttcatgctactttgaattcggtttttaaaactgaatttaaatatcacagtacttatcatatgatattcaacaacctgactgttttccattttattttattttatcaacttttattttagaatcagggagtacatgtgcaggtatatatcacacaagatatattgtgtgatgctgaggtttggagtacaaatgaatctgtcattcaggtagtgggtatagtacctgataggcagttttgttttgagacaaagtctcactctgtaacccaggctggagtgcagtggcacgatctcggctcactgcaacctccacctcctgggttcaagcacttctcctgcttcagcctccatagtagctgggattacaggtgcctgccaccacgcctggataacttttttgtatttttagtagagacagggtttcgccgtgttggccgggctggtcttgaactcctgacctcaggtgatccgcctgccttggccttccaaagtgctgggattacaggcatgaaccaccgcacctggccccagtaggtggtttaaaccctttctccttctctctctcccctctgttgtattgcccagtgtctgttgttcccacttttatgaccttatatttttcttctttaaatcagtaattttttatgttgttaaaatcaatttttgcagagattagaatgtatttggcctaatttctcattcttaagtaaaacaaaataaggacataatttatagacttgacatatactgattttttggtatagatcactaaataagtactgaacttttttctttaggacgtttagagtttttgacaggtatatagtcaagccctgctctcttttacttcctttttattctctctgatgatttgtatatgaattcattctttattgatagtatcaacatgacaaaacatacaaggcctttgtcctaatggatcttataaatctaatgcaggaggcagacagtaactaaacaatataattgtatatgcggtaagtgctatgaaggaattaaacaaggtgacacaacagaaagtagttgtgtcgggcaattttagataaaatggcgagtgaatgctgtgcatggaggtgacatcttgccagagacaggagaatgagaaagagtttggcatgtgaagatcggggaaatgagcacatggggcagagggagggaaatgtgaaaaggcatgatggtggggagtgtttgaggggtgagagaaactatcatcagagtaacaggcaacctacagaatgggagaaaatttttgcaatctatccatctgacaaagggctaatacccagaatctacaaggaacataaacaaattcacaagaaaaagcaaccccatcgaaaagtgggcaaaggatatgaacagacacttctcaaaagaagacatttatgtggccaacaaacatatgaaaaaaagctcaccatcactggtaattagagaaatgcaaatcaaaacgacaatgagataccaactcatgccagttagaatggcgatcattaaaatgtcaggaaacaacagatgctggagaggatgtggagaaataggaatgcttttacactgttagtgtgaatgtaaattagttcagacattctggaagacagtgtggtgattcctcaaggatctagaaccggaaataccatttgacccagccatcccattactgggtatttatccaaaggattataaatcattctactataaagacacatgcacacgtatgtttactgcagcactattcacaatagcaaagacttggaaccaacccaaatgcctatcaatgatagactggataaagaaaatgtggcacatatacaccatggaacactaggcagccgtgaaaaaggatgagttcatgtcctttgcagggacatggatgaagctggaaaccatcattctcagcaaactaacagaggaacagaaaaccaaacactgcatgttctcactcataagtgggtgttgaacagtgagaacatatggacggacacagggaggagaacatcacacactggggcctgttgggggaggggtgggaggcaaggggagggatagcattaggagaaatacctaatgtagatgatgggttgatggctgcagcaaaccaccatggcacatgtattcctatgtaacaaacctgcacattttgcacatgtatcccagaacttaaagtagaaagaaagaaagagaaaagaagaaagaaagaaacaaagagagagagagaaagaaagagaaagaaagaaagaaagaacgaaagaaagaaagagagagagagaaaggaagagagggagggagggaggggatggccaatgtgactagagtgaagtaagagaggggaagaatagtattagtcaaagttgaaattgaagacacaaactggctattcaagactttatgcctgtgatgtggccaggcatggtggctcacacctgtaattccagcactttcggaggctgaggcaggtggatcacttgaggtcaggggttccagaccagcctggcaaacatggtgaaaccctgtctctaccaaaaatgcaaaaattggccaggcatggtggcacatgcctatactcccagctactcgggaggctgaggtaggagaatcacttgaacctggaaggcagaggctgcagtgagccaagattgcaccattgcactccagcctggccaacagagcgagactctgtctcaaaagaaaaaaaaagtttatacctgtaatgagatgagaagttcagattttccagtgtgtgttgtataaatgaaggacccaattttctcagacagaagataaaaggagttgaggttcgtaacgaggtgattttaaggatggatcatagaatcatcaagccaggaaggagagagtgaaatcaaggagaaggtgatggataggagaaaggaccctgagttattataacagagtccaagagtcagagagctgcacagatggggtgggatatgccaggtcaaggaaagggccatgggagtgggtgcctgatgcggagaggaggaaaagaggtcagcgaggaggtaaagagcctgggcacagtcatgttggtagattttacagttacataaggagaggtaggaaggaagatggcgaaccagaaagtaagtcattaataatggctggaaggtggttttatgagggatgtggattttcagagagaaagagaaaactgattaagaagtagcatcaaagaggagcaaagttgatgcacaacctatctctagatcttgaaggtcttatagaatattgtttctaagtcagaagtatgatgacagggggaggagccaagatggccgaataggaacagctccgctctacagctcccagtgtgagcgacgcagaagacggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcggagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagtacgcagctggagatctgagaatgggcagactgcctcctcaagtgggtccctgactcctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatgaaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgttgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcatcatgacaggatcaaattcacacataacaatattaactttaaatataaatggactaaattctgcaattaaaagacacaaactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgacaaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatcgaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaaacattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggagacaaataaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcattgccaagtcaatcctaagccaaaagaacaaagctggaggcatcacactacctgacttcaaactatactacaaggctacagtaaccaaaacagcatggtactggtacaaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataataaaaaaaaaaaaaaaaaaaaaaaagaagtatgatgacaaatggtcattttccttaaaataaaatcatatatcactacttactgacttgcacctatatgtacttctgggaaatttagccagcatgtatttccacaatacagggatagtttttgttctgtggactgctaaatgatcacagcctaatgtattgccttctcagtaaacacacgttgacttaaatcagttgggtaaattgtaaactcaattccttactttgactttagtttgcaaattaagaatagtgtacttttcttattttcaggccttatttataattcctaatgctatacactattatgttacagcttgcacttgtattttgacactttctaattattgtcaaattataaatactactaattaatatatccttgattcttcataatattctattaaccagcacttaacacctttttcataaaacacttttcaggatatatatatagttagggcttgttgacactatttcatcttgatttcaatttatgcaatccgaattttcaagtaaaacctcatggaattatcagattcatcactaactttcaaaacttttataacacatctgctgagttttcagacattcattctggaaagaaaaaacatgctggaaagaaaaattttacttactctaatgtgttttattttaaataaaaagtcctataggttatgattttactgtcctctttttttttctgaaaaacattaaggtttctttcccaaagcttattagttaattgtcagtttttatgtaagcccatgaggttagacctatataaggcagtaatttttaattctccctctcttcccacccttccttttcttccctatctcctttattttcttccttcttctttattagtttttaaatatgcatatctctttttataggagaaaggatggataatgattgcagcattctctgaccactctaatatctcaccctagaaattttaataaatgatttactaacattctcatcaggctttttattataaaataatatcaaagaaaacctgctttttaaaaaaatatcttgatacttgtattttaccaaattcatgggtatagataactttttgatttctcattactttcaagtatcttcttcatgtaaaattttaatcaaatttcagatcccatgcttaacacataaaaattaataaattgatgttgagggactatcacattattttatactgaaaagttgttcaattattctaaagttctatatattaatccaaagccgtctctacttgggggaaaaatgtgtgtgtgtgtgtgtatgtgtgtgtataattttttggatctatctatctatgaggatgactgccttattacaagtttcagtacaatttatatatatggattatatctacatatatattttttggttatatatatttttatatatataaacgcttggccattttgtctatttacctatctacctataaacttcagcattttttgtttgggtaattaatattttgaagttttctctcttgttttccttcttgtttggaatgatctgtttgagactgtgtttttaacaaaagtatatgtaagtttgatatacttaaccttatttttcgctaaacaacaacaagaaagaccccctaattttgaaaagtgtccatcaatatcactgtttggcagtttatcataaagattcaatcagtatacagtaaatctataattgaataaataatgttagaagcaaatatcacaggctaggatcagcttaagaaatctccaaaatgtgagcctacataattgagaccaagtgacatttcatttggtgttaacatatactatgtaaaaatggtattatattttcagtgttttaatggaaattttaacatgctttctgatagtttaatatcttttaacttgtgccaatagattgttttagcaagaaatgagtgataatcttaattttattttcttttacccgattcaaacattcttgccttgatcttagaggctggagaataggcagcatgacctctcatctcttccgttctttcctcagccttagtgaagggtgtcccattcacccatttatccacaccatgagccatactgtggatcatccactcagccaccaactcctgcaggtgctgcctctttccaattttacagccactgccttcattcagaatctaaatatttctgcccttgatttctgaactgcctctgcagttagtcttctgctgccctctcctcattcctttcatctgtcattcctgcttaatactctcctagggctctccatcgtgtccagtataaaatcgtactgaaacttgtaatcaggaagacatcccctttgtaatcagatctccatcaccagtccaacttggtctttgacctcttctcactgacattttatgctcctgtcatgctggactctgcagttgctgggcagtgtacccgcatgctttcctgcaggctatcccatctgactctcttctcctaaacctcaccatatttgcatgggtaacatgtcctcaccttttaagaatttcctgaagctctccctgacatcctgattcctgaacaaccacccctttgtgctcacaaaggtctttgtagttacattatttatcatacagtgtttccactgaaagtttaagtgcctgttccccatcgtggctcctgagtagctatgcagagggcgtaggggaagcaatctggtgaaactgggccaaggagacttgtctctaagctacattggcagagcaatgttttacttagattatatctatttaagatggatttagggaggctcagggagattattggagagaggggaaatatgagagaccctaagcacctcttggcagcactgctgtgtttcctctactgtggagtgagctcctggaaaacagggactctgtctgtcatctgtgtgtttcctgagcaccacatagtgtgtgccagatagattgtatgcctgctacatagtaggctcttaataaataagaagtgaattgaggattctagatgctattcatcttcccatattaaattgctttcaaaatgtaaatcctctgtggcactgaagtctatttaaaatatgctcttctgccaaataaaatgtctcctccaggtgatttgaggaagacatgtgggctcaaataagattaaaccaaaccattgtcatgtacatgtaaatattgcatgagtaactagtcttacattttcttcactaatggggatttattctaaggaacttttttgttcagtattttctgatgaaggaatagtcagaaatatcaaaatccttcttactccattttaggctgccatttttttcctaagagctgttatacattgagcatacctaaattgcctttctgaaatacaggaacacactgtattgtcagtaaaatggtctgtgttgattagtttgtctttggggtgtacttgattcatcagatgatggagatcctgctggcgtttcatgcaacctgctatggtatgtgggctttattggcttcccagcagcgacactgacacaaattgtcagattttatgggcagttttaaacctaatgaaatacatccttgagaagcttccttcaccattttagtagctgtacaatttgaaagaaaaaagtcaatgtacaccacacagggtagttcactattgaaatcatggaggacaatgacaacacgcttattttgctcttgaacatgctgtcattaactgcacaatgggatactgatgctgcctcagaggctggtattaatctttgtgccaaaccttgcagaaactctgtgtgcatttactgacgtaagcattgctctccatctctttgatcttaagattactcctttggggatagaaggtaatataaggctgctgaacttaaaaaaaaaatgctcaaagtgagtgaaggtaagagatgttcattttcttccagtactgaaaattaagagtacagacccacatgctattatacaagagaaagtagtcctatgactgctggataatttacatacattatctaatttatcataaccctgggagagtggaaatattgctattcttattttactagtgagagactaagtgatttgctggtttttgatcccgggtctacatgaatacaaagctacatctttaattagttctctatagggtctcaaagcagtcattttactaaatttttgatctttattaaacatagatgcaaaagtaataataatatttccacaaataaagggatgttaaccaaaattaatgttcaagaatcctttcagtgtttctctacctctttaaatattccagaaatggtgatacagtcaggagcaatatattgccaggaactttggcaggacgagagattactttttggatagaatcagttgcaggaattttccaaacgattcacacagcatcaacttaatcttctggaaaacattttagggaccacaaatacatattgtacccaggatgtagtgtacttactgcagtgtggtctatgatttttcttggcatgcataattcaaagacccagatagaaatgactgattttagcacttctaacaataaaacaaaagctcttctacaagagaatatcttcattcatgttaaacatatcaatatctcaagtaagtatgatgaattttgagatagggatcatgccattggggtctcatctggtggtcatggggaaatggtcctctttcttggatatctttggagagtatactatttgactctttagtcaaactgaggatcagtattttaaaagtctataaaatacttaagccatcttgtagaaataaatagtcttcccacccagaccataatctctgaaataattattaggaattttctttttctttcaaacactttggaattataatttagattctttaaaaactgagttttatgactgttttttcaaaaaagcttcaaaattttggcaaatgttgcatttttttttccaattaggataagtaattcaaaaagtcacaacatgcttcagccaaaaatccattgtgaaaatagaaattagaaatgatctttcaaaaaattaagaaatcattttttgaaaaagtgtggagtcattaattaagtgtttgaccttttgtgccttctcaaatgtccattttcaaaaagacagatgcagttagaaggaaaagactatgaatgtaggttcagggccagaggacaaaaactgttgaaattgccttgatatagattcatagattgcaaatgagcactttttaaaatttaaacccttgaatatggtatctcaggcacagagtgagttctttatatatacaaaatgtgattcttaccgcctaccagctgtcttccgatttcaccagatgaccttccctataagtttgacacgtaactcataaaatgcatggctctggagaacaattatcatgacgggagtatgctttcttgattatatggcaggatcctctttcccacctctgcttttgaaggatattaaaggtgagattaaaaatgctccagttgttctgcttgtctgattgtaacagtgaaggagacaaaattgattctagcttatggctcagtgtttcaatgttattctgcagcacttgtttgccagcagctgttagggattattgcaggtttctttgtcaggaacagtgtggcaacaataataaatcagatttagactggctactgaaggggtttgtttaaaagatttaaaaatctcttcagagtcaaagatgttaattctacctggtgaaccagaatgatcctgcatatatcttgggacagacttatattttctaaatctgggtaatgatcatacatgcactgaaaagaagaccatcttctcccagaaatatacaacactgaaagattctctaccaaacatgcatgaaaagatagcaaaggtacaatatttctttaatttgtttctttcctctttcgtttaggtgaaatagaggatacagctctgatcattagaatttcatatggcaaacgctcacacacatagtggatttgaggaaatcaattttcactaatctagaaaattctctcctcaagagaaaagggatttaaaaactttcatgatgtatttaaattcaacatatcttttgcctactttaaatagggaaaaggtgactctaaggtcataacgtgaaattgactttacccttcctggtatagaatggcatttcacattgagaaaaactagggagaagcactgaagaattaatgggcagtggggagagaaatgtagttcattactttattatttgtcgtggtaacacatactttatacaatctatcactcctacttgtccaaatatgtgtttctcctgaggtaaaatttcaaaaattctagatgatgttttggaggttctgtagagaaggtgaatggtatagagctaaagcaaatcttgtatgatttttttatttaatatgtttacttcctatacctatgtctttactgtgtatacatatacacccatatccctatatattcgcgtgttcacttttgatttcaaattttatttgtgaaaaaagcagatttattcttttttttctttgagatggagtctcgctctgtcaccccctggctggagtgcagtggcttgatcttggctcactgcaacctcagcctcccaggttcaagtaattctcctgcctcagcctcccgagtagctgggactagatttattcttaatcccatttatccatgtggagaatatgtcaccctgctcatttcactttgcaaaccgacttactattctttgtacctctctccttctctttttgctctgtcactaatagagctttcagctactaagacacacaggagtcctttctagagagtaactgaaattaaccacatacatcattttggtggcaaacctcacagccaccagtcatttatagtaccaagtccctgctctttgggtaacagtggataagaaatgctacacaagctccttatgtggagaaaagactgttctcctatttggaagccttgtgcccatatccatgccctttgcacatttatcaaataaccgtgacttgtcctttatgttttttcaagcatttgtatcattaggcaaggctctgcctaatggaagagatttactcttactctgtgcccaggtggctcgtccatctctgggtattttcaagcattggaggtggcaatagtgtgcttagcctcaagactgagcaaagaaatgaactttccagagattactcttaaaatatcccattctgagagcacatgtttctcttagtactgtttactccggactttcagggtcagtaggcaagcttttcaacaaatttggtttcttttaaaaactatttttggtagttttgttaaatgtgtctggtaattcattttaagtggaaaagggatggagataaagggtaggtagaattgtaaatgtcctaagcctcttttatcatcctatgtttttgataagttttatctggtaacagacaaacattgtagaagcaagaaggggtttaatgttgttaaataaagaaaatgtattaaaagagaaaaacgaggcactgggctcttctactcttgtttatattcttcacccttgtgttccttctactcaggactccattgtaaatgctcaggattaatttttttgtcatttgatgcagttctatactgtaccttgtctttctgcaaagcaaagataatattgtagtttaaaacttggctatccaccaccatgagggaatatgcttctcttatttttctgcagaaacatttaaaatttcttcagctatattttgtacttacctgaattttaaaaatagaatatagataatacatttccctatttttgtgactcactcactgttattaatagttatttttctaatttgaatattatgctttgttaagttatttagaaccacttaccccatctgtaaataaccccgaactcctatactgtcatcacctttgtttcttctaacatgttgtaatgtaaaatcaaaattattaagttataattatttatgatataagaagtattctgtggataaagtatacatttattttggatatttagaataatttttgtttgtttttggcataattcctttttcttgactatttacaggaaatagctagttataggttttacctaagtctcattcaagctaatggattatgcaaataaagtttgctcactgaaggacaagaatattctgtatcttttttctggttcttcaaggtgatagttcataaagaatatgttccattgacaaagttagttatgttttttagcttattaaactaatttaaggacaaagaagagaaaataattttcaaacccactgtgcttggccctcactaattatgtttttgcctgtgagatacggattttggaggctgtatttgcaataagtgacacatacacaatttataaatgataaaatataaaatatttgtcttaaatagggagatgctgtaatgtctctttcccctcttcaacgtatcatattacagtgattcctcaatgagcagctgaatttccacctgttcttgacgtattacctatcaccatcaggctatgttatgaaactcacttttagagataaagcaaattgtccaaatgtcaccaattattgaatctaaatgtgggcatacaggttttatttgaagcagtctttcagcttttctatatgattacatttttatttaaaaattttgaataggctgggtgtggtggctcacgcctgtaatcccagcactttgggaggctgaggcgggcggatcacgaggtcaggagatcgagaccatcctggctaccacggtgaaaccccgtctctactaaaaatccaaaaaaaattagcccggcgtggtggcgggcgcctgtagtcccagctactcgggaggctgaggcaggagaatggcgggaacccgggaggcggagcctgcagggagccgagatcgcgccactgcagtccggcctgggcgaaagagagagactccatctcaaaaaaaaaaaaattttttttgaataaatagaataatgtgatagcaaatggctagacagctattaaggtggtcaaggaaaacccactaaaagaaaccagcatagtattttgtatgagcatagaaggtgtgggttagagaaatccaatgtctctattttagaaagaaatgtcatcaaggtggacagggaccagaacatgtagcactttgtaagccacgaaaggcattttcattttattcttgtagattttaagtagagatgcagctttcttctcacatattttagaaatatttatttggttaccatatagagccagttctcatatagagaatttattctctatatgagaatagagaataaatttggtgcaagaaataaatatcgggtgcaagatctaaaataggaagacaggttatgaggctgttggatccccattataatggcagcttggatgagataggtttcatgaaaatgggaaaaagcagacatgtgtgggatgttttaggcagctggaatcaatagtacttattaatggcccagaggtctgggtagtaaaggaaagaggagaaactttagataaggcagttagagaaggaaaatcaaggatagattctagatttttgtcttgagcaactgcatggatggtgatgtcattgaatgtgatggaatagatcgggaggggtgcaagatttttcatggagggaaggccagagaagaaacagttctgctatagccatactgaattttaggcaccttttagacatctaaatagaactattgatttaatatttggatatgtaagtctcatctgtatgccatctgttctggctatcttacattcggatcctgtgtattttttacactggcctggaaaagctggcaaaacctagaactgcatttgtcccctctgcgtttataccatttcagttgacaggtctaattttaagttccaccttttcataattgattattcatttgtacacaagtatttgttgagtaccagaaatagcatttagtcatttcaagctttagtttttcatcatcctattctccagatttcagcagcatcagaagccatataaacactgccttcggatggcccttagatggccaccaagatcccctagttacattttctgtgtacaaagcagaagaaagatgtccttcattctgtacacagtgtgctacactgtggtttagtttattattaaagagcataattaaaagaaaaaatatgctatttaggtttggattactaattttaagtttaaatgcctttatatcatatttctttgaagctagacatgtattcaaacctcagctcccccaataattagatatttgaacatggtggaaatagtgaacctatcatctttaaaacaaaggatataaaatctaatagagtggataacatgattataataaagatataaagattataaaatattaaaagttcaatattgtcattagactctaatcaataatgagtatatcacgtattatattttgacatgaagaactatttagccttagagctttgaaatataactaagaaatctattaaaataaattaaatagaatatattccaaagtaactaatgttttcccatattaactcagaataactttgtctgaaattaaactgaatatatatcatttatagatacaagcatagagtttaaattcaggtaatcttatttggatgtacaaaccgtgaatagagacattaaggaaaagtagtcataattaattatatcgaatcttcagagttcacaccattcctcttcctaaaaacacatacaggtttaggctgatcaagatatcaatgtctgctctgagatcatcaaagtaatgcgtccattctaagaagcactagtggcatatatgatcacggtagaagagcaagaaaaggagccctcacttagaaccccataagacaggaaagatacagcatcaacctctcctctccagtttatctgtgttatggattgtaagagtgttttgaaataatattttacttagtaaagtaatatccacaagcatttcaccatgaaaaacattaaacattttaagtatataatatgaaatataccatctctgatgattatttttattgaccatattcttgccaactctaaggtactctaacactagaattttaaacttgttatatttgttactttggtacgaatgtcaaagaaaggtattacctgtaagtattagagcattcctcattgttcctaaacaaagaatttctttttatgtagtctgcactaggaattggaaatgatgcacataaaatacagctttttaatctgtgagattgtttatgcatcttaggtttgcttagttttgcaaatgcgtgcatttaaaatcaccatttgtattttgaactcttctggcttttaactgtagtggaaatttggattgaagacaatggaaaccgtgaggtacaatatataaacttgcatccaaccgagaaaaaccactactcttatctgcacttcaatcagcaggaggttctttttcagtttgtttagaaaaagtagggcctgtcatctgcatggcatacaatctttacaaagaaattttcttttgccctttgtgttttaactactgagtgctgcagaaacttctgtctaactgcaaaacagtttaaggtatcatctatgacaatgttaaaagtaaaacccaatcaaagtttatattatcatgcataatagaccaagcaccattatctgaataccaaacggggccaaataattctctatgattcagatgagacataaaagtgctttaaaaacaagtatgtggtaaaaatcactttggaaaacctttggcattatctaatgaaattaatatgtgcctactctatgatgttgcaattcaacttgtaagcatatactcaagagaaataggtgcacatgtgtacaaagacatattcaagaatgctcataacagcactattaataatatctaaagctggaaataaccaaatgacatcgctattggcatgaataaatatttcatagtatcataatattaggaatactataaagcagtaaaaatgaacaaacaactgttatacccaacagcacgggtgaacccttaaacataatcttaaggaaaagaaattagacataaaagagtatacagtgcctgattccattcatataacattcaaaaatagatgcaattcaactttcatgctagatagaagtcaggatactagttatctttggaaagggtagagatagggaggattcttagtatgggcaatattctcttttgatctatatgatggttacataggtttttatatgtaggttattaaaataatatactgataatatgatcatacattgaggtttttatttattacaataagttgagattattcaaaggtacatttgttcatttttctatacatatatacattatatattacatatacatatatataccaatttttaaaatgttctaagagaaagaaaagctcaataaataaaaacaccccatttccttgtcactagagatgaattactattatgttcaaatcgtatatacagcatattttttatatatgtatctaaaatatgctgaataagcaaatcaacaactacatctagacttctgcatcgcaaaccagaactacatttaaatgcattttatctcacacttaaagaattaaaataaaactcttttctgaacaatcttccaatatattgaccataagtaaatgtaatatgagtcaattattttaaccgttttgtaactcaatgtctgttggatttatcttgatttttataaagttcagcaattcaatttccacattttcttttgtttctatttttgtgaggcactatagtttttatgtaataaatgttactgatatggcctcctacttagaaaatgttattcatgagagtatattgattttagcaaaatttacatatttacatatgtacatccacaggtttgcatatgtaaaaatatagattatttacttactattgaaaaagtgtattatggaagataaaaggttttcatctctgtcagatacgacaggtgaactttggtaacataaggcctagcaaagttttattgatcttacatatatatatatataaaatggtttttcataatttcatgggatgcatcatccaagagaatgatcacagtgatactaattactgccattgactagccacctgccacatgccagacacatggtgacatggctgatgataacatgtgataggtgtttcccaagagagtccctttaaacaaggtttttttcctgtcttcatattgatgaagtgttttttctaacgccattatttcatttattctatgaaagacaaaattggcattttaaaagtagaacacggtcttttgatacctgtcatctgagatacccaaaggattttttttttaagttagcatcaagggtaaataataacaaatgaagttattttatgttagatcttgtaggtctaaatatatgcacagcaatatttaacatcctgaaatcagaaattttgtttctgatggcatctctttccattatgtgatttgaaacattttagggatattttcctgtctactttgcatggaaaaaactacagactttgtcaaatctagttgccttggaagaagaatgaataagaggagatgtgttaaacaatacaaaatatttttgctatttcaagtttgaattgattttgaaataatagtttcaggctaaataataaactgtctttttaggaaacaaaagaagtattttagaaaaagacattaaaaagactttattaaaatagaggacatgatgatcttgtttgttgctttaagcagtttatgtagtaactttaaggtggtagaaagtgtcaggaaatcaatttgaaggcaaatcttcacatatgaaaagaatcagaaatgttaactcaggtcttaaataaaaaggaagaattaatatgatatattaaaagtgatacgaaagtcaaaggaaagattgatgagacttattaatatgaaatgaggtttcttcaataaatatgtaagtacaaaaaagttaaattgtattaagaaacttgagatttaaaaaaaaaaaaaagcgaagtatttaaactacccctcttgagctcccagccacattcctcttagttgtctaataataacacttcttggctatttcactggatatttctaaatgatagggtcctattcatatatctcaacttgtcaatttttaatatcatcaattgacattccttttttagaaatcatgacttagctacttatactccatcttcagtgcttatccttctaatgtaatactatcataattttatttaaatactatatgtcttttatgacgtaaatattgtctaatactaaaacatctactattccatgtttctgtgttttatcttaagaggttaattttatttgtttatttttcctgggtctttagcttttcttgtattcttgtcctatttgccattattatattattttcccactaacatttcaaaatattagttattctaaatagtctgacttttctttagagttcttcactcaaagtcctctatgttctgcctgaattaggattgattattccctatgcccactgtactgtttttctacattggatctaccttgtcagggatccacaccttcctctttcttggtttactttctcattttgctggagcacatcctcaaatggcttcttaagaaatattacatgggcagtgaattttctgagtccttccagtttaactcattgcaatatacaaaatggcaggcccattcaatttatatacttattccttcaagttttggtaatttatctgcattattattaaataatatattaatatattacttaaaatataaattaaaacataaattccttctaatttctccagtctacttttttgaaactcccatgagtcaaatttttaccttgttgtattggtgattgatattatcatttctctcatattttcagtatttttttgtttctcttttgtgggtgatgccttcaacttttttgtccaagagtcatattaaaactttattttaaaagatttgtatttttccctttttaatattattctatttttcttcttgaatctcttcaaaaatattaattagcagtttgcttttaaaaatattatcagttttttaaataagcatttgtcctccagattttttcccctgtttaatgttgattcttcttttccatgagggactatttacgcaacaatctacataatctttattccctactaacatttaactgtgatatcctaaaatggcctgattgaggaactgattgagatgattaagagctctgtagcagggcgcagtggctcacgcctgtaatcctagcacttctgtgaggctgaggcaggcagatcacctgaggtcaggagttcgagaccagcctggccaacatggcgaaaccctggtctctactaaaagtaccaaaatcagccaggtgtggtggcaggcacctgtaatcccagctactcaggaggctgaggcaggagaattgctaaaaacttgggaggcaagagttgcagtgagctgagatcgcaccactgcactccagcctgggcgacaagagcaagactccatctcaaaaagaaaaaaaaagaaaaaaaaaaaaaaaaagaagtctgtgtatagggcaggacgaaaggtgatttggtagaaagctagctgttttgccaggcagcattaaatgtaagaatgtgcagattttttcctctgggatcctgtcatttctccagaatggtaatctccatacttattcctggaggagaggtggttacaagtattctggggccacaactattcttggccttttgtctacccctgaagtttccatcactggaataaactggacagttagacagattaacatgagaaaaggcatacacattcattacacgcacatgtacctggaaggcaacaaagtatgagacttaaagaggggccagatggttgaaatttagatagcatctggagatacggaaggaaggaaataaggacttaaagtctcttagtaggtggtggcaacaagctgtgggagtgtgaggagaggaactgcatggcaagcaaaggttgtcatatcatgaagataaagtctctaaggtagcaatcctcagaagaacacgtgaaaaggtgtcccaggcgtggtgtcccgggagtttcctctcctgagataggatttaatcttctctagttcatgtagattccagggaaggggttcatgacaattacattccttctggaggaacttcccttagataagggggaacttcagagaaagcctctccctgtgcttgaggagaggcagaggggcgagagatgggagtggaaggcaagtcagagagaacttggttctaaggtggcttctttagtccaaagtgctcagctcctcaaagcgccatactttggagtactattttctgagccctaacagccacaaatggaagaagtattcccctgtacagaaaagtttgcattacttttgtcagattatgtctcttaatataatcacattttatgaataagttttatttcacttaacagatttatttattttttaaaaccacaactttaattcccaagtaactcttagaagtttctcctttttggattttcattttgatgtttagtaggcttaaattccagtgtttaacacaacccccagcttttgagtcacagtttatttcattatagtagacccctgattgccaaattacaatatcttatgaaccgggcaaaatgttgacttatttaggacattatgttacctatttattccaaaatatttcatttgaaaatcagctacattcccatgtagacttttctttatacaaaagttaaaataattacagaaaggtaaattattctgatgctaaaattagcctttcattgatttcaagtagattgtaattggctaggatcaaatacatgctttatgtaatacagtttatttcttaaactgatacagaaagtgcacataattctggaagtaaaaatgttcaaaagctaagaagctctcatgttatttttcttcaatttgctacaaacatatatagagtgtagttattttctagccataagaattagcagaagctttggagagaaaaggtaggagactgaatgccctgagcatccctttgaatagctcaggcaagaagaggtgctattatcccaggaggagactgtaagtgacgtttgtgtaattcaagtatgtcctgcctggataaggacttgtgggtaaggaaacagagtagtaaatagccaaagggaagaaagtcagaaaagcttgctgtgttcctccacttaaatatatgttatttctttagggactgcaggttttacaaagagatgaagactaattcggaatgctacttacctctgtttccaaaagaaaaagactcctccagaatgtggttttaagtaggccatggaccaaaagtaggccacaaggcatggcaggcagctttatgaacttcaaggttctaggaaatttcatccattggagagttctccagtgctttaaacaatattagaaagaaaacagcggtacaaatcaaccatgctagtaaaaatctctcctgcaagacattactgagtggtgaagactaagtggttttgccattgttgttgtattgttggttggatggtttgccttggatatttgcttgcttcttttttgttgatttttagcatataaataaaatttataagcccaacaaaagaaaagaaagcaatctttcaagaggctttaagataacatcatacattttcgaggtttttaaggctgagattctattttgttttacttaaaaggaatgttacaatgctgttaacgtttttgcttattctacatttttgcttattcatgaaactcgggagaaattctgtctattggcaggctctcattgtgtattcatcaccacactaaccactcatttactccgaaattaagtgctcagtgatatgcatgttataaattcattctcagttgcaaaattttcttggtgcttaagaaattgtactttaatcgcttttagccaaaaagtttagcaaaaatagtactttgacatagtactgacagcctgtgcttagattttgataaatgtggacaaaatcaatagatagatgcataaggagtgcccagataaaatcatcatacttcaaaagctttttctaacataactcacagctgtagacttttcctttcaataataagcaaaaacaattttcatagctacaaaccgccgacacaactttctatttaaagaggacttctttgcaggaggcagaataataactcaacaaaataaatagaatctctaatttcaaaatactattatccccaaaagtaatgggaattttaaaaattatttagtgtttccagtttagatatttaagaacaccactcacatctacatgccaaataaattgactccaccctccacccgttatatcagggccccactccatccattgtcttttttcttagttatatcttgatatgtcaccctattagttttttccttgcagcatttcacttgcttcttgctttttttaaacaaaaatttatgcactaccctccctgcatccatgttcctgctgcctcatattcattcattcttcagctggtggcaatcagcattcagtttctctccataaaactgttattaaatccaataagcctttcatttctgaatcaagtgaagatttttctctatctttgctgaattctttatggcatttaacatgtcttttcactccatctttctttggggactctcttccatgacttctaagacaacactttttaattctcttccaccattttaggtttgtctttgtaggtaacctttatagattcttctgtgtaatccttacataccaatgttctgaattccattctgctcctctttttccattccatagagtctgattgtgtacttgcaaacacttccatggtatctatttcaagtgtattttgaaaagtctaacatctaggctttcaacttgatctgttgtactttctgtattctatacctgagtgtcagcaaagacgcctgggagctgtctttgagtcttccttctctcttacctccatatttaatggattaccattctcattgattttaccttcttaatttctcttaaattgattttctttctctatacctaatgttagtacctttccgccatgtttctatctggtttacattgctggaacagcacctgatttgctatcttgttcttagtcttgccatcccaacttagtccattcctctgatgtcttttcctttatacagttatcataccatttatcaatttgcattatatatctgattttatttacttataagtcatgttctttgttagctcattaggtaccaattttatatcaatattatttttctgtttgtcattcagtccatttttgttgttgttgttttggtttggttttagagacgaggcaggtgaataggtatagactgaatgctcctaagctagatgataatgaccaaatgattactgagacagggatgagcgatggtcagtgaaattgaaaggatattttagcagctgctttaacaagtatctgggaaaagtccggtctcttccttgcatttctgaacgttaatttgtattaaaagcagcatgactcagaaattttatataaaactcaaataaaccttagaattggatcttatcgagtattgtgttatacagagaatatggagaatatgtgggataaatgagtcaaatggtatgttaaaaaaaaaagtaggaagcatgatagactcaattcttaattcctagaggaaacagagttatgtccaaggaacatattcaacccaatcactgtacagctgtagctttttcttttctttctttttttttttttttttttttgagacagtctcagtccattgcccaggctggtgtgcaatggcatgatctcagctcactgcaacctctgcctcccaggttaaaacaattctcctgcctcagcctcccaagtagctgggattacaggcacctgccaccatgccagctaatttttattttatttttttgtatttttagtagagacgggacttcaccatgttggccagcctggtctcaaacccctgacctcaggtgatcctcccaccttggcctcccaaagtgctgggattacaggcatgagccaccgtgcctggccaatttttctaaataaattaatatgatgatgataatggtatatccaaatagctacccagtttttgattaggcagaagtatgcttatggtcagtcagagtaaaaagtgagaccagcatggtggcatgcacatgtaatcccagctacttgggaggcggagacaggaggaccctttgagcttaggagtctgaggttatagcacactatgattatgcctatgaatagccactgcactccagcctgggcagtgtagcaagaccctatctctgaaaaaagaatcaaaggccttaagaaatattttatttttacctcagaaaatttaaaaattaacttagagctaaatagtttgggtttcattatgtgtagaaatgaatcttgcaacagtaacagtttcccattacacattataagtgtctgttttgagtaaatttgttgaggagtctaatttagtttgaatcactgggaaaagacacaattgaggttttataaaatgtaaaaaatcaaatgaactctgtacttccacttttttacataaagtacatcttccacttctagttacaaaaaattttttttttctcacttgagtcgtttatctgtagtaagtaaatttgggaaaagtgcaagtattcatatacattgttttgcatttaaaagaaaagtgataatgttcaaacccatgctatttacaaaaatcaaaagctcaaatcatgaattctgtttgtgttaaggatttaaaaaaatagtggcgtgagaatggttattgctcttcaataaagatagagataccacgttttgctttaacatatctagaggcaactttttcatcgatagctttattagtaggtcaaggagaaatcatacctaagtagaaaggtccgtggagaaaagagacaaaccatatcagagttaaaattaaattgaaaaaatttaaatcaaggaaaccattttcacttctttcgatatgatgtgcaaaatcatgcattttaaatgggaaatgggaaatttcatagcttcttagcaatgatgtgagctctgtggtctgggtggatgcagggcatgtgggtgcttttgctcatttaaggaaattgcatttgaaacattctcaatacattatgtagccacaagaaaatttatagtgatttctttttggtggaacaaagtatatgctcttttccagctcaggatccttttccagtcttcctacacttaacagccagtacaaacttagtccatagaacgtatttgttgtgcacagacctgcacaaacacacacacatgcaaggtttcacgaatcaggtatgtattttgtgtatgtgtcaaacttagccatcaactggaatttgtgttttagtttggatgctgatttacctcatcagtaaaatgcccttcacttactctccctagacatagactattttccgtaaaatatgttagtgatttcatatttaatgtgatatggaatagaatgagaggttgtgtgaaattaaaatcatgatatcaattatctttctgtcatgcagaataaaataagtgttttgacaagatataaaaaatatttatggtaattaagtacattcatactgtatcagctaaatttgtagaatattgatttctgtattaaattatgtaacattttaattaaaataaatatattgtcgagttgtgagcagcacagtggtaagaatattttgcatgaagatggttacataaatatgcactaaaattgagtctaactgcaaaaaaatgaatgcagtagctacacatttagaaagaagttctaagaataaagcagtttacaaacaaatagtatatatacatgtatatgctttgttagaagaaagagaatttattgtgagtgggatactttaactctttcagatgttaaggattctatttcccaaataacttcattcatgtaagaagtatatttcatgtgagtcaggttttattctctaggtgttttctaatgtgggaaagtgaaatacaagggtttgaaatggttctggggatgcagtctttcctgtcagattccagcagatgctgatataatttaatattcgtggaagacagggcaaatatagaatagcatcaaattgattttgcagagttttcaagccagatgtcccttggcatttacatggaagaagtctactgtgtaccaagttgcatatttttgtgtgtaagttctcagccatggtatgtagtcattggtgttttgacagccatctgctcagacctttatttctctgttcagccataactaaaattgaacatttttcaaatgttccaggtagtttcaattttaagataacagaaaactagtattcaatggttaaaaagaaaaaaagcaatacctatctttggcttagtaataacccctaaattgaaagttaatttcttataaatagcagtgcaaaatgaacaaactttgagaacagaggcctcaccttattatcaaatgagtttgttttaatcatgtggaaggctctcagctagacactgaggaagttatagaaatgggtaattccaaggtgaatgttccaaggatagctatgtcttatacataacaagcacttcatcattatttgctgaatgaatgcgtatgttagaatccatatgtaatagcttgtccatttgcacatattttcaccccactgatagtttttaatatgtggaggtacacatacatatctctgtgttttttgtgggtgagatatgtaggctaacatgtcgtaagtgaatgaaactgtgtttgataagaactgtcaagtgttgactatgcacctattggtgtgctagacattctgaagattcagaagaagtatacaacattatttctaatgttatgattacatctacagacaaagaatcaaacaatgattctttttaatggtaacttgtgttttttaatgttaaagatatgggccaaatgataaagaacaggaaaagatgagtttttttctctatcagaaggatagattttgagctaatcttgaaagaaatactaaatttagacttatggagaataatttaggaaagcaattgaacactacccaggggaggtgggaagtgagatgctgtgttcagagtgagataaggaaataatttgaccagagcatgggattttaattgagaatattaagagataaaattataataaatgtagggaaggtgtatcagagtgagattatgatatactatacttgaaatatctaaatgaagtatttatgtttactctaaaagtcaagtgagagagattctggagtgagacaagaatgtgaggaatggggacttctgtggagtttaatctatagtaatgcacatgaatctgataaattattataatctttgcttttagtagaaatggggatttagagtacatcagtacaggtggcgaaaaatgtgaatttaaaacatattttgaaaaacaaggataagaattagtgtttaaaagctaaaagagaagaatttgtgtcagctgcaaaataaagtaaatacacatacacatacactacatacatgctcataatttaaattatgaactattttatcacactctgctgtgtaagtttttctaactcatattgtatatcagccatgttgtattcttgcattaattaatgtattcattaaatatgtcttcagtacttttttgggtccagcattacattaggcagatatattattcagcaagttttcaatttagttcagggaaagagggatgataaatattattatgagtgtttagaaatattaagaacccgaatccatttatcagtttcataacaatgattttcaagcttgtttcatttctcacagggtagacaaagacaaaatatatatctcataaaagtaataatctaccaggcatgtttgttgtagccaagcaaatatatagaattctaaaaatattgtttatagctcttgtttcaacatgcttgggacaagttaatgtttacagttttgtgagtgaatgaatctatatactgaaaacatttcattcaataagttgaccttcttgaggtttgaataaattttggagcctgagggaatcaatatggtttttaagttgatctcctaggtatgtctaagtttaagttcttaatataattatcaaccctttattattttaatatttcattacattaattatcttttggaatattttcactgatcagtaacttctagtcataagccgttctggtaccaatcatcaaatttcatatttgtaagaaaaaatgactagcctttggctgtcttgacatgcccaaatccaccaagtatatatctcacttccaaaatagtctcaggatatgttttctagatatgatcttagatgatggagtgtattgttaaattaacaagtagtataaaaatagacaaaatattattaaaaatacaaggagaaaggaatatgttagaaacaagtaagaagttccatatggaaaactgataagcaattttttagaagcaaaaatctcatgacgctaaaacaagatgatgaagaaattactctgtgtgcaagtgtggagaaaaatagcttgtgataccatagtgatcttagagctcattatacatcagcaatgaagagctttaactaccatgcaattaaaatactagagagtataaataagattgtaccatgtgtatgtggcagcatataaaaactcagaagtggaaggaattttagtcaagtgttactcttgaaaaagcaaacggattaggaatatttaattggagaacaacatagacaccttctgtaatattattcaagtaagaatgtctcattttggacatcttacttatagtcagattgattctcaaaacactttttaaatgtctagaaatatttacaatggtatttatcctgagaaatgctaaaaaaaattagaaaatgtaaaggtgactgaagttaggaaataacataaaattggtaatgatgagcaattttcttaatggctgttcataactggaaaaaaacagatatgctccgaaatatatgaattgtgagataaactgcagtaaaagaccccaagaaattgagggaaactatggaaatgattgtagcaagtggtagcaagctatttttgtttgcattttgaaagcagtttttagaaatttctaattttgaaaatcttaaattgatttttaggaattctggggctacttttttctcagacctctagggcaaccaattgtagagacttcccccttctgttaattgactcagatctgcttacatattaaaggccacctctggttctcagctggaaaaaagagttcctcccttttgaaacagttgactcagaatcagttccttcctttcagatccttatctttaattactttgtcttctaacctggggtcctaatctttgcctaggaatttaaagtaaagattggccgaatcttatttctcttgacttgtatctacctttactttagctcaccctctgggcgtggcctctagccagtctcactttgagtatctttgaaactctctccttattgtcaaccccttactttgattattttttttaatttaatgtttccaatgtagaaatacatctcaaaaattatgcagaagttctatcatataatgttcttgcatgggtctgaagctctttgaaggcaagggtccttgactatgttgttcattgttgtgtaattactgcctagatgagtacttggaaaggtggagtgattcaatgaatatgtgttgcatatagtttaagaagaactgggactggaattagaaacacatgttccgtctttagcaaatcacccatcattactaatcttccattattttatctatgatattgagcaagtaatgcctatcccatctatattatagctttgttggaagactcaagggataaagtgaaaatgctttgtagagttcagtgctacacatttattatggtcaatgaactgcattacccaaaccaacattaattgtacataacatgtgacaaagaaaggcttatggttttggagtttgtttattttagaagaccagataaactagaacaaatattttccatgaagaagttttttttcgtgttagaactcatgtgattaaattgattcacaaaatttgaggtcatttattaattttatgaatattttactgagcacctatatgatgtcagtgactctaattgtctctgaaaataaaaagattaataaatcatggcttctgccttcaaggaacttagagtttagtggttatagaatgttggtttaaaaaaaatggcaaaaataaaattctgacaaaaactcataatatctgagagtttatatgtgcttgctaaatgaaaagaattattagcaatactatgctgaatgactgtaaaatgctgactttttacttgaaatatttacaagaggaaacagaatatttgtgggtttccctgcatatttatgtgtgtgttcaaacagctgctagagaacaaagtgttttgctataaacactgtcaaatctcactgtgaaaaaaatttgtctataaaacaagtattttcatagatatactaaagctgcatagaatttgcttttatagcataaaacagaattagatgcttgagtcagctatgaaatactttttcatgcaacactcattctaattctttacactatgcattaggctgaggcctggtgtaatttgaaagtgataatgcaatagagaaattccagaagctgggggtggggggaatagactggatattgcaaaatgcatcagttagtcaatcaaactcctaatttatcaaccaaaccaacctaatcccatagagaattcaaagtgactcacgaaaagacacacaaaagaagaaatgttttgtttattttccaagatggaaaatgtaaactatccagaggacagtggtatgggtttagaaagacaattcacacaataaattttaaggaaataatggttttagtctttgatgctaacattatttctgggcttccaagtcactaaaacaatacatacatctttttaaaatgttatttttgttgtgttgtttggttttgtgttttagtctttttattttctgacaaaagaaagtttgccatgtctccagaacaggcacacaatttatgtactaaatcctgatatgaatttcttttcttttcttttctttttttttgaaatggagtcttactctgttgcccaggctggagtacagtggcacgatctctgcaacctctacctcctgggttcaaaatgattctcctgccttatcctcccgagtagctgggattacaggcatacactaccatgcctggccaatttttgtatttttagtagagacagggtttggccatgttggccaggctggtcttgaactcctactcaggtgatcctcctgcctcggcctcccaaagtgctgggattacaggcgtgagccaccaggcccatcctctgatatgaatttcttattggagaatccctttatgtgtccagccctgtggtaggctctgagaatatagtaatgaacaaggtaaacaaaacatacatagtctctcccatcatgaagcttacgttccagcaaggaagctagaccttcaatagataattatcatttaaaattataccttgtaatcagtgctatgcaagaaaaataaggcagaattaggggctgtaatgaaggacctgtttacaaagcattaggaaagccctcatggaggaaataagacaaggaagaaacacttgtgaacaataggaaggtatgtgaagtgaaggagcgttaaggaacagagatttctagacaagccctaagcaaggaaaaagcagagctttattctagaatcggactaaaggcagtattcgttgaatgtgatcagaggacattgtaagccaggataatcattttgaattttaacctaggtacaattatgatctatttttaagaagactgacttgatcagatttgaatcttaagaaaactcattatgtaaaaaaagggctaaagaaaggataagggtagtcagcaggccattcaggaggctattgcagatgtccagatgttacaaatgcttgtgacttggccccaagtattggcaatgaccctggagagaagcagatggatctgatatttatttcggagttagcataatatgaaatgatgcaatggcatcaataacgactcccggttttctctatgagacactgggtgggtaaactaagatgtgttgagcttgagagaattcaggagtagctaaatctgggtgtcccttcgggtggggattagaacgctgaaaaccacgaactctactttggagagtaatattaaatttgtgatgttcctgagacgtctaaaaaaatggagatttaaccaggcatttggatatatagctctatactttcagaaagatacctggtctggagatataacttgggagttattgactctacagatggtgtgtaaatgggttggaagtgggtaagatttggggaagagaagaatgaaataagaaaatgatccaggattaagccctgaggaacgataatagttactgataaaaaaaaaaaaagaaaagaatgaagtaaatgaatgtgacttttctgtttcattttttctaagtcttttaagccagagaaaacataatgtggaacagtgtttttatgtgtgttttatcactagagataagaaattgtcaagctgtccttaaggaccagggagggcccatggggaacagcatctttcctgatgctgttgtattcatcaaagcatagatgagtctcttctgatatttttgtttgaggaacatgaatataagctcatgctcctagcatagcaattagtttagagatttatcattgttttatttttattttttgaattattaactgcagacaaagccctaaattttttttgttttctatatcacaagtacctttttttggtttaaggttctaaatttcattttccgtgacttgaaactgttttgcacttcctctccttgctttatattttgagtttacacactaacctgccaaagagacatctagtttataggcttgattttggaagaaagacagaagagagcagatactgaacatatgttccgctgatattgatgaagtgaggttggaagaagcttggaagcagtctatttctctccaactgccaccccctctatgaatattttgggtacccttatgctggaacattccaaataagtgccccagctatgggttttttttttttctcataatgattctgaaagcctttgggatgatttaggattgttctacaagtggaacataaaccaaaacaaagcagttcgtggactctaattttaaatgggtgatggatgagatttcaatgcaaattgtaaagactgaaaatgatgtgaccagagaagggacccctagatagtaagtactcaataaatgacagaagcagggtatagtatgaacctgtttcttgggaaaatagacttgaagttagacaagaatctatttaatcaaactctagatatgatgttttgctaacttttgttttttgttgctttggttttttggagtttttttgcacttcaagaagtctttttgatctgaggtagtgtagtcaactctaatttattaagcatgaagtgattggttacaggtattttaacaagtatttggaggagtttggggaagttgaagtacgaacacattatttgaagtcactgttacagaggtgcactattttgtccttcctgatgtagccattagtgttcctacaagaaatctggattatcatgacagtttttttttcttttttcctttttctttttttaattttagatttaggggatacatgtgtgggtttgtgacatgggtatattgtgtaatggtgaggtttgggcttctactgaacccatcacccaaatggtgaacattgtattcagtcagtaatttttcagtcctcattcctctcccagcctcttcccttttgtattcctgggtgtctattatttccatctttgtttccatgtgtatccattgtttagctcccacttagaagtgaaaatgtcatattcaattttctgcttctgagttatttcacttaggataatggcctccagctccatccatgttgctgcaaaggacatgatttcattattttttatggctgcacagtattccatggtgttcatataccacaccacattttctttgtccaaccaacacatagattgttgagcacatagattgagtccatgactttgctattgtgaatagtgctgcaacaaacacacaaatgtaggtgtctttttgatatagttagttcttttcctttgggtagatacccagtaatgggattgctatatcaaatagtagttctcttttttgttctttaagaactctccatattgatttccataggggttgaactaatttacattcccaccagcagcgtataagcattcccttttctctgcaacctcaccgatatctaatattttttgactttttaatactagctattctaatttgtatgacttggtatctcattgtggttttaatttgcatctccctgatgattagtgatactgagcattttttcatttgctttttggccacttgtatgtctttttcttttcttttcttttcttttttttttttttagaagtgtctgttaatttcctttgcccacttttaatggagctatttgtttttttcttgttgatttaagtttcttatagtttctggatattagtcatttgtcagatgcacagttagcaaatattttctgtcattctgcagttgtctgtttattttgttaattgtttattttgctgtgcaaacgccgtttagtttaattaagtcccatttgttcatttttttttttttttgcatttgcttttgcaattagtcttagtcattaattctttacctaggccaatgtcgagaataatttttcctaggttttctttttatggtttcaggtcttgcatttaagtctttaattgatcttgagttaatttttgtatatggtgacacatagggtccagtttcattcttccgctagccagttattaaatagggtgtcctttccccattgcttatttttattgactttgtcgaagattagttgtaggaatatggatttatttttgcattctctattttgtctcattgccttatgtgccatttttataccattaccatgctgttttagttactatagcctcatagtctcagagcatagtgtgaagtcaggtgatgtgatgcccccagcgttgatctttttgcttagaattgctttggttatttgggctcctttttgtttccatattaattttagaattgttttttctaattctgtgaaaaatgacattggtaatttgatagggattgcactgaatctgtagattgttttgggtagcatagtcattttaatgatattgattctttctatccatgagcatggaatgtttttccatttgtccatgtcatttatgatttctttcctcagtgttttgaagaaatcataatcaattcctggtagagatcttttacctccttggttaaatgtattcctaggtatttcacttttaatagttattttcttatgtatgtctaaattttaatcacagcaaatttatggtgtaatcctatcttaattagatggatgatgtcctttgttgggaatttaataaaatctaatactgcttagctggaccaagtggataagatgacatttgaatccatagtggaccttgtagcccttcttttatttgggtatctactatatagagaaaacattggtattctataaacatgcctaagatccattggagtatgtatggttagctctgtttattttctttttggttacaataaaaatacttaacattttcactgtaacctgtttggaaggaagagagtaagcaattttaaaaattaattcaacagagaaacatgtactactttttctgattaaaaaaaaaaagaagaagaagaaaagagcccacagcagctcagaagcctccaaaaatactcttttattttagaagctgaaaagggcagatctaactaatggtacaagacaaattgaaagtcctataaacaggaatagaatacttactctctttggttttgtttgcttctgaacaactggattcaaccttctttctttccccccagctcttaggcattgttgtgtcaggacagctatggttcaaattgggctgattttccagttctattaaacccttcatctgcatcgtggatcaaatacattaactagctgtctgcagtgcacagctggaaatcattctcttccacattttgctttgtgccatttttgttttataccaatatgctctgacacacccacatagctcaggatttcagcagtcaattatctccttttcttccttgataggtcttagaacattttaaattggtgtattctcttttgtcttttaaatattgaatcacttgcaaacatctctgcttgcatgaatatttttcaaaatgctccatagacctagaagctgaaatggaaagttagaatcattcaaacacaaattttgattttattcctttgagagatggtaggtgattggcatgaaatagcaggataaatattgtctaccaaaagtaagatgagagagagaggaagacagagagacagagacagaaaggataaggatcagccatgtattattgtaaacagtatatgatatcttagagattattttaaaatgaatatattgaagtgaattgttgcattgactgaatggcttttccatagaaagactccagctatcatcagttatcaattacattattggtggtctttacaaacttgactataaatgttgagacatttttcgagaaatacatacacatgtgtgtgtatgtgtgtgtataagtatctattggtatctccgcatgttagttaaaaatataataatatgccaagtacggacaatgaagacagctactccacaatattcatttaatttaatttttttttttttttttgagacggagtctcgctctgtcgcccaggctggatggagtgcagtggcgcgatctctgctcactgcaagctccgcctcccaggttcacgccattctcccgcctcagcctcccgagtagctgcaactacaggtgcttgccaccacacctggctaattttttgtatttttagtagagacagggtttcaccgtgttagccaggatggtcttgatctcctgacctcgtgatctgcccaccttggcctcccaaagtgtagtttaatatttaagctgataaaacaagaaaatatatttaaaaaatttttgctagactacattagaaagattttctttaaagatgtgagctagatagaggtcattttaaaatgatgatttatcaaattttacacagttaaagatagtgaaaataaagagcacattaaaaaataactagatggaaattttcactgtgaaacagaatttctgaagtgacacggtgttcacttctgatcatggtcattgtacaaccattgagtctttgtataattgctgtgagtagtgtcactaccattttcccttcactttttttctatagatatttaaatgaagcaactgtatacatatttattcattttgtcagttataatcaagttattctatcctaatctttctatcttcactctgtgtgtgagtctgtgtgtacataacatgtgatatttatatccatcttccttcttgatcatgagcaacaggaaccaccaatactattttacttaagctgaaatacatttgaaatataccatataacttgcagagttgatgggaaaatttgaaaaccagggtgagaagatggcagacatcaaggtcatccctaggttttgatacctgtacagaatagtcattgcttactgctgccgccatcactactttctctttcattcctctgatatgactatctctactcctatcattatctgattttccttatctctctagtctgtgcttcacatgcttaatattcaaattcctaggccaaagtcacatgtacatgccctaactgctatagggtagggagaagaaaggtctcctctatttacatttccttggcaggaggtaggacactgcataccctcaatagtagacacaatgccaattactcaagaaaagaaatggaggatgaatgttggacagccaagaaatgatgaaggtctgccacatttttcatataggttggctttttctttgaatgttttcacttagctagtgtaccaaaacagttctacatttccaccaaattaaaggtctgattagtttaatgcccttcatttgccatatttttctcaagaaagattatacagtgcatgaactcattcttattcagtaaatttaaatttgagtggcattatattccaactagtgctatccatgccctcagtaattttatagacttgagagccaccgtaaaaaatactaaagttacagtatgatgagggttctactaaatatcaactaagtaatatacggacaccaagaaagaaacagaaaattctgtgtggcaaagtcagaaaacactttcacagagcagggaatatttgagctatgaaagatgaacatgcaacaaaaagggagaacattctttgttgaagggacaagataatgtcatcacaaagcattttcaaaatgcctgctatatttgtaaataggaagagatcagttcactagatgtataagaaggcatgaaggaggatagcaacagatgagttcagacaggtagaaagcaggcctgattataaatgtttagatcaccaaggagtttgtctacgacactacaggtgacaggcaactcacaaaagtctttaaaaaagaaagtgagttttagggaagataatttcaacaacaatggggaagattaatgggagtagagtcacgcaggaagactaggaagggcagtggtgctcaacctgtttggcaccagggaccagttttgtggaagacaatttttccattgacagggataggggtggatggtttcaggatgaaactgttccacctcagatcatcagccattagattcttataagtagctcacaacctagatccctcgcatgcacagttcacaatatggttcacgttcctgtgagagtctaatgctgttgcttatctgacaggaggcagagctcaggtggtaatgcttgtttgccagccactcacttcctgctgtgcagccctgttcctaacaggccacaggctggtactggtctgcagccctggggttggggaccccgggttaggatgctactgtaataaatgtaaagtaaggttaggatatctgaatataaatgttgatgtgtttgtgtggcggggagcggtgtgtgtagctgaatttgaggtagagacaaaaagtaattaaactggaagcagaaatcttagaatggggaaaagtaaggcatatttgttcacaaagtatcttttaacattttctggtttctgtggagtcacattttattaatgctggttgacatttatctacctagaaaaaaatgacagaaatttcaggaacaaaggtgactatgaattaggtaccaatatttttgtggatgatcttcatgaagtcagccaataatggagatgagtatgtggaaaggatggattatttggactttttgaaaagaagttattgggtgaacatgatggctcatgcctgtaatctcaacagtttgggaggttgaggtgggaggatcacttgaggccaggagtttgagataaacttgggcaacagagcaagatccatctttacaataattaaaaaaaaaatagaaattagctgtatgtgatggcttgcacctgtagttctagctactcaggatgctcaggcaagaggatcacttgagcctaggaggcagaggcttcagtgtgccatgatcatgccactgcactccagcctgggcaacaagagtgagaccctgtcttaaaaaaattaaacaaattaaaaagaaatgaagttattgagtgacagttaaagaaactgatttgcaagtggccttcaggaggcagaagaaggctacttgtctttccccagtgattttatgaatccattgaggagatctgcagaagtgttgtcactgctggagaaaaccaaggcttcacttgcaaaaaggagtactttcttaaaactgagaaatttggaaatatatcataggacttgtaaagctatgatggaagttagcccatgagtgtgtttacagaaggcagagctagatggcataagactcagggatgatgcaggaggtgataaatatttttgtttagagtagtgagaagagtgaaacacagtagatctttaataataaaattttcactcatttggaattatgaaaattgtgtttgaaaaccagctgtgccatttaaattctgggtatatgtttcttcatttgtaaaattcaagtttgaactaggcttctttgaactaaattcttcttgccaccagacaacaaccttcttcttcatcacctagaggaacattgcctgaagcctaaggaagcagccttccctgtgccacacagaagaccccttaattgttcaatgaatttctcattgacttgtgtagtgcttcaaaagaaaacacttacacatcaaacatgattctaagtcaaagttcttcatttatatgagattaaagaactggaaaactgtacaagagaaatagtcacctgctgattgcaggcctgtgggtttcttggaaaaactcagcaattttgcttatccaggactatctttttgcccagttcctctgattctgaaggaagttgaaaagatagttttcctttgctgtatccaacatccttttctacatttgatttaagaaatgtcaatttaactttttattgatactgatattgaaaatacataaaatccaaagaatgagataaatcttacatatgtgtcatatttctatagatttttttgaccaacattttattttgaaaattttcatgcacttggtaaggttgaaagaatcatacagtgaacactatgtactcgaaatctagattctaaaattaggccaagcatagtggctgatgcctgtaatcccagggatttgggaggctgaggtgggagcattgcctgagggcaggattttaagaccagcatgggcaacatagtgagaccatgtctctaccaaaaaaaagtaaggccagcacggtgctgcatgcctgtagttacagctactcaggaagctgaggcaggaggattgcttgagcccaggagttcaaggttacagtgaagtattataatcatgctattgcactccaacctgggcaacagaatgagaccctgtctcaaaaaaaaaaaaaatagttaatgccaggcgtggtgactcatgcctgtaatcctaacactttcagaggctgaggcaggtggatcagttgaggtcaggagttcaaaaccagcctggctgatatggcaaaaccccgtctctactaaaaatacaaaaattagctgggcgtggtggcaggctcctgtaatcccagctactcgggaggctgaggcaggagaatcacttgaacctgagaggcggaggttgcagtgagttgggatcatactactgcactccatcctgggcaacagagcgagactccatgtcaataatagtaataataataatgataaattaatttaacatgtttgagtagggaggagatatgtgctttatcacatatctatccatctgaacatatctacccataaatccattttatcttttaatatactgcaaacctcattcctatacacatgatcatgaatatcattaactggagttaaatactgctaatttttttcaagctcaaatttatctacattgaaatgcataaattatcaccccgtgtaacattcactcactgaatgtaatatttaattaacaaatacatacaccattataatacaaactgctatcaagaatattatcatcatcccagaaattttctttatgcctcttcccagtcagtctctgcccccaagctcccaaaggcaaccatttttcctgttttattttcctaaaagattaggtatgtttaaaaagatcatataaatgaataatagagtatccactctttggtgtaaacttatattatgtggcataatcctttttggagtcatcagcattgttgtgtgtatcagtaatttgttccatttttatgttgaatagtatttcattgtttaaatacaccacagtttttgtatcatttcccccattcatggaaacctaaggtgtttccaggtttggctattatgataaaaacttctatgaacatttttgtttaggtctttttaaggacatgtaatgtcatttatcttggatatgtacctaacaggggaaaatttgaaggacttttatatttattaaaaactacctgttttctaaaagggttgtgctaatttacattcccaacagcaatgcagcagacttttgattgttctacaaactttttaatatttgatgttgtcaatctttttaatataatgccatttaatctaaaacatgagaactttgtcaatatataggtccagttactgtgatctctcacccaccatttctttattatagttgtcatatatattctatttacaaacatatgcaatgatgtgattttttgccttaaatattaatatgcatttaaaagaatttaacagggaaaaagtctattgacatcaaatgtacttatactgtcttttatcatctccaattttctattaatcacatgtagtggatttttttttcattctagatactgtgttacatttttcagtcacagaatttatattcaatattttttgttgttaccatttcttttttgctacaagaattttcgtatgtgtgtatgtccttgagtatagtttaaaagctgcttgaagatgcttgtttgcttattccaacatctggttgatctcagtacaatctccgttgattgctttttctcataagtatgagttactttttattgcttccttgtatgtctagtatttttttttaattgcaacctggatgtcatgaataatagcacattgtagaaactctgggttttgttatgttcctctgaagagcactcacccattcttttttgttgtcgcatcagttggttaacttgactgggctcaaagtcccaacttttttctttcctgtagagtgcagaacctaaaatctctgttcagtttttcagccctagctgggctacttggaatctgactagggcaggtgtaggtctggcatcagtgagcaatttggacagagtttatgcacagattgaggctccctttctgtggacctctctttacacctgctgtggctatttttagttttgttcactagttcttcaagccagtaaaactgtgggtttctatttgagttttagccattctggagctcatccagtgccttttccttctaagtattcatagtcttcctggcttacctgttcttaggtgcactccagatatctggtgtttgctgtgtgtatatatatatatatacacacacatatacatacacacaccaaatatatacacagaatttatagctgttatctctgggagctttgctccaataaaagctacttcacaattattaaaaatagaacctccataagtagattttaaaatgtttctgccatttgaaaccaaaaagtgggattttgagaatgtagatcatcaaaatcatgccaacatgtgtgaacatactacattatttgagaaagcaaatatggtataaacacatccaaataaaaacagtggaagttaggtgatttttttcaaatgtttgccatattgtagcagaatttcagtttttcaaattttcacatgatatacacttagcctttttctagatatcctattaccatatatatatatatacactatagaacagaatatattattctatatataatatgaatattctaatctctaataaaatacatagtataaacagaatattgtttgatttttgttcagacattgttccttataaccagaactccaactaaacttatttagtctagtgctattcagaaaaaaaatgtcaatcatagttgtatggataatgatcactggcttttatgtcattaacattacaggaccttaagttgagttaagaagatgtaagtcaatactctctaaaggttcatcagctatttatagttaatttacactcctaatgtttacataatcttaaccaagtaacacatattgaatatggaaataaatattgccctggtgcttttgaatgggaataagtaggcacagcataatagatttaacatataatgaaaatgggttgcaatctataataagacatgctgaagattcaataaaagctcagatattgattcattcttcaaattggtcattcattagcaactaattggagacctttgctgaccaatatgcttaaccgatttttaaaaataaacagcaaaatagcaatgaaatttcataaagcaactattccctgaccataaaacaaggcaattaaattgtgcaaaggttaattttgagcacataatcagtaactgtaatagaaacaaatcaaagaaaagaattgaaagatcctaaatgtaaattttattagtgtctttagttttatggttagaaaactctatgaagcaacaatggcatggtgagggataagttatttgttttattaaagatttaaataagctttaccaaggaccagattttggttctactttaggccctgacaagaagtcttgtaagctttttaaagagctcacttcaaatcatagttatcaatcttactaattcataactttgtacatatcatttatcttctctgagctgcacttccttcatttttataaagtggaaagaattaataaaatttatacaatgggttatatgggaattaaataatatgaagaatatagaatagcttcagaatcaatgtttcttgtactctgtaatccctttgtagctgtatgcttttgctctctttatttatttaattatgtgggataattggtacataatccaattctatattttctgaacatacaacataaagaaaatactttatccctggtctcttttcttggcttcctcccatgattgctgaggcctgggaaagtacaggcctggcctgctccaatcaggtctttcagggcagaccaaagcagggcacagggagtcttacccatacctgcaaaacaggaatgaggccatggtcagggtcagaactagtcagtgctgagggaggaggcaaaaatccgagagaaaaagtgacaatgccctggtgaagttttagaaatgttagcacctgcctgagatggcttttgtgtaagtaagctggctgtctttgaagggggcagatggagctagactgcttaaactcatcatataagcgagcaagagaagtataattttgctctcctttaaacagaattcccagcatgtctctttgttcttactacttatttttctatactgtaaattaaatttttaaagaactggagaaaagtccactaaaacaaattactaacagtgacaaataagcagtgctttatgttaatatgtaagtgcaccattgtattagtccattctcatgctactaataaagacatacccaagactggataatttatagagaaaaataggtttaatagactcacagttccacatggctggggaggtctcacaatcatggtggaaggcaaagaagtaacaaaggcaggtcttacatggtggcaggcaagagagcatgtgcaggggaactgcactttataaaatcgccagatattatgagacttatttactatcacgagaacagcatgagaaaaacctgccctcatgattcaaatacctcccaacgtgtccctcccacaacacatggggattacaggcgctacaattcaagatgagatttgggtagggacacagccaaaccatatccaccattatgtttattcaatgtgtaacctatatgtatctgtatctatagccacatctatatccagacaattacataatcttatatgttgaaacaattacagattcaagtactctgactcactcatcatttacataagctttcagcagagagaccatacttatatgccattccctctgcctgatatgtttgttttttctttcttcattttccctaacagataaacttctatttctccttgaaaattcagctcaagattacttcccatgataagcccatcttagtaatatttttattctcagatcctttactgtctggcataatatgtgctcaaaacatatttgatgaaggaatagttgtaccgttaaatgcaaaatggtgatgaatgacaaaatagaaagatatacagacaaactttatttaatcgcatatcatttattaacctagaaaataaaatgtctaagatagataatggcgtggagaccatctaattatttttaaatttgtaacctgacaaacgtcacaaaattgttaggaagttttcactaaggcttatatcatggaaaagataaaaaaaaataaggtaaaaacttttaaatggtactctactttttataaaacattacattttctaatgaaataaataatactttatgaatgtttaatatttctctaaccaacaattacattagctttccttatgtcacactgacagaatgtctcattgtgttggggccagagagcacagagatgaggggggaataaatgtatcaggaacaataaatgagatagtgattaagtgaaaaagtaagtaccattggcaaatcaggaaaaattgggaacctcaactttcagctgaagaaaaacacaaggcaggaggccagatgagagttgggggtcactattttggaggaacaggattaagggatttttaaagacatatgtataaggagggagaaaagaaagaaaagattctttgggggcagctctttgggagatcttaagaatgactgagacaagaactgagttgtcacttgatcttttgaattcatttacctgtggaattttttggagtgattacaataaagatttaaactatttataattgcaatttttactgtactattatctttttttaacagaaaagaaaacttaatagtcaatacatactctaataatcaaatattataaaaatcttcctaatttactttcttttttaattttttgtttctttcaatgcaattctaaggccaaccaggtccgcaaggtagcactagatctatgctggtttcataaaacattgtagatgccattcagtagagtgattaagaggatagactctggagccagattgctttggttcaaatcatagctctgctacttgctagctgtaatcaggagcgagttacttaacacctctctgccttcttaataaaatagagataatagtggtatgaagctcatgtggatgttttgtgtagcaaatcattgtaggaacagtgtctgacaatagtgcttggcacattgcaaacattcaacgatgctggctattatgattataattattattattatatgcagatgatacagacaaacatttatgagtccaatatttataatctaattattcgtttattttacaaatacattgagtgcctactctgtccctactatgtgccaagctttgaggataaggcagaaaatacaaattcaagatctagagatcttggtaaaaaaggcagaaaacacaaactcaagatctagggatctcagtaaaatatcaagccatgagatttagtcaggaaggtttcttttttcttttctttctttctttctttctttctttctttctttctttctttctttctttctttccttccttccttccttccttccttccttccttccttccttccttcctttctttctttctctctctctctctctttctttctccttccttctttgcttccttccttcctttctctctctctctctctctctctctttcttgacagagtcttcctctgtctcccaggctggagtgcagtgatgtgatctcagctcactgcaacctccacctcccgggctcaagcaattctcctgcctcaggtttccaagtagctgggattacagatgcccaccaccacgccctgctaatttttgtatttttagtagagacagggtttcaccatgttggccagactggtcttgaactcctgacctcaagtgatccgcccacctcagcctcccaaagtgctgggattacaggcgtgagtcaccacacccggcgaggaatgactttctatcagaagttgaattgatatagacctacttggcacatatatagagctgaaacaacctagatggtcggcatattttctccataaatagagtcaaattatctgtaatttcaaatgtactttctccaagaacagatttttcagttaaagagtggcttttgatgagtgactttgctatactgttattgaaaaagggtctataatatgcaaatgctagacatgtatgaagcacaattgacattaacttacaggaagaaaagagactgaatttggttctcagagggaataaaaaaatctccccagccctacacttagatggacctctgagatcgtatctatgaaagttaaaaacttctattatatctaagacataattactggtgtatgatcatggaccactataatggcttgtttctggcaatatattgctttattatattgctggatggcatggaaagcagtaaaaattggtattccaaagtaaacattatctatcttctctagtctgggataaagaagttttaataattatttacactgaaggataattagagcatgaaatgaccatgaaaaaatatatttgcatagttgtgcagaaacattaacatgcaattatgtcttgatactagatataaaatatctgaaatggaagatggaagatttagtgggatcttttaccaataacttcaacagaagatttgtgttttagaatgtgtcctagagacaggaccttcttcctagctaaatattagagataaaaaattaaaaagaggcttaaagtccatacttaagacccagaaagaaaaatagtattcttttgataacacatagtatttatgtagtatactgaattgtcaggtatttatcattaattatctcatgttgggttactttaatgctccgaaaaatattttatctcaattgcttttaaaatgtatcaaaatcctaactttgtttctggtctacacaccttcatttgtccatctttttcaggtttattccctgctgtcctgaatcttgcttctaatgctcttatcacgaccaatgcaacatgtggagaaaaaggacctgaaatgtactgcaaattggtagaacatgtccctgggcagcctgtgaggaacccgcagtgtcgaatctgcaatcaaaacagcagcaatccaaaccgtatgtattttagtgtgtaggtgtgtggcgctgggtaggatctataattgtgagatgttgaggccaagttgcattaaattcaagggtttgtaatactaagaattcctagaattctttttaccattaagagcttcttcctggcccctctctgtcattcagcaaacattattggagttcctgctatgtgctaagtacagtgattggagatgattcgccagctgaaggcctgtggcagtcattgggtttactaactccagataccaaagtggtttctgagggtgtggttattaactcaggctgtcatcattcattggtaatttatgtgccagatattgtgcctgagatccaggaggaataaggtaggatatcgtctttgagctactgatatatagtgtggtaagtacaaaggaaagaatgagcacagcgttctgcagaagagagaggatggccacaaaggcttggtgtaagtaaaggcttgccagaaggagcgatatccaagctgatgaccaaggacatgagctaaacaagggtatgagataaacaggtaaagaggtgagggaggggaagaggagaagtcatgccaggaagagaaatcagaattagacagaaaatcctagttactcggggagctacaagtaggaatgactagaactgaaagtgccaaagggcagagagtagagatgagactagagcaaaaggctggagccagattatgaaggcatttaacaaccacaggagaagtgatttagggagaggcaccatgtaaagccctctttccagcctctatgaaccacagtgatacctcagactcattgatgtatttattcaacaggcctttgaacacctcctactagcaaagcattgtattggagcataatgttaaattacacataacccctgattcagaggacctagaggggaaatagaggcaaaagaaaagtaaattcagtgctaaaataacatgaatgctccatgtagatgctaaagtcatctaaagatttctggctaagaaatctttatatctatatatctctatctgtatctatctttctgacatgccttcttctcttctcctcgcttacctctctctctctgtatatatataatatatatataaaatatatatagcaggtagatatatacttatatgtaatctacataaaggtaaaaatatatattatttatatttatttatattatttttaatgaacagatatattattttatttttattttgtttttgaggcagaatctcactctgtcacccaggctggagtgcagtggtgcgatctcagctcactgcaaccgccatctcccgggttcaagcaattctcctgcctcagcctcccgagtagctggattacaggcacgtgacaccatgcctggctattttttgtatttcaagtagaaatggggttttaccatgttggccaggctggtctcaaactcctgacctcaagtgatcacccgcttcagcctcccaatagatatattttttgttaatattatttcatatataatatattaaaaggtagatatatattatatgtagagagatatattttacatatctatagatcgatctatagatatctatatctatagatcgatctatagatatctatatctatagatagatatatagaggccagaaagtaaatgaattgatggattattagtttcaggttcattaggcaagatgataaagcctgatggagggaaaccaccattggttcagagactggtggccttgaaaatttcatgaagaatatgagaaagcccaggggcatgaacggagttgtggggaggaggtgcgagtgtgtagatgtgtgtttaggatgggctgtgcagacggggagaattagagagataaaatatgtaaaaccataagtgtgtgtatatgtatgcaggtatatatatatatatgtagagagagagagagaaaggaggtaataacgtgaatacttaatgccaagtgaggtgaactatgatgggggtaaagcttcacaattatattattttaaaatttgcttagtatttcttctcctttttttttttttttttttaggcagagtttcgctctgtcgcccaggctgcagtgcagtggcgcgatctcggctcactgcaagctccgcctcccgggttcacgccattctcttgcctcagcctccccagcagctgggactgcaggcgcacgttgccacgcccggctaattcttttttttttttttttgtatttttagttgagacggggtttcaccgtgttagctagcacggtctcaatctcctgatctcgtgatatgcccgcctcggcctcccaaagtgctgggattacaggcgtgagccaccgcgcccggccttttctctgtctttttaaatagaccttatttttagagcagtttgaggttcacagcaaaattaagaggaaagtacagaaattccccatatttcccccgccccaacacatgcgtggacttctccattaccaaaatccccctccagagtgctacatttgttacagtccatgaacctacattgacaacagcatcacccaaacttcatagactgcattagggtttacttttggtggtgtaccttttatgggtttggacaaacttataatgatatatatctaccattagagtatcacgcaaagtagtttcattgctcttttttttttaaattataaaatgtataaaatgagagctttttctcacaatttacattttttatcccaaaaagaaaattgaaaggcattgtgccttttttcttggagctggttaaagagaggcatgcatagtcccctcattatataatttaggaatgcagaaaacattactatatttcagcaattgacacttgtttgattaaaattagtggtcgtgtgtatcacagaatatcagaaaacatgttaagacaccaaagaaggcaaccaccagaaacctttcctattaatgactctggttaatttctttcttttttgttttgttttgttttgttttattttgagacggagttttgctcttgttgcccaggctggagtgcaatggcacgacctcggctcaccgcaacctccgcctcccgggttcaagagattcttctgcctcagcctcctgagaggcatgcgccaccatgcccggctaattttgtatttttagtagagacgaggtttctccatgttggttaggctggtcccgaactccagacctcagttgatccaactgcctcggcctcccaaagtgctgggattacagacatgagccactgcgcccggccgactctggtgaatttctcggatgtaagttgttatggtatgtgtgtaggagtggggagtatagttgcatacccatgtgtttgctagctcttgtatagaatgtaagaggaaaggacatatgtcagagccctttgcttttatgtaaaagccaagggagttcaggtaaatggagtcaaggcaataaagggaaacagatttcaagggaaaaaaatcaggaaaatgaggcattaggtatgtgatgaaggaaagaatttttaggaagaaaaagtaacagttttaaatgcttcgaagataattgagtaagaaaagcataaaataggtttcccttgcttttgacaacatggccatccattgaacacctttctaaagtactcagcagattcatagtggcaagaggcacactgaagaggtaataaatgaatgatgaagaagaagaggggactatagaaatattctgtcaagtatccttgatgtgaaagagaatgaaggacagaggaggttgtggagttgcaaaggttttcaaagataagagacatttgagttggtttagatgcttggggggaaaggcagggaagttgaagaccaagtggtggtgggcatggtgtctctctagaagtaaaaacatatgggtcattaagcataggcaaaaaccttatattagaagatacatacttttaactcaccaaatcagaaagaagaaagaatgaatagcagcagtcagcagaaagtgttgggagaaatttcttatttgatgatcttgatttcttcattaagatgtaaatctgggttacctgctgaggaaagaagcaaacatttagattatgagcctctcaggggaataggaggggatcactgagccgtaatcagaataaagtggcaattccatatggagtaaaataaagaatcaaacgtgtggactgatactcttggagcattacagggaaagtagaatggaaagagaagatggcaagaaaattgaagaaaaggtcagaaagtaaatgaattgatggattattagtttcaggttcattaggcaagatgacaaagcctgatggagggaaactaccattggttcagggactggtggccttgaaaatttcatagagaatgtgagaaagcccaggggcatgaacggagttgtggggaggaggtgcgagtgtgtagacgtgtatttaggatggactgtgcagacagggagaattagagagataaaatatgtaaaaccataagtgtgtgtatatgtatgcaggtatatacatatacttatgtatttattaaatatttaaattaaacatgaaatatatgatatgtaatataatatacttatataatattaaataaatttatataaataatatacacatataagtataaatattatgtatatataataatatgtacctatgtgtatataatatttacactagaaaggcaagaaataagaaaatgtatccaatcataaaaatgggatggaggaatgatgcaaagattggggtagaaaataatttagttctccactcaattatttttattcttggctggaaaaatggatgagatgcattgtcagattgagtccaaaagctattctgtctttcaccctcttgaaagttctacattcagagtatcttttgtctcgtggaagataaatatattcagccaatactatccatgttttcacattgaaaccaaaaatgaatcaattatttcagtaaagcaaggtgtatataagttatgatttgtatttccccatttttatttacctgtagtgttttctaaaccagtcacagtctggatttactttacattattattatttattattattattattattattattattatttgagatggagtctcactctgtcacccgggctggagtgcagtggcacaatcttggctcactgcaaccttcgcctcccaggttcaagcgattctcaagcctcagcctcctgagtagctgggactacacgcgtgtgccactgcgtctggctaatttttttgtatttttagtagagatggagtttcaccgtgttggccaggctggtcttgaactctcgacttcacatgatctacctgccttggcctcccaaagtgctgggattacaggtgtgagccaccgcgcctggcctgcatgattatttttaaatgaccagattcattccacatttccagattatgctttgatactagaaatttagaaagaataaaaccccacaagaataaaaatctagcaatcaactgcatgaatatattttagtaaaagttggagcaacagatgataaaattccacaaattcagtgaactctgagaataaatatggaaggtccgcagttaattatcctgcaaagaaaacgaaccttgaactttctgttaatagactttgcttcccaattaaaagctagcagtttgaaaggtttacctcatcagcgattccctatccagttttcagatgcagttagcccttggattgacttgcatatttatccctgttgaggatgttatacgtttctatctccttttaaataagggaactttgccaacaattcgtcagtatttgcaaattaattatgattaaactttcataatagggattatggttaattgttgattcatctcccagtcctcctttttgtgactaattctcttatcagtttgacctgaggtggcagataccacaatttcctattagacaacttctctcacaattacctaagagccatgaatttgatttagaaatggggttgtatgtgtgtgtttttctatcacatattaaacgcacaatctgtaaaaaagattcaggaggatgtttgggaaatgttttctgtgatatttatttttcttcagaagaagtgccaacaatatttcatttatggttttgattccccatatgccaatttcagcaccctcttatttcaccagggtcatttatttggtatttagttatgcttctgatatttgctgtcatcataaagacctgacatcttccctagcttcaaaagaacaatttgactaatgctaacatttaaatatattcagaaattttacttttcattaatgagacaggaagcctcatctctatggactgctaacatgatgatttggtggaaaataaagtccagccagctgttaagttgaattaaaaaatttaccaataataatggaatatttttgccctgtcttgtacagtcatattaagatttgcaatatgaatatccatatctggaataggactataataccataaatagcttaaaacatagtcttcatgttttcagtaaatgttatgacagtgtattatatattaattataaattaatatgtaatacaaatcttcacaaatctgaaaatgccaaatttagtgaatattcagctttttaaattttgaaatggagtctcactctgtcacctaggctggagtgcaatggcgtgatcttggctcactgcaacctctacctcctgggttcaagtgattctcctgcctcagcctcccaagtagctgggaatacaggcacccgccaccatgcctgtgctatttttttttttttttcatagagatggggtttcactgtgttggccaggctggtcttgaactcctgacctcaggtgatctgcccacctcagcctcccaaagtgctgggattacaggtgtgagccactgcacctggccaatattcagcttttaataaaatttttcttttaaagatgattttactttctatcagattcctattgcattgaggacttagttttgctttatttttattgttttttcaaatgttttaccaagtacaacttgtctctaagattcaaaacagtgtacattttgaatagatgtatcatttattttatgtatatgcataataatggttagaatgctcacagttatactgttcatcagtaaccctgtgaatacagggttcacatccaagatgttctcactggtccgtggcaaagtaagaaaatgagaacaactttccacatttttcataaaaatagaaaggatacaatttaaataattgtcctccattttgatattatgggttttaaaaactaatgatggtttttaaatgccctttgtttcatgaaataataatgatgctttattaaatgatagaaatatattggaggttattattacttggaaaaactaagagctagaactcctatatcaatttcacaaatcgatcacacatttatttttaatttcatattttttctctgaaaattatgaatctggaaaccactgctgtgagcggaattttgttattcctagatcagagatgacacataatgttgaatgatttgtctgtggtcagttacgtactaagtggtggagccaggaggaatatcagctacccgtgtgccagcacctcatggtccccctctcatcaccattattattagaatacatggctagattgcaatattaggtaggcaaattgagagtccatgtttgttcctcatagcaatgtgatttgttccttatgtgaggtattccttcaaatttaaaaaggattgtgttctaatctaaaaggtcattcataagccactcattcgaaacatcttcccagatacttagttttatgaaattctcaagactgacaccccaaagcatccttaatctataataaacacaggagtacagggaagctcacctccactttgtttacatttctatgggcaaatgtgccgactttctagtgagatgtgaggaatttaagtgcccttactgcagccttgggaatagaaacaggatcatcaacagcctccactcctgccatcctcacccatgcatgagcaaggcctgtttagagagggagaaagaaaaagaccttatattacttggaaaatgagaagcaaagattttagacaagaaccaatgactgggaaccaaaatgcaatgagggcttggcagcccaggagtagtggctgctgttgtgagacacatggagctaaaatgggagagatgagaaactgtgagctttgaggattgtaagaaggaagggagctgcaacaaaggtcacaggtctgtggggttgccacgcctcctattttctatctctaatctcccttttgattttcacaattggtcctgttcttatatgtctgggtgaaagtaagggaagatctgtggtttttggtaggatagagtttcatgtgccatcatctccttccttgccattattgtaaagattcctccactagagttagtgatgatggcaacagacaaatgccggatgagaggtttgggttatctctcatattattaaatagtgatagaaaattggcaagttaaagactggccgcaaaaagcttctgtaagggccaagggaaaacttctcttttgccctctgaaggtttgctgaaaaatcaactgaaaaaagttagcttggtaggtgaaaggcatacaaaatgtattttaacatgcatagcatggaagaatcacaggaggatgattacccaataacccaataggagcatagatgtagatatacccttcttcacgggggagggaagatggggaaaatatggcaatttggaaaatagtaaatgattttttaggggaattcaagaacctacaatggcctgggacaaagtctgttgggcccacagagcagatagtggtttgtaacaaaagtctgttcaggtgtgccgacagacttcagtctctcttcatgtgaaatgagttaaattaatgaaaacttaagcaagagggccagaggaaacttttcctcctggtgggatcagactgtaagtagatacgggagtatcagagtaaaacttatttcagcatttgctggtctccaagagcctttaatttaaaataatcagcataccagcatgctatattttcgggtattggtttctgagcctcaatatctcatagaatgaatttaacagcattttatgttaaaaccagatatatattggactccctacgtcttaataataatgaatgtgtcagaagggcaagtgttcaagtgtatttcaaccacaagtcaggattttatgtttctgttaacaaggttgatggcatactagagctgtctcaatagttagttgttgcttttttgaatgattgacaagtcaattagattttaacattatatctttacacttaatttctgtagttacctttaaaattgcccattttggttaatggccagagtgctgaccagctcattcccctgcagcctaagcatttaaacatttcctgctaccttgtatggtgctatgagacagctgtcattgaagaaattctgttgagaatctgaattactctccttctgtattattttaatgtttgatattcacatgatggttgttttaaccatttttttttactttaaagaaaaagctataaactagttatatgatcttttcttcttcctttcatatgatgctgctaactcaatagagagacacccgattacaaatgctattgatggaaagaacacttggtggcagagtcccagtattaagaatggaatcgaataccattatgtgacaattaccctggatttacagcaggtatagttcctctttttttgtcatttccacttttgaaattgcattttacatttgctatttgtttagttagtggtttgtgggtgaaaggatactctttcttatcactctccattgttttcttgataagatgaacaaagggtcctattcatatagcgtattgttatttacgagtattcagcatttaattataaagcacaattcaaatggaagcacgtgaagagcttagaaatgaattaggtgctaactctgttttagctagctggacttaatgatgaaaatatggatcaataaaattttacataacaaaaatataatagtatcatttttaacttttaaaataatacattgctcccactgtgctgatggtgtgtgcacttaaaggttcttggataacaaggctcttgagcaaattgcctctcattactgagagctgagaaagttttgacagttgctttcaagttaaacttgggtgactaaatgaagtaacaagctttgtagttatacaaaattgatgccggaagttgttcaagtttgtcttgcataggcctgggtgccttctatgcttaatctctttcttccttctcttcacaatattcaggtcaggctgaagttattaatcaggaatcgccagcacctcaaattatttaggcttgcaattaggatggaaagtggacaaatgccacattccatcctatttgtatgcctaaataatgtgcaggggtgatggtcaggatagttaatgacagacaccatacactgtaaaggtcatggtttttataagttatcactgtgtggggaagcccccagccagtgggccagatcagcacaagacattttcctaatggatgccatttgccaccagcatgagtacaatctccctcctccagtgtctaggttcattttggtgagggctgcatatattcaagagccacagaaagctggctggagcaaacaagctggtggattgcacggtagacctgccttccacccatatgggcctcctcgggatatgaggaactggtggcggcaggggctcagtgctgcagcttatatcaccaaatggcatggacttatttctaccctcactaatatacagcagctgaatgtcagtcctgagttaataatatttctcaggaagtctcagagcactatcagagaatggcagggcaagctaccacactgatcaatcatgctttaggaaaattaatcctgtgcatgaatcccctggggatcttagcctcaaaatggactgcataccactcctgataaagacaactttgtcctttattggtcacaagagttctcccccttcatgtgatcattgaaagtctagtctcccaatcaagagtgagtctgctgtgcattgactcaggtcatctccagggacaggcaatcaataaataatgatgctttattgttctggtttattctccatttattcttttagattgcacatagaacaatggggtcaattattaatataatttgcacaaatcacttatagtactctttgagctgaacagcaatattatttacctgttatcaaacatggcagcatttttcccctcctaatttacaactggatggcgcaaccacaagtttttactaaatcatttctaacttgcctgtttttatcaattcagcaagtcaaagagtttacctgaaagcctatttttcagtgatgtcattgatattttcctaaatttactttgcatactcactcatccattcccacacagtatcttaagaattatgtggatttgtcgttctgttttctcttcctcccatttagtttaatggaggtaagatgagtgaatatgccaagacatattttatgcttcattcatcataacaaagtgccagaattctgtatataacccaggtctacctgactccaaagtctgaaattcaccaagtggaattggtacagagcatatgtgttcaaattgtcccatattccaggatggtgtccatccatatccttatttattccagctttctatttcctgaaaatcaacctactgtgtgtgtagaagaaggggaattcaagtaatctctaaaaatgtaataaatccttatttctacttgactcaagattttaatttagtcagttatttagtgatgtgaaaagttaaacaggttttgtaatcaagtttcgtgatggaacttctcagacaagaaagagcttcagacttccaatttggcctcaggctttggaataacaaactgtgagacatgtttataatacttattcagctatggatggtatattgtactgcactggcaacagagaaaatgtggacattcttattatgtaactcctcacaataatcctgaataaaccagctaatattaatattcctattgcatagttgaagaacactgtgctttagaaaagttcagtgacttggccttctttctaaagcttattatgggcagggctggggcaacatgaatagtctgaatccagacccaaatacactatcttttctaatgggtatctgaagacataatcctagggagctcaggataatttttattatatattttcaagggctccaaatgtagttcaggttcaagaaatattgcactatcttctcctggcttctatgggataatatagccaacaacctgtttcgttataaagcaggggactagaaccctcattttctagtatactctagtgtgcctctaaaatggcaaagcttctgtcttttctacctaccgcatgaaggattaataggttattcaaaataagatgagctattatccaactgggattaaaaggcagtaaaattataatgaataggtaaatatcactaaatgtttgtttgtcatttattcagcaagagacttgaccatttattagttcttcttttgtataaatttcaacaagtgccagtattgttgttgataaatgcttggctcctctgtgacacattttcataaattagtatcttaaacataacagaaacgattgcatttatttgattaaatcactatagattacagtgggtttttttttttttttttttacattttaacattcaagataagcactagaaaaaatagcaatttgtttggaagaaagtagctacttattttataagtagattgttcttagatacgtattactaagggattattaacttttctcattctatttactcatagcatattttgagcaagtgatttaatcatgctgtgcctcaacttctagattagcagactaaatattacaatatcttggcaagaaaattaaagtaatgataatggcaatatagcaactaaattccatctcacaattacagctattaaaaggatctagagtcagcatgaacttaaagaaaagcttaactgttccagtgacgtgtatataaaaactcaatataattgcgaacaaaaatatacaacaatttaaaggagacagtaatagggactcaaacgttaataagatgtctaaaacattctattttagtctttttcctaccagatttcaccagaatatgtcattatgtctgattttatttatttcttttaaaatctagccattatctccgtcatgccctttgatttgtttcagaagaaagctgattggcaggcggggtaaaacagagggaggcagcttttcagtagacttttcaaacacatattgaggtgatactcactcctggctaatccaggaatgccattaattagttaagctcatgtcttaactaggagtcttctcctcaataagcaattcacttctcttcctggtctatccctcaaaactaagaatgcgtttaccaaacaagattatcttacagctacagagatcacactccacatattcttaacctaaatattttattcactgatcttgcagagaaaaatttgtttggacaagttaacagttttaactggaatttatgttttaggaggaggataaactactatttctatgcaaatattactatacttttagaatccatgtgaatagtataaaatgatttttctctaaagcctagaatcattaatgtaatggttaaacatttctgcaataataaaacataaaatacgtggaaatactttatatattcaagttttaacaatcatttaaacatattaaaggtgatccaattttcagtcttgaaggaaggtcattattctttcatgtcaattctttcctcatgctcttcttactgattcctgattactgattaaaggatgtgttgtacaaggagggaattttggaaaattcacaaatacatggaaattaaacaacatactcccaaacaaccaatggataaagaaaaaattaaaagagaaatttaaaaataacttgagacaaatgagaatggacacactaacactgataagaagaagcaaaagcagttctaagaagaaaggctatagtaataaatacctacgtcaaaaagaagaaagatctaaaattaacaacctaaggttacatttcaagaaagcaaaaaaaaaaaaaaatgaagaaaagataaaagaaagaacaaactaggcctagaagtagcagaaagaaggaaataataaaggtctgggtagaaataaatgaaatagagactagggaaacaatggaagagattagcaaaactgtcacttgggttttggaaaatataagctaaattgacaaaagtttagctaaactttctaagaaaaaagatcagaattgaaagaggagacattactactgatacttcagaaatacaaaggatcataagtgactactctcaacaattatatgccaacaaactggataacctagaaaaaatggaaaaattcctagacctactaacactgaatcatgaagaaatagataacatgagcagatcaatgaagagtaaggagattgaatcaggaataagaaataccctatcaaagaaaagcccagaacctgatggttttactgctgaattctaccaaacatttaaggaactaataccaatccttctcaaaatcctccaaataactgaagatgagggagtacttccaaacttattttatgaggccagccattagcctgataccaaagccaaagacactgcaagaaaagtacattacagatcaatatttttgatgaacatagatgcaaaactcctcaagaaaatactaacaaaccaaattcagcagcacattaaaaggatcattcactgtgatcaagtgggatcactaccagggatgccatggtttaacctttgcaaatctataaatgtgataccttacattagtagaatgaaggacaaaaatcatatgatcatctcaatagatgcagaaaaagcatttgacaaaattcaacattgtttaatgataaaagctgtcaacaaattagctatagaaggaatgtacgtcaacataataaagactgtatatgacacatcctcagctaacatcatactcaatagtgaaaagctgaaaggtttttctctaagatcaggaataagacaaggatacccacttgcaccacttctatttggcataatactggaagacctagccagagaaatcaggcaaaaaaagaaataaaattgtcatcaaaattgaaaaagaaaaaggtaaagtgtctctttttgcagatgacataatcttacatatagaaaaccctgactccaccaaaataactgttagaactaataaacaaattctgtaaattagcaggatacaaaatcaatatactaaaattagcaacatttccataaactaacgaggaactatctttaaaaaaatcaataaaataatcccattcaccatagctaaaagaaaaataaaaaatttggtaataaatttaaccaagaggattgctatgatttggctctgtgtccccacccaaatttcatcttgaattgtactccaataattcccatgtgttgtgggagggacctggtgggagatggctgaatcatgggagtgttttcccccatgctgttgtcgtggtagtgaaaagtctcatgagatctggtagttttatcaggggtttccgcttttgcattttcctcattctctccttgcctgctgccatccatgtaagacaggactcctccttaccttccaccatgattgtgaggcttccccagccacatggaactataagtccaattaaacctctttcttttgtaaattgcccagtctcaggtttttttttttttttttttttttttgagacgcagtctcgctctgtcgcccaggctggagtgcagtggcgggatctcggctcactgcaagctccgcctcccgggttcatgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctcaggtatgtctttatcagcagtgtaaaaacagactaatacagagatgaaagactggtacactgaaaactgtaaaacagtgatgaaataaattgaagacacaaataaatgggaaaacatcctgtgttttgtggaataactaatattattaaaatgtccatactactcaatgtgatccacagattcagtgcaattcttgtcaaaattccaatgacgtttttcacagaaataaaaataaatcctaaatattttatggaaccacaaaaggtgctaaagcaatcttgagcaaaaagaacaaagctggaagcatcacactatctgactttaaaatatactacaaagctgtagtaatcaaaacagtatgctgctaacttaaaaacagatacatagaccaacagaatagaataggagcccagaaataaatctaagcatttatggtcaattgatttttgacaaagatgccaagaacacacaatgggattgaactgtctgtccagtgaagggtgtttggagcagtagatgtccacatgcagaagaatgagtatagacccttatctcatgccatataaaaaatccattcaaattctaaatgaattaaagactgaaactgtaaaactactgaaagaaaacacaggggaaaagttccatgacattggtctgggcaatgattttttaaagatataaaccccaaagcacaggaaacacaataaaacatagacaaatgagattacattaaactgaaacacatctggataaccagggaaacaatcaacatggctgctcttcaaatcactgaatttattttgttggtactatttgggtcactgctaaattggtgaataccaaactaacacagaagagattataatatacatgttccaaatgtagattataccttacctgagtataccttaagtacaacagaatatagttaaaatcacagttctttacctgttttaattgtatatagatttttaagatcatttgttcagtatcacaagtagaatctgtggttaattagaaaatatattttccctttaaatgaatttgtgctgacttttaaaattattaataaaggtgacagctagctttggtgtctatattgaagaaaatgttcatcctaattggtttccgtttgtctaccctttggtctgctttcaacacagcagtcacagcaatctcattagtacagatcacataacactttccactaaaagtggaaatcttattagtacagatcacacaacactttccactaaaagtctctactggttttccatcacattcagtgggaaaagcacaatgacccacaaggccttaaggaccttttcctcacctcttttcatctctggcctcatctgatctctcttcctcagttgcccagctggtcatcccgctatgtcttgaacactcacacctgcctcagggcctttgcacttgatatttcttatgtctagaattattttcttcaatttcaatgtagcttgtttcctcacctccttttggtttttattcaagtgttaccttctcaacaagggcctccttgacaactctatttaaaattgcagctcccagcctgtccacttcctaaaccactttcctgctttatttttctccataaaatatatcaccatctaacttactatgtacatgttactgttcagttgaatatttatctttctaaatgcaatttttttgtgcgtggagctatttgttgttgtaatcattgctttctaagcacttagaatagtgcacaacatataggaagcattcaatgtgtttgtattaagttaataaatgactgaatgaataactagtacaaaccaccaatccataatttaagaatcttattgaatctgagaattaaaggattaagtgatttcactgtgcttcttatgataaaacacactgcactttttctaattatgaaatttcctttaaggttgaatggcattgttttagtctatttgggctattataacaaagtaccagatgaggtggcttataaactgcagcaatttatttctcatagttctggaggcttgacgtccaagatcaaagcactggcagattcaatgtctggtgagggtctgcttcctggttcatagatggccttcttcttgctgtagcctcacatggcagaaggggcaaataagctttctggggtttcatttataagggtactaattccattcttgggggctctgtcctcatgacctaattacctccccaatccccatcacctaataccatcacattaggggttaggatttcaacatatgaattttaggggaacagaaacattcagtctatagaaagcgtgaagtaaattttcttccagttcctatgcatgttcttactctgcttttaagcgtattctaaatttcagttgtatctgtcactatgtgactttaccacacttacagctttatttaggaaaagagatgttaattattttaactcttcttttgtaacagagaagtctgggactgtcattttttgttttttgcttgacattgtattttttcctcatagaacaaaagttagtataaaagaaagggaaaaaaggccatacaatgatgctgtttaaacaagagtgtaaatgtaggatatgtattttgatctaaaatgttgataaaccaaattctagcaataccatgaaaatgtaaacattttggagacccagatcctatttcaaatagagtcaagatgactgccctagaaaatgcttcttgaagtcatggaataaattagatgattgtttatttaaaaaaaaagaacaataatacataggagatctgttaaaaaatctgtgaggaaagagctgttaaaatgttgaaaccacatgaattctgttatggaaagtctgaacaagactttctaaaatagattgaatgtgggcagttttcacagctgcctgatgacttccacacacaaaacatccacatttcatccttttggtggaatactgtgtattttccaattttattcttagagtttaattttttacttacatattatgcttatgtatatcatatttgttatatatattatatataactaatatacaattatattatttatttaaaaataaggaattaaaaacaattatattatttgtttttaaataaggaattacaaaataatgaagagaccgtatttattatagatcttgaaactgtgactaaaaaccccatgcacagagaaaattcttgagtcaaatggcttcattgatgaatagaagttagaatactggttattgttacaaggagagggaagataatgactgggagagggtatgaggaaagtttcatttcttatttttgattatataattgtacaataataatgtgttagtacatagaactaatataattgtaaataagtgtgtttatatataataaaatatacaaaatatagataatatattgtataatgtataattatatacaatataataaaaatgtgataaataatattgtataatatataattatatacaattatattaattatatgtactaatgtattagctatatgtatttatatgtacctatatataagactttttctagaaattgactacatatttgaattgtgagacagcatgtatgttttgattcatagataagatatgtttccaatattacccatatctctaaaatacaaacatggcaaaaaaaggctggagtgagactaaggagaaaggaggagctataagtgtgcccagattccatttctttacctatgacttatgcgttggtacatttaccttaggtaacttgtcccacttttatgctcttcaatttggtctagtgtaaaatggagcaaataggcccacttccttattacgaggcatattataaggataaagtgatgtgttataggcaaagagcatagcacactgctgcactttaggtgatactcagaaaatattacttttggtcttccacattgaaaataatggtgaatggagaataaatgggctaagttgtaatgtgaaaaatggaaaataacaaaacaaaagctcaaaaatgctttaattactggatattgaaatgatacctatgaggttcactttgtatatcacctaagaatattattttactcaatatatttttagcactttatggacattaatatttctatggagaaagcttaaaaagtgtcacttgtgcattgaaactcttttgtaacagcttctttactcttctgttgttgtcatgatatcctccagattacttaaatttttaaccaagaagtaaccttacttattactagtatgctctttccttaaaagcttttctgatttatgttattttaattatatcaatcttgttattatgtacagtttttaattattttaataatttcaacctttctgcaactttccattttagatatgtctcattaatggcatatagtgaagttttgacgttttgtctagtttggcagtgttggtcttttaatgaaacatgcattttcagtggatctgtgtgtatctaagtgaagcatgtacacagaaaaggtgacaaataaaagtctgagagaatttttgctaaatgaaccttcccaagtaactactactgagacaaaaataaccagcaacccagaaacttccctcatgccttttccaatcactatcttgccttctcccctaatagtaaccagtattctaacttgtattcaccagtgaagccatttgatctaggagttttctctgtgcatgggttttagtcacagattccatatctataataaatgtgggactcactggagttttcatttcttatattttcagtttagttgagttgggcttttcaagaaattgatccacttacctaatttttcaaatatatcgacatgagttgttagtgatattatcatcttttaatttacaatgatctgtagtgatgccctttttttattccagatattgttgtgtaacctttgtttttcctttacagctttaataggtcttcataatttcattagtctttttcaaatagccagttttgggcttgattgattttctctatcgtgaaattgttatattgtattgaatcctgctcttatatgtcttgttttttacttctcgttattttttattttagtttactacattttcttagcttcttgaaatggatacctatgttattaatatttcagttcttttttcctaatatatttattaacgcctacaatttgcctctacatagggctttagttgcctcctacaagtttgatatattgtatttttcattatcatttattttaaaatatattctaattttcatagtaaatttttctgtggcctctgagttatatagaagtgaagtgcttaatttctgaacaattgagtatttttctaatcgttttgtttttgttgttattcctttcctcactaattccactatggtcagtgtattttcaattctttgagactaaactttttgagacttgtttttatccaacatatggcagtgacttgaaaacaatgtggaccagttgccctggctcactcctgtaatcccagcactttgggaggccaaggcaggcggatggcttgagcccagaagttcaagaccagtgtgggcaacgtggtgaaacctcatctctaccaaacaaaacaaaacaaaacaaaacaaaaccccaaaacaaattagctgggtgtgtgcctgtagtcccagctattctggagtctgaggtgggagaatcacttcaacccaggaggtagaggttgtggtgagccgagattacgccactgcactccagcctgggtgacagagctggacatcagaccctgtctaaaaaaaagcaaagaaaagaatgcagattctatagttgttggttgcagtactacaaatatatcagtgagttatatttatatatattgatacttttaaattagagacatacaaatttaggattattaaatttaataatttaaattttgtattaactcttttgtattaaccacctttttaatactactgccagcagtacttctatctttagagtgtacttttgtatgtagattcactagcttccttttttctctgtgtttgcgtgatataggttttctcatatgttgagtgtacttatatttaaggtgtatcttctgtgagcagcataaatttgaattgtttatttaactaatctgataatcttttcctttaaattggatacttaattcatttacatttagtgttactatactgatatatgggttcaaattaccatattctcatctgttttctgtttgtcttatcttttgctaatttttcttcctcataactttcttacttttggaatactgaaggtttttccctatttaattattccatttcttctttcattagcttgtcttctgtgaagtcttttattactcatactaattaccataaatatggtaacttgcgtccttcatttatcagaactttgtaatattttacctcagtcccacctccccatcagatttaattctatagttctcatatgtttaattctatgtatatattaaactccataggaagtaattgttaccatcataaacatgcagttttcatctaattttaaacacctttaacttttttgtttattttttgttagtatactttgtttatttatttatttctgttagtaaacttccatcaagaaagtatcccatttcttttctgccttttttaaatgaaagcctgctagtgataaatctctcatcttttgtttgttttttcacttttctttacttttgagacttattttccaccaagtataaagtagaatttcttgcctggttggaattttgttttgttttgtttttttccagcactctaaatatatcctatcattattacttgtttttcattatttctatcatgaagtaagcggaaagtcttattgctggttcttggaaacaagatcatttttcctttcactccattgaaggctattttttttaattttgcttttggtgttcaggggtttaccacaatgtacttaggaatgattttattggtattaatactatttgggattcaaaagcttctagattctgtggatcaatgtctttcaccaatttggtaaaattcttagccgatattttctcgaatgttgttactgtccattctttctctccactctccctgagacttcagtcacatccctgctagaccgtttgccgtgctcattatgtattctatggcttcttttcatttgtcttctcttcttttgaggtttctcagtctgtacattttctgggtgacctgttgtttggtataaataatcccttttttctgctggattcaatcttctattacatacatttactggatttttaatttttgtatttttattttttagttttagaatatccatttgatactttaaaaaaattagactccaaatatctctccacttagtcatctggaacatattaataacagttattttaaattatatgtctgataactctgacgttggaaacaactgggagtctgtttctattgtcttttcatgcattcctgttttatgacaagcttggtcgtttttgattaaataatgtatgtgtctgaaaatgtataaaaattctggaagatgttatttttctcttaaaatgatttattttcattctgtcaagagttagtgtagaggcaagttgctttgcttcagtcagcaactcaaatgttttgtagcttagttagagattctgatggttgtttctagtttactcttagttctagggatagactttcaggactccagtggaaaccccgacttgtttaccacactctttccttcttggctgactcttaactccaaagtttgtcttcccaactctgggagacttcccaaggatcttcttagtttttcacttctcatgagttcatttttgcatgatgtttatcttctggctccttcaccacttagaaattggcaaatctcttgaaggcaaaagctgtgaagaatgtaggtctcatttctctatgaattatggtccctcacatcctagctgacttcatagccctgaattctaatgtttatcttcttatcctgtgagattgctgaacacactaagatgtagctttctctataacctcctattcaactgtcagcaaatcaataaaagtaccctgagaggaaaatggctagcttaccttaatttgcttccctttacttaagtctggctgccttggttgcttgctgatgccttcaaactgctgtttttagtattttatccagcttttatggttgttgtctttgagagaaaatggaaagggaaaaaatatttattttatttacagttttaaaaacaaaaatcagcatattatctgataaaattattattgctttttgtgaatttaaggaatgttctgaattattgcttcaatattaaaacaataattattggaacattttgatggattatgaagaaagaatatgtaaaattgggatcgtgtggaaaatctggtatgcatgaaattggcatataaagtaggcctaaacaaagcaggtgctattcttagtaagaagcttcatgccccttatggcatatctgccctgaataatacataaagaaaataatttaacaatatgcgtttgaaaaatatttgttgagcaactactgttttttaagcagtgttctaagcctgtaggtctgtccatgaaggagacaggagtccttgcattccagggttttcaagtaaacaatttagaatagtgcaagttcatgaaaaaaaaagcataagattataataagattatagacggtgatgaaagagctaatttacatgtatgttctatgtatgcatttttcaggaagtgatatttgagctgagaattaaaaaccagaaaataccagtcatagaaaaatctgggtagagtttattaccagcaggaataaatgtggggtgctgaggaaaggaaagaaggccaatgtggctggaacctagtgatcaagagcaaaggtggcatgagatgctgtcacggaggtctccaggtcttcttagctcctgaagggagtagtcagtcatgataaacagtttatattgaattctgggtataatgagaaacccgcagtggtatttaagcaggtgtaacatgatttcctttatctcattagaagtaacattctgctaaatggagaatgattatagtgagataagtgtgaaaactaggtggcagtcaggaaaccatagtacttttttagcaaagagatgatggtaacttggaatagagtggtagtagcagagagaagtggcaggctgagatttatctggagttcggcatcacccgaattgatggtggaacaaatgtggagagtggggccaaaatgttgactcctaggagtttggcctgaagaaattttcctgaaatagtatggattaaaggaggagcagaatggagatactgggtggcaattaagggtctgttttaacgtgttatctttgaagcattcgagtggtgccaggcatggtggctcactcctgtaagcccagcactttgggaggttgaggtgggaggattgcttaagcccaggtattcgagaccagcaaccagcccgggcaacaaagtgagacccctatctctacaaaaaaaagcaaaaaattagccaggcatagtagtcccagctactcaggaggttgaggcaggagaatcacttgggtccaggaggtcaaggctgcagtgagccatattcatgtctctgcactccagcctgggagacagagcaagacgctgtctcaaaacaaaacaaaaaaattattcaagtggaaatattaaagggacaattggatttatgagtctggagttgagtgatgtgcactgggaaagagactgtacttaacagtaaaggcctgtttaagatcatttagaaagcaggtatagagataaaaagagggcctataattgaatcctaggcacttcaaatttaaaggtggtaagatcaaatacatcaagaaagagggaatcttcagctatggcaatgcagatgctgtgaggtacaaattaaaccactcaggtcttggaaatacctaaacatagggggaaaaaacacctaaattgtaatgagtatatgtgtgtatatatatataaatatatataatatattatatataatatataatacatatataatatatcttatatattatatataaatatatatatataatatatataaaattagagaatctttaataagaggtgaatggctccaaacacagatttaatttggaagctcccaccctagcaatacctactggtgttcattttatttatgtaaacacacaaatgttgactatgtaatttttcaattaaggaaatagccaataaaattgtgtggaaaaaagatagcggtagcagataataacatcttttacttactaaagagattgtgtctaaatattaaaagtaatacattcccttgtcaaaacacttcatttttgtttgttttcacaaatattttaatgtggattttgagtcaaattttctgtaggaaggtcatggtagattaatgtcaaattagctgaaacaataaacacaatgaaaagaaaaatcagccttgtaagacagtacaactaaggagatcagtttaaaacactaatgaggagttgcctctcagcactgggtcattatgattatactaatataataagttaggttcaggttagaaagcaaagatgaataatcttcaaaaggcacagtaaatagtcaatttagttgtctaccttcataatatttactatttccatactaaaagcttacagttgtgggctagaatatatgatattcacgtaataatatttaaattgaatttcatttttttgcttcttcattatccttacctctaccctcctcaataaattcatctcaaatgataagattttccatccatcattgtgaagaataatttatttacttaatgattctggaaatatgggaatgtttataaaacgaaatacaaaaattaagaaatggagtgggcaagtaaaaagacattttcccactgattttagaatatactcaagaaaattaaactagtgacaaaatagatttatttaacttataagctaattcataaattaatggcaaaatttatcacagtatacataactgagactttgcagatttttttgtaaatagataacattctgatacaattaacagatctccatcagctgcattagatttcaagttgccctgctaccactgtatatatgcacatagataaatatgtatatgtagtgcaacacagatgagaagatataaagttgttttattttgttcgaatatgtattacagagaaccctatgtgctgtatagcaccttatatatctttcttttaagagaacctcataggacttccaaattcttcactgaaatagctcctacttcttatattacctttcgatatgtcagaaagattctttttctggaagctgttgttctcatccacatcattgcacaggctgacaatcaagacactatttctcactttctttaaaactaaatcaggatttgagggagtggagggatgactaggcagagcaaaaggatttttaaggcagtgaaaatactctgtaggatagtataatgatgggtacatgtccaaacccgcaggacgtgcaaggccaagagtgaagccgaatgtaaactataggctttgggtaattttgacgtgtcaatgtcatttcatcagtcattacaaatgtactactctactgggggatagtgataataggggaggttatatgtttatgggggcagtgagcgtatgggaaatctctgtatttttttttttttcttttttgagacaaagtcttgctgtgtcgctcagactggagtgcagtggcacaatgtcggctcactgcagcctccgcctctagcattcaagcgattctcctgcctcggcttcctgagtacctggaactacaggtgcgcgccactataccccgctaatttttgtgtttttagtagagacaaggtttcaccatgttgcccaggctggtcttgaactcctgaccttaagtggtctgcccatgtcagcctcccaaagtgctaggattacaggtatgagccactgcacctggccaaaatctctgtatcttcctttcaattttgctttgaacctaaaattctccctaaaaaataaaatattaaaaaataaaagaaactctatgtaccctactgactctttgtcaaagattatctattttttttctcaactcatgcaatgtttaacactttggaccatattatcacttatggttagcctcttataatatggtatggctatttttttaaaaagtcatggtaaaatgacataacaaacaattttttatcttagccacttttaagtgtacattgttgtgcaaccatcatcaccattcagctctacaatgcttttcatcttgtaaaatttgaaatactgcacccattaaataataactccccattctctctcccccagtccctggcaaacactattctaccttctgtctctataaatttgatcattctgggcacgtcatataagtggaaccacacagtatttgtccttttgtaactggcttatttcattcaacatagtgtcttcgagattcttccacgttgtagcatatatcagagtttccttcatttttaaggctgaataatattccaatgtctatgtataagtagactcacacacacgtacatatatggcacattttttgtccattaatccattgatgaacacaggttaattccaccttctggctattgttcttaatgctatgaacatgggcatatgggcttcaatctttaaggtttcagttactcatggtaaactgaagtctgaaaatattacatacaaaaacattttaagagagagagagggagaagctacattcacataacttttattatattatattgttgtattttttattagttattgttgttaaatctcttactgtgcctattttataaattaaacttcatcaaagatgtgtgtgtatagaaaaatacattgtatatatgggcttcacgcattgaatgagggtcttaggatgtatcccctgaggataaggagggactactataattctactgttaattctttgaggaaccactatattgttttccatagtggctgcaccattttacattcccatcggccatacacaaggattctaatttctccacacccttgccaacacttctttttctgtttttttttttttctttttaaatagttagcatcaaatgcgtatgaagtggtggtggttcatattttcagtcatcgtttcccagtatttcttgagacaattttgaaatattgtaagagatataaaataactttgatgttggaaagaatagcagtgaagaatgcccatgtaaaatttgagaatcttgaaacatgacagatacaacattgcattaaaggaaattaaatcctggacaattttgcttagcttgtaagtacatatacaacacatatacaaatacatgtacctataagtacatataaaatatatcctttctaaatttggctatattgtcagatacctgagaaaattattatctttatagcctctgtgatatgtcgccaatgcaaggcccatgaaaactcaaaaagagtcagttagtaaatgaactcttttattatttgtataaattatagtttttataatttaaatgtaacatatgaatacttgtgtctggaattacaatagacacatttttatctccagagagttactactggcactttttgaaatcctgttttgtcctagacactggacaaaatattttacataaattatcttatagaacttttcaactccgtaagaaagatactattataattagtacattttgtatcacagaaattaaacaacttcctcaaaatgacacagttagaaaacaatagagcacaagatgaatccagttctttctgatgtcaaagcctgccgtgtatactccagatgacctgaaccttagagtaactaaaagcatcagggcttctctgatatataattgtgagaatctcactaaaaacaagattaaattactacagaggagtcttagaatttaaaactctaaaaagtgaaacttaggatttaccaaaaatgtttctaacttctcatatacatgtatggatgtaacctgaaatgctgggttgattattgaaatgtccatatgaacttacaaatttaccagaaaaaaatcaaactaccccatcaaaaagtgggcaaaggatatgaagagacacttctcaaaagaagacatttatgcagccaacagacacatgaaaaaatgctcgtcatcactggccttcagagaaatgcaaatcaaaaccacaaagagataccatcccacaccagttagaatggcgatcattaaaaagtcaggaaacaacaggtgctggagaggatgtggagaaataggaatgcttttacaccgttggcgggactgtaaactagttaaaccattgtggaagacagtgtggcgattcctcaaggatctagaactagaaataccatttgacccagccatcccattactgggtatatacccaaaggattataaatcatgctgctataaagacacatgcacacatatgtttattgtggcactattcacaatagcaaagacttggaaccaacccaaatgtccatcaatgatagactggtttaagaaaatgtggcacatatataccatggaatactatgtagccataaaaaatgaagagttcatgtcctttgtagggatatggatgaagctggaaaccatcattctcagcaaactatagcaaggacaggaaaccaaacaccgcatgttctcactcataggtgggaaacgaacaatgagaacacttggacacagggtgggtaacatcacacaccggggcctgttgtggggtggggtgaggggggagggatagcattaggagatacacctaatgtaaatgacgagttaatggatgcagcacaccaacatggcacatgtatacatatgtaacaaacctgcacattgtgcacatgtatcctataacttaaagcataataataaaaaaagaaacttaaaaaaaatgaaatgtccgtatattttcttgattttttccaaatgttttgaagaaagtttttgtattattaaatgctattcattggtcaatttaagtaatcttcttttaagaaatcattcagaaattgtaggtccttgatcgtaattctttttgggtaatttcaattgcaataggttaaacactgtgctggaagatttgagaaagattatcattggtccattttgtcaaaatcatttccagaagtttaagtccttttttcttcatttttagtgtgattcattgattttcctaaggaagaacatttaacttctctcagtattcacaaggaatacctgcttgaatgtttaagtaccaacagaggatttaaagttcttattacttatgagcattaaatgaattcaatactccaaattttatagaagaagcatttctgaagatagaaaataaggataatttttaaacacaagaaatcacatgcttttcatatcattatcaatgtggaaaatgctaaaacaacttgctattaaaaaccatttatcagaaacttgtttaattaatatgtcaaatatctgggtttttaaatcatgtataacaatcaaaatattcctaaaaacatattgagaactttaacaaaacattttacagttggaatgaaattagtactggatgattggattaaaagccagtagaaattatatattatcctatttaaatgtaggactatataagttattggtaatcctttttcgtaattttattactttttccagtacctaagtggatactggtgactggtatataataagtaaccaatgaatagatattgaataatgcattgctttgctcaattttctcatctctgagctttcctgtctgtgctactgcaacattactttcttaattatattctctcactccactgcaataatattacagatgttattccctgattaagaatagtataaattgacaatccaacccctcaaatgaaattttttggtgatccaaacgttttaaacatccaataaagatataacatgctagttctctagtaggcacccatttccaggtttccaaacgtttcaacaaaaacatttatatatttctctattgattgcataatgtggagattctgttttgagaatgcacataaagtatattatattctgaactgtaacaaaatgagactctaatttattcacagtcctttttaaatttgtctgtatttttgttttcctgagaaaaatcttatctttatagcctctctggatattgaatatcttgagactagctttaattctcttgatttttattaaaacttctaattccaactttattcgtgaactacatgcttatataaaagtacgtttcatcaaacagctttctctttatctctttaaaatcattaccttttattattttcagtatgctttaatgctttaaaattttattcttgaaacatttggtttttccattgctactttcctattgattgttttcctcatatgtatcttgagattttagtctaggttttataacaagcatagctatatttacagatattttttctataaagttttcaatatagattctgatttttttatcttataaaaaatagttaacaccattaacgtttggatttatttctgtctagttctcctctgctcacacacacacacacacacacacacgtgtacacacaaatacatatatataaaatgggcagcacactaataaagataaaaataaactttataaagttttacattttgtaactggatattatattgtgaacatccccatgtaactgtgtagtatttgaaacttagttatttaaaaattaaattgcaaatgtatgatcttatagactattttcctgcttccaagacttctttggaactgtggactccctgaaatgccagggtaacataagcgagacagaacagctagcagaacctcagggaataccactgactttatggtgtcagccagtatcatgagagcccacaatgttgcctttcaaaccaagtgatacatttctatcaataattaaataaatttgaaagtacactgccattgcatttgcaatcttctttctttgttctttattcattgcaataataaaaacaaacaaacaaaaaacaacaccaaatcaaatgactgttgatgggggaattataagaatagatgggagtgaagacccaagctgactttacctccaactcaaagatttttgtccactaatctaatttctctttctctctgtgtttgttaaaagtttcaaagtagatgtaggttctcttgccaagttgatactcgtgttctttccttttcaagattacataaaaagtatagcttagatccaacgtatcaacctggaataggtgaaaatatcactattgattataactagtatttaacgaggcttaatatggaccaaacactgatctaggtatttcacatgtattatgttttgtaatcctcacaactttatgaaggaagtatatgtgtgagaaaagatacacacgattagattttgagagccagtgcaaactgcaccgcaggtgtattgcctgttcaaatttttctttaccactctatattaacacctaagttaaaggccggcacaataagcaatgtgttgcttgataatatttgtaaaacaaatggattagtgaacaagttaatatgtcactctgtggtctttaaaatatatatggaaatgcagaatattaaaatctgcaatacatattttgaaaaacaaaggtgagagtaatgctagccaaagcaggtttgactgcaggcacaactgtccttcccactcttcttaattgaagagtcacctcaatccccatttgaatgttctcttttcaacctcctaaaaagattactgagaatgtagatatttaaatgtattctgttcatctttaaataatttcatttatgtttaagctgcaaaaattgatctgaagttagtctggtatattgtgtactttaagcatgtgatacatttctaaaatgttgttcatgtcaagaatatctacaattcaaatcatgaccttcttttggcttgtattctaattttgaagtttctgacctagacacaaaaatgattaactgaagaattttaatagttgtactgttgttcttcacttctatcagtgatgatatttgatagtgtaatatgctgagcaggcaaacaatgaaaaagtcccctccatgcaaaatgtatgtaaaatcagctttcaataagtgaacagtatttactacctgctgttccttttcaccatttgcagtaccattcttagactcactgcaggcataaaccctgggataaggaaaagttaagcctccattcttcatacctctaataaggctttgccaatggctgcaatcattttacaaccatccacttatgtttaggtttaacagagtcttggcttcataatgaaatacttcattaaagtatttttatgatatctgtttacacatatgttcatagtagaattacatggtgttctgttatccagtctttgccattcacatggactcagtttatagtgtctggttatgctactgaagatcttcctgctttaccatttgctgttaagtaattgtagtcagacagactgcccaggaagccccatggactcagttttatcccttgggtatcacaaatgaggaagagtttgattccatattggtgaaatactacttctgtttcctaaagatatgttgttttctaagatttgcttctagattttgtgattaaatgttttattggacagggatttaagaatcagaatttcatgacattttgtcctactttaaatggaaatgtctatagacttttctagtgaaggcttttacaaatgttaagggatgattgaatgctcacagcaggacacatggcattacagaaagtctccaaaattattcatccttttggggacaactataaccatgattttttgtgacactcataacctgttgaattggaaaaatattaatgttagaaatctgttctcatgtcacttttaaaattcttctccttttttgcctcctgtagcatgagtcctagtttgattaaactagacacttgattttctccaatggtaacatgtttttaaaaaaggacttttactctgttggaaccaattaggccaatgtgaggaactttggaaggaacatgagcagccaaacttgctaacagcaaaacgtatttttctgaaggcagcatgaaaaggacggaggagttctctaaggactgtgagttccacgggtccttttgagcttcagaaatccagctctcagcacttcataaatcatttctgacctgatgtcactgaagttgtattattatgtggttagtataaaattcagaaaaattgggagaaaatacaaggagaagaatttgcagggtgattgttgtaagatttttatcatgtcctcttaaaaatggtagcttttcagaaacttttgttaactgctttgcattccatcttgagaaaatgtctgtatagttagatgagcatcatctcctctccttgtttttaaatcacatccaaaatgacatcaggcttgcagccgtctcattttttccttttatttacactcttcacacttcattggcaattgaggtcaccactttaaaatttagggtgaaggctaaagaccagcttgacaaactgttggcggaatgctctcttttgcaagtcttcgttttgaagaaagaatgtgtgatttagaaatatttaagattgtcattttggtagaacttctcatctatcaatgcagggtgcagcatccctatttattaatgttgtgttggttagatatgttcacccattaggtacgtgcagaggtacctgaaaccatctgagaggtggtatcccatttttcataatctattcaattgaactttaaaaataactgagcatcttttatatacaagacattaacagacatttatattctatggtatctactgctagcaacttataacagttttggtggtaaaataaaggcaaacttgcttcataacaaaacaaaattaaattatcaaaaagaaatgctcagttgttaatttaaaatataaaatgagacatgagaataaccttaggttagaaattcagatgtagaaaatatctgtataaagaagttagttgaaatactcataggcatgaaaggtattttgcaaaaagcaaaagtaggcaaaactggatctatgaagttgctccataatgtactagtcaggtgaagtagcacaaattacctagtgtatcagttttcttttgttaacacaacatattaccacaaacttaatggcttaaaacctcacaaatttatctcacagtttaataggttagtagtctgacacaagtctcactgagctaaagtccaggtgtgggtagtattgcatttctttctggaggctctaaggtagaattcattttctaaaattcattcatttaggatagaagctgaaagaatcagtttctacaggctacctgcatcctttggctcatgaccccttcctccatcttcaaagccaggaacaggttgaatccttcgttgtaccaccctaacctcttcttttgcctccctcttatacttttcaggacccttatgattacattgagcccagtggattatccagggtgatcctttcatctcaaggtctttaactgaatcatatctacaaagttccctttgccataaaaagggtcatattcacaggttccaagaattaaatatagacgtctttgagggaccactgtttactctaccataactagcctatctcatttcaattttctaatcagttactacctgtctcttagagttcttgttagcagaaacaaatttctgtgtaataaagtgcctggcaaaaagtaggtcctaaataaaatgttattttccccaagggaaagattattaggaattataacattgggacacacctttgtttaaaaagctctaattaacaagaaccacagcaggggcgcacatacaggggttggagagaaattcagttagtgctgtcttctggacactccttctatcttcattctctcctctgccattgttaaccttccattttaggcaaggagctgtattaggaaaatgtggtttccttttattaaaagaaaatctctaaattattaatagatattacttttccaaagaaaatttcagaaaggagaagaacaacataatcaaaatctgtggacactttaaagataaggatgatggagaaagactgaattttgcaagcaggttataataactcctgagagtgattgtaatagggtgattaggtcatgcatggactacaagggatcaagtagaaaaggagtggtaaagtagtaaacagcagagggtacaggctactcttaagaaagtccctagagaaggataagaaaatggggcaatacataagcttggaaatagatgatgatatttcttttttttttaatttaattttatttatttattttttttattaatcattcttgggtgtttctcacagagggggatttggcagggtcacgggacaatagtggagggaaggtcagcagataaacaagtgaacaaaggtctctggttttcctaggcagaggaccctgcggccttccgccgtgtttgtgtccctgggtacttgagatcagggagtcctgatgactcttaacgcgcatgctgccttaaagcatctgtttaacaaagcacatcttgtaccgcccttaatccattcaaccctgagtggacacagcacatgtttcagagagcacggggttgggagtaaggtcatagatcaacagcatcccaaggcagaagaatctttcttagtacagaacaaaatggagtctcctatgtctacttctttctacacagacacagcaacaatctgatttctctatcttttccccacatttcccccttttctattccacaaaaccaccatcatcatcatggcccgttctcaatgagctgctgggtacacctcccagatggggtggcggctgggcagaggggctcctcacttcccagaaggggtggccggtagaggcgccccccacctccctcccagacggggtggctggccaggcgggggctgccccctacctccctcctggacggggcggctggcagggtgggggctgcccccacctccctcccggacggggtggctgccgggcggagacgctcctcacttcccagatggggtagctgccgggcggaggggctcctcacttctcagacggggcggctgccgggcggaggggttcctcacttctcagatggggcggctgccgggcagaggggctcctcacttctcagacgcagcggccgggcagagacgctcctcacttcctagacgggatggcggtccggaagaggcactcctcacttcccagactgggtagccaggcagaggggctccttacatcccagacgatgggcggccaggcagagacgctcctcacttcccagacggggtggcggccgggcagaggctgcaaactcggcactttgggaggccaaggcaggcggctgggaggtggaggttgtagctagccgagatcacaccactgcactccagcctgggcaacattgagcactgagtgaacgagactccgtctgcaatctcggcacctcgggaggccgaggctggcagatcactcgcggttaggagctggagaccagcccggtagatgatgatatttcatttgcaatagctaaaattgactaagtgttaagtgactctgatctgttgaaagaattcatgaaccaagatcagaaactttcttctgtctttgatttgttattctactctgttaacattatacttctaacacttcccatcactacaaatctttgctattagtccccaaatgctttgaactagagtgattcatttatgtgtgtaatgtcataaattggagaatgtgtaggttcatcttaccttggtaaatacagaagcacaaaaaacaaaggcaatgccaggtatttctccagggtgaataaattttagaaggcaaatttaaactgtcatatttctgattgcctgtgattcacaccattgttgtactctgtgacagtttcattgaaaggactgtcatgttccatgaggaactcagcctacctgctcttttaccagtagctggtgggaaagccatgctgtgccaatgacttattcacaggaggcaggtcaatcttttgaaaccacagattgtttcaaatgagagaaaaatatgtgagaagagaatagatgtcaagggtagtgctaaagacaaggaaaatgcttgcctgggttttccctgcagctgacgttgttaaaaatgatagcaacttaatgaagcatggcgtactaaatgcattaataagctgagggaggaccttattcattccaatttggactctgctcactcgtgttactcgttttcttaagactggactaaaattgtgagaccttatgggccaacgataccctttagagctgataattaatttgaaagaattattaaagcatatttcttgagctaagaatgcagtgtattcacagtaagaggcagagttaaccatttatcaagataattaagaaaatgcattaaatgtttgctccgtaagagcaagcactaaattaccagtagtagtaatattattatgtgaaagggaatcaatagtttgtttactaaaatgagatgcattagcaagcttttttattctgatataaaaattttcaaatatacacaaaagtatagagaataccgtggactcaaatgtacccaacacccatccataagtattaactcaggacccctcttgtatcagttttcaacccatccacatcctactccacccctccagattattgggaagcaaattccatatgtattactcgctttgtaactacttcattatgtatctctgaaggataagactcttttataaaggaaaccattgtcacatctaaaaattaatactattatactgattctttaatattaacaaatatttactcagtattcaaattcatcacacctgcttccaagttttttaaaaacagttgaatcaggattcacaagaagtcacatactgcatttgttcgatatatctaggtctctcaatcaataacattttaacttccttgcaacttatttttttgaagaaaccacgttgtgtgtccagtagtgtttcttacatcctgcattttgctacttagggttcctgtagtactgtttgcatatttctctactactatatttcctgaaaactgatagataaatttagagagttactctgattcagggttcatatttttggcacaaccactttatagattgtgctatgtgcttccatcacactgcagaaaatatctgggtgtctcttttttggggatgtttctggtcattgatcagcattaatggccacaggtccatcattttatgggggctcccttcatagtaaactgcacagtaaactatacacagtgaaccttgtggtaaactgtagcatcctgtgtactatagcaatttactccatgttgcttttttcatttaacaataaatcccgccattcattgctcttccatctcagggttttcttgcttattattgcttgttaaaattcttccaaatcacatttataatcaagtcgttcagcactaaggaaaaaaaataacattttcatgaaaaaatgaaattgcattacatttatatattctcttagggacattgaaaataagtcttgctatttttcagagctagactttgagatttgcttttttgcagagtgagatagagaagtccttcaaatactgtcccttgaagagttaggcattgatttaaacccttttgaaaaacaatttcaacaaataattgaaaatgttctcttcaaagtattatcattagtcatccagttagattattattattaggaattctgaggtggtggaataattcattttccaatgtgttaacttctcatgagtttaatgtgagtataaaaagtctgttttaactgagggcagagtattcctttttctcttataatacaggagccagttacaacacaggaggtgaaatggcctgtttgcttacctgcaacttcaggaatttcatgcttagcaattaattgcagtacacacttgtgggggtaggggtaggaggttggataagtgggttgcacttaataattcagtgacaattacaaatcgtttcactatatgtgaaagtatttgaagtaaatttacctgaagatagaaaatatgggtgggcaagctcctcctgaactccccaccacattattctaggtttattgaagtaaatgtaaacttataaggggacataaaactcacacagaaaataataattagacatatttccacattaatgtttttaagtttaaaacatcatttaaaaattttatcactgatgcttgacttaaacaagtccacttatagcattgtcagaatctgtataagtatctcttcagggaatttttaagatgagagtgaacaattttctgagattgcctacacatttttgttacacagtaagagccaggttctatgtggcttaggtggggatggggctttgagtgaatcctctgttgtacacagacttaatacattctccatttcagcccacttttcacctctgttttcatcagacctacctcggtgaggttctagacttctgccctgctgcagctactcagtactttaggccatgacctccgctctccttcctcagcaactcaccacagaccttccagaaaaatgttaaacccttctcatccttttcttgttattggtttctattttctttctttcttttttctttagcgtcacaggggaagagctgataattgtattggctatatgtatcaactcaaacagagagacattacctgcagttctataaagattcccagattattccaatgggtattaagcttgaaaacatgatgtctatgatcctttctggttctgatattgtataactctcatcacttaatgaaagccaccgttcctatttggataaataagagaattgaaaaacgcactattagaactgagagtacagatgagctttccaaatatattagagatggcatcacagtacatggaaatgttaaaatccataacatgggcaagagcacatactagaaaagtgcagaacctctttagaagtgaagcattttcgttccatgcacatcaatttgctataggagttcagggacaaatagcaatatgggaaggaggcggagctcaacattgagcagaaattagacacatgctgttctcttgagagattaagaaagaataaatagaagagagtaagtcaggtcctatgagaaggataaagcattgtcttccatagagagtgaccttcattaatattttttacggcttttgtggagatcagcctaaggaaacagaagtcctatggccttattacatcattacagaatcacactttggctgggtctcttaactgtgtaacagtggtgctcaaaagtctctgtaaatctccaaaacacaatactctttagtagcatttcttagatttgtgattcttctggggacaaaggatctgggatacaatgggttcccgagtgcagtggtgtgatctcggctcactgcaacctccgccttccgattttcaagcgattctcctgcctcagcttccggagtagctgggattacaggcgcccaccaccacccccgactaattttttttttttgtattttttagtagagacggagtttcaccatattggccaggctggtctcgaactcctgacatcgtgatccgcctgccccagcctcccaaagtgctgggattacaggcgtgagccaccgtgcccggccgaggatttttttttttttttaaatcaagacttagcaatgcatgttctagaaactgattctggttttcagacttaactaacatgggtataggtgagctaagatattaagctgcagggaagggtctagagtagctagagttcctgggctgctcacttcaagctatgaggtctcctgaacactggtaaaaaccccagtgctgtacaaatatcattttatcttagccatgatgttcaagattggaaagcataactctatgtgatgatcattgtccgttgcttattattttgagactaaaggattcttaagaaagaccctattctccatttccacactaaatgagatcaagttcttaatactcttcttattataggaggaacatctaattcaatgctacatcagtaattaaatgatattttgttaggtgacatgcaaatgagtaacaaatggaatatgaaatagaaagttccctttgttatgtaaattgtcaaacacttgatattgtttttaaagttatttgggatttttttaagacaccaagtttgtaacaagtgcccttcaacagaaaagacacttggatatcatgagatgttctcttaggttcctcaaagcctagcagtcatagcattttaatacttactagtggggagtctgccttccctgctgcacaccagaacagactggggtgggggttaatcatctggaaatgaggtattataactactgattttgaagagtctttataatgaaaacaagacacagttaataaaagtagcatagaaaacattagagagttattttattagggccattaaatatttggagtacagtacttagaaaatcactgttaaaattgttacagttactctctgaagcctgctaagaatactgctatttattacatttttaataatgctattcactacattttaaaagtttactcaaaaactacatgactttcaagtcatttaagaagtccaaaagaaattccatgccaacaaatttaattaattttgcatggaatgtgaaagaacccatagaaaataaatgaaagagggatattgttttgaaatgggactcattcagtcttctgtaaggcggtgactgcttttccgtgtcactgctggcagttatgttgaattatagaaagagtctgtggggtctctagtagaacttctcttcgtggattatttttatctattattccagagccaacacaggagctatgaagtcataaatccacattgtagctgcatgagaacttggccttatcacatatttgcatactcagtgctttctaagcaaagttctttatccataaccttagtgtagtcttatttttcttagtgggtacctgtgatctctaatatgctttgctatctctctttttgttttatatctttaaaaaaatctctatgtttttattttttctggaaggaaacaggctcacttggaatatttacctagattctctctttcacaagaacacgcagtattttgtattcattatctcattatctcttccctggttgtgtctttagaaaagaaacaatggataacagagggtaaaagagtttcagtaattttctcagctcacagagacctaataggacaaatactccaggaacgtatgccttagttcctgcagatgacaatatatgctaactgggattcaagctctaacaaacaggcaagaccaatgtcaaactaataaccataacgtggaagcacattacagtgattttggctatccaactaaatgtaataaatatcaaatgcccaccatttcagaagaattataataaggaatatagcatctttaacccatttctcatttgcctgaagaatacttgcagacagcatttgtggcttaatgtttaccctgagataacttgtggcttactgtcctaaccttatccccaaagtttgccatgaaatatctcacttttattattatttttgcataggtctagcatattgactttggaaacaaaagacatcattctatttgtagcattctgtgtttgatagtagtatttccatatacaaaatatagtaattattgattgctgaaatcaaatcctagaaaatacagcattcctatataaaaaattattaaattctgatcatcatatacatttctgttacattaggattagagataagttttatttagaaataactctaagaaacgtttttatattttattttcacattgaaaataagtcagatttgcttcagcctcaaaaaatgtgtttatgtaaaattaaatgagagctggcagtgagctgtacattttttttcctaatgggacatgggttatgggttaaagatgtacaagctggccgggcacggtggctcatgcctgtaatcccaacactttgtgaggctgaggcaagtggatcacctgaggttaggagtttgagaccagccttaccaatatggtgaaactccatctctactaaatacaaaaaaaaaaaaaaaaaaaattagccaggcgcagtggcacctgcctgtaatccagctacttgggaggctgaggcaggagaattgcttgaacctgggaggcagaggttgcagtgagccaagcttgcgccattgcactccatcctggacaacagagcaggacgcagtctggaaaaaaaaaaaaagtgtaaaagctagaggccctggcctccacaagcccacaatttagttattcttcttctttatgattttaagaccttgtcaggaatactttgggattatcagtagttaggaccaagatatttcatattttatagcagagacaactctatctgtgcattttataagattaatccattggtatgtttcttgttgaatttctatataaagacattctacgtgatgagttgttcaatatgaactgtctaaaaaacaattccttatgaataatacctaaaaatgcataagtagcaaatatcttttatagtggttgatgtaacatattctatgttgttcctacttttgccctttctctgttacttattttactttgtctttattttaaagataattttatttaaaagtaaaacatttatgttcatacaaaaaatatagcagaatacgggatggaaaataaaagtcctcctcttttcttgactcctaaaggtggcagctttaatatgttcacataattcctctcccaaaatgtcttggcatattcaagcagttacaggcacatacatagatatgtgtgtctatctgcagttatacctatctatatgcctttgtaaatataaattcatcagtatttctcacctgcagtgatactcaataaaacagaatgctcaaagcccagacccctcaggacaaatatcttggctgtccttgctatgctggggtcaatcagatggtctcaggggagaggaggcatttgggaggttgggcagcagtgatttgtcaacaagtacagaagcatttcagtattttatccactagttgttccacaactgtgcctaaaaggctaatactaaccctactttgactcattcgatgggtgatttcccctccatggctctcaagcatgcatgcattcaagtaaacatcttgaaggaatagcatcagagccacctgtattaccgcattccataccaaatttttatatttttaaatctagtcccttagggtataccatagatcctatacacgtatgcatgagttaccatgtcaaaactatgaagcagataaaatttgtttctagagcatccctttcaggattccctctgtagctcagcagtcctgttaatcacattgtagtgagcctgtcctcccaattgtgccccaccagtgacctcatccacttagagcttagagctgccaagctctcatacctcatagcatttactagtcaagaacatatcatactgttttattattatagcacttttcatttgtctcattattacaatatattaacaacacattgatggtggaatagtaatttaaactaattcatatctgtctttctacctagaacattgtacataaatgtcattccataatgtttcttcactattcttttggactacattggtaaagacacagatatgcactaccacaaaacatctagaatatttctttttttacgtcttcaaattctatataaatttgtaaatagagcattgccacattcctctccattgtcactctgttaacagtaacaatacctctttatttcaccccttttcttgcatgtttaccttttgtaaagagaaggtacagaaacccttcatttaatgtgtttcaggttcaatccgttgtcttcataacactggaatttctcctccattattttctatttggggatgtaaaggaatggacatttattgaggatttactgccacaatgctagaaccacaatctgaacataggaatgtgtttatgttgtttttgctgtaccatactaactgcctctaaatggcacttttttgaggattatgtgatataagtaaacaagttttctaaactatcaagcactattcacactgggaatttctagcttgtattttacagtctttaacacagtaaggtgagtaaattggtatgtactattaataaatgttttaggtggtaataattataatggaactttaaacatcaggtgaaatgttgccaatgagttgttactaaaatccagtcttaatccatttcttttaaagccatggttgtcaaaacaaaacatcacttcttagcaaaaaattattagatatgaacctgtaatagtaaaatcatttcagagaacattataagattatagaataaaatctgaaataaaatctactgtagcatttagacttatatttgacataaaatgatgagaatatttgggaattcaatgttattgttgttgttatacttccctaggtgttccagatcgcgtatgtgattgtgaaggcagctaactccccccggcctggaaactggattttggaacgctctcttgatgatgttgaatacaagccctggcagtatcatgctgtgacagacacggagtgcctaacgctttacaatatttatccccgcactgggccaccgtcatatgccaaagatgatgaggtcatctgcacttcattttactccaagatacaccccttagaaaatggagaggtaagatgagaaaactcaccatttaagcacatttgatacggtgaaataggcctgtcagaaagacctgaatatatcagtaattaatgtcagggagattttaaaataggatttagcaaaagtacatttaaatgagttattaaataaaaaagaaaaacctgaggtgattagaattttaactaccttcatgtgtctcccatctccagtaaagatcagagaagaggaaataggtttaatctggaaagtcaatgattaattttacatataaagagactttctcaacaatgaggattgctaatgattagagaaggattggagaccttaaaggtggccttacatttgagtgtactttggtctgaagatggagacaaaagaaatgaatttgtgaagaaatgtaatccacatgaaagacccaaatgaaaagtaattctttcaatcttttgatgtttttctgctgtcaccacatagggctacagtggggtttcttccctgggtcaggctttgtggaacagtaatgtgcaggaagtcttaggttctcagtgatgtgcaagctaggttacgtgcttagttcaaatatgttcttctccagtgtctgtcatcctgtggttaagattttagattcattcattgattttaagccacatattctaaccatggcttcagttgttattagtttattagttgtatgtgggggcggggaggttttttttttgttttttttttttttgttttctggcttagttgtgtgttcttgatccagttacttaaattctctgcacctcagtttcatcgcccataaatcaggaataataatagttcttacctcatataattgtcaagaggattaaatgcattattgtatttaaagcattagaacaatgctgaaatgcacactaagtactctgtgctatttttattgttttgttgccattaaggaaataataaccattactactattatttttattattatccttagtcttctctcaaatacccaaactttgacttagtgactctcttgaattattcaatatttctttagtatgtttccctgacttgtctccctttagtatatgtgacccacctcctttcatgctacctaattatgtatatctccattgatactcatgtctgatattctctcccacatagtccaaacatctgaagctagtatcatcatttatatttacattttcagaaaacccatattcacattctatcatgcccaccccagccaatctagggttatctctcaacacttctagggaaaattagggttttggcataaatctgtcagaccctcattaggcactatttttatattaatgtataccagtgcttcactatattttaaattccatgttcaaaaataccagttttggggaaaaacattccaaatggtactctcagcagaaatctcaatctgccaaatgacaaggactcaaatgcagtgagtcaaacagctgttcaacctgctttgtgcctagaggcatccaattcctggccagtttggcctgaggatatgggagtagggagtgcagaaagagttttgagttgaatttttattattttttatcctagattcagtttacataagactaataattctcaaacaatttaagactattctatacctttaaaaatgattcaattcagaaatttattaagcaatataaaatacacttcggcaggtatgtaacatgcgtgtcacaagcatataccctacccattctctcccttcattaataatggttctccattccttaaaccaagtcagcctgccaatatgaaacaaaagacatgtttattagttaattagttagtttctttaattggctatattgttttcactcctaaacaacacttactaaaaactgcttattgatggtaactattaggagcaactgactgaactgtctctgtgacatgtttccttacgtctatttgtcactcatggggaagtgaatgaaataaggaacagaaagtaattcaaaatatttgccatagaatgataagactgaagaataagaattaaattcagacctctcctaggctatctattcattttatatagcttactttgtggaatatgttacttttttgaatagacaggtgatatcctccaagactctcagctcaatgataatataactgaaataataattgaggtctctgattctcaggtaaatatttcatccataatctggtaaggattaaaagttgacttttaaaagttgacaatcgctaaacttaaaaatggttcagaggagatacaatattgctggatctaatgtaagtagaaagaatcctaattctgatatatcatggcatagaaaaagacacaaggaattagaagacctggattctggtactggttccagttatttgtgggaccttggtcaaatgatttaatctctctgggattaaatttctttaatagatgaattagttcaatgcccagattgttctaaggcagcatggtattttctaaaataatatagctttggctatcatacaacatttgaggatattctaaaagttttggatacttttctctaacattatccagacaaagtagctgtggaataaatctcactcgtcagctttagttttaaaattatgtactttcacataatccctggaatacaattattaattgtttatgttcaaaactttacagagaagtgacagtcaaataagagaaacaaacatataaaccagtaaataaaacatgattgcataagtactgtaacagtagtgtatacagagagcaataaatctccccctgcttgagtggaaggaggcacattgagaagataacttctcagaatatgggaaaaccagcaacaactcttatctcaaaagtctcaaagccaatatgcaaattcatctccaataatgcctatgtgttaaactcggtacatacagaatttacctccattgttgagggatattgttatcagatgtagaattctaggtttgcagttattttcttttggcacattttattgttttctgatttccattgcttatgtagagaatgcagctatccgattactatcttttggagtgacttttctctgatttatttaaatatttttttctttgttcttcagtagttttactatgatgcttcagatcttcactgcccactacaatagccactagccatatgtggtaattcaaatttaaatttcagttaatcaaaattaaattaaaattccatttccccattacactagccacatttcaagtactcagtagccacatgggactagcagccaccacactggattgggcagaaagcaacactgccattattgcacaaagttctgttgggcaatgctactttagattgtacctttttattttctacatatctgcaaagtgatgtctttcatcagttcagaaaactgttcagtcattacctctctaaatattgcttcttccgcattccctctgctctatgattctaattaaaaatgacttggaactttttactgtatacactatgtattttaaactctcttctttagttttcatccttttgtctttctgtatcttcattctaggtattttcttctggattacttctagttcattaattctcttctcagctatgtaaatattgctattaaagttattcataggattcttaatttcatatatttttcagtttctaaatttctctggttcattttctttttttctttctttcttttttttttttttttgagaccgagtctcgctctgtcacccaggctggagtgcagtggcgccatctcagctcactgtaacctccgcctcccgggttcccgggttcaagtggttctcctgcctcagcctcctgagtagctgggattacaggcgcgtgccaccatgtccacttgatttttgtgttttcagtacagacagggtttcaccatgttggtcaggatggtctcgatctcttgacctcatgatctgcccaccttggcctcccaaagtgctaggattacaggcatgagccactgtgcccagcctggttcattttcaaatagaagttgtttctcattttacattgaaattttatatttatagtaaaattttaatttaataatatgatttattctaaaattttcaatattctatttttaatctccttgagcataaagtaaaaattatctttaaaagtttttgtctgataattctaatatatggcctttttggatatattttattttctgtttcatctgctgattctttttatgctgtcttacattcttgtgtgcctgattatctttgtataacagaagttgtatttgaaagagaatgtgtagaaataatttgagagctagtatattgtcttcatcctgtgtgaactttctgatgctactgccaggcaatggaaatctggatcatcttaattcaattttagggattcaaatttctgggacattcagatgattcaaagcattgctataacccagtgacagctgctttaattccagtatacgctcattcccatgctgcttatctttggagtccaagccagcgtgtgtgggaattacgaaagtcccacccatgcagtcctggaatccaacttttgtcctcctaatacagcagggctgtcaaaagagctgctcagtctctcagccatgtgtctggacaggaaaatgctcacaggacaaaagctgtcacaacgtaccaatcacctgtctagacatctcttttgtccttgatgttgagaaggttatcttcactctcttgatagctctcacatggctttaaacatatgtttttgtatatttatccagtttgtctagttgttgtcattgagagtgttgactcttactgtataatctaccataaatagaagcgaagttgcacatgcatttaattttttttattttggaattatgttaagtttacacacatgtatgaagattatagagaatcctcacattccctcatccagctatccctaggaataatatcttaaataatgacaatgcacatgttaaaactaagaagttagcattgatacattattgttatctaaaccacagaccttattcaggtttcattcattttaccaatttcattttttctcttctgggatccaattcaggtactattttgcatttagtcactgatctgtgacagttttaagagatattttaagaaatattttaagagatatttagagatattttatagactattattcagtttgggtttgcctgatgttttttcatggttaaactgggcttctggattttgggaaccaatactacagaggaaacagtttctcattgcatcaatcattttttattaatatatgcatatttttttcttttttattggtttatggggcttgtgcttctattaataggtagatttttaaaatgtttttaatttttatggttacatagtaggtgtatatattttagatagatttttaacgtggacagcagtatctaaatatttactgtgatttgtaatgtatatttttcactaagcattgaatggtcattttcttccagaccttcaaaatattccttaaatatgtcagaaataagaaaaacaagtccctccctctctgccttcctcccttccttccttccttccttttttttctttcttctttacaaacaggttctcattgtgttgatcaggctagagtccagtggcatgattatagctcactgcaggctcaaactcctaggctcaagaaatcttcctacctaaaaaatcagcctccagctaattttttaaaatttttttgtagagacagggtcttgctatgttgcccaggccgttctcaaactcctggcctcaagtgatctttccaccttagtcttctaaagttacagtcttctgagattacagacatgaaccaccatgcctggcccagaggaatttttaaggcccacccatgtaacaaggcattatgaaataaacatgtctcaattgttacacactagttagacaacaatgttcatgttttaggcttagaacattaataggaaatagttttcttgtgactaatgccaaatccactgagtctaaagtttattacatttccacttgtctaaagaatttttgagacatgtgccaaaatctttagaacattagagctgaaagataccttaggtaaatttctcatcaatctattaaaggatattcaagcccccaatttcagcctctgtatccaaacttcaatactgccctatgttcatatcatcactggagaggtctggcctttccttatggcctctttaatcttaattgcatcatctctgatgttttatttggctttgtttgttactccagttactcccacctgtttcccttcatggtttggtttggccccttctctgccctccactccacattgatttcaagagatcaacaaatgttagagaactgggttcaactactaccaagaaagagcttaaccctgaaacctagcatcctaggcctgcacccaaagggagaagagaagcttattctgagctatgagataatcgtaaggtatcaagtctcagggcctggcaaaggagggataatggaggatataggcaagataataatatgactgggtatgtcgttatccaggctgcaaatagaaggaggctttgagcaaaagccttaaaacagttttattttagaagggcaattttctatcatcaatgccaagagaaggctcagcagggaccctactttgtcctgctttgagcaaatgatactgagctccctaataggagttgcagggtatgaagcaacagactgcaggggcctccattactttgaggccaaccacagggtagagctcttgtgggaacagctacataacatgcatgtccagcagtgccccagggaaccaagccatcgagagctactatcacagcccaagtgctgcctctgcagaaagcagtagcccagatgctattgagaactgcttacaagaactgccacttggaagcaccctgagaacttggctttacttggaaatcacctaggagcatttgaaaaatagctactcctgagaccagaacttttaattcattatatttgtcagaggctcattaagccctatgtatattttaaacaagtactcttggtgattcttatgtctgtattcctggcttaatgttcagctatttccagccttttaaaccctgtaggagaacagggcaccagttatttagggaaagaatattggtcattctaactacttccaactgaagaaagagactaactttttctgtcaacaaatgtgataggttttggtggactgagtctcttggcaggtttgagttgagcaaataaacttcgaactaaaactaggttattgatggtcaaaggggtatctgagagaagaatcacagtaataatattgaggaggacgaactttctagatggcactgctttagagatcctagaattaaaattataatatttttctgttgtatgagacttttccctttctttgactcacattattgcttttaatttatttggattgtcactagactgctagctaaatattcgtggttaccatagtgattttgcttccatttcctcatacagaggcctttaagttatttacatatgatttcctttccttcttaccaccaccttctcactctcctggactgcagctcaatggaacttagattcactttgattctgctttgaaacatggcaggcttgtataaaaatccctggagaaaccatcattaaatcttgaagacacttttttttttttttgtaaactgtatgtagagctttgatattattttgatttcctatgtgacagaattttatatatacagacagaatatttttcttcctcttttcatcatctgacattatggtggtccttagaattgcaaatacaggagaaggaagacacaaacccaagactgtattaaaaaatgtttcagaaattctcctttgatataacattgttaaggttataacatgattttgcatgtgagtttgtatggaaatgagggaatggaaatgaagacctagcctttctcaattacccttgcaattgttcctttagggagaaacagcggagtattactaatttgtattggttttcaatagaaatttaggtaaataattatttggggtttcaggcttcctttctctaaaaataattctttttagaccaatgtggggccaatcagtacctggagcaacaatattaaagtacctccttacagtgaggtttatatggagtcctctaaaaaatgaaatgtttcaactctggttggaatacacagagcagctgaaatattttgaaatgacacacacataaaatacataatttatttaaggtaatttattgttacattttaaaaatacatctttttaataaaataaagataaaattaagaggattatattcctcctttttctttgttgatcagttactagactcccttactcctccaaaaaaaaaaaaaaatatatatatatatacaatgcccagaaagtatccacaaatccctgttaaattaatgcagtattgttgaaaaacaaagatggccagagaaactgaatgagaatggaatcctgaggagaaaacaccaatatttaagagacctggttctctcagtgttgtggaacaggatccactgatatggaacagaagggtaagcttctgttaagctaggtaaggaagcttagggttgtgaaagaaggtacaaagacactgcacactgacttttggggaattacctggatttggctttcaggtagctctgccaaggattaacaatagggttcagaaagaagagtaaaccatctaatatgtgccccagccagtttacgtggttataataacgatcaaattagatttttatggcaaaactctctttaacctctacgatatgatagtatttccagcctttttattctcaaggttcagtagctaacattggcttaagcccactcctaactatgaaatgactgagctggctcagcctggaatgagagtggggagcatgagagggacacagccataccacatgaggccatggctagggaaggcagaggctactgaacaagactgaaggaataagcaaagcaaaaaaccacaagcttgctgaagttggaggaccagaaggaataggtgagggtctcagtgctaatgtagggttaatccagggccaagtagacaaaaataataataaaaccacaacaataataataataataaatgatggctagcatttgttgcacatttattttatggagggtgttaatctaagaaatttcccatgtataaattcatatatactaatacttgtcgcattttacagttgagaaacaggtattacagagaggtcaaataactttcccagggttccacagctagtaatttttggagctgtgatttgaattcagtgtattctcagagcaccagaaaggtacaaagctaaaagtttccttctgtgtctggggtttcctggaaaatctgctctgccctataagctcaggagtcccccctcctagcagttcctgctgaagctctatgtgagattgcacagacctgagtttgagctgctgcttattttttattttggggttttagtattttcatgttttaggttaaaaaaattctttaccttttagctttgatgaattacttcatttttatatctaataggtttttttaaccttcactttaattgatttcttaacctctttatcttgctcattttttaatctttttaatgattttaaaatgctgattttaataattttatcttggcatatttatatttatcagtttttctgcttcaagctttattctggcaaatgatgtatatttatatttcttttgtgttgttttttaaatattttttatttttgtttctggaatttaatgtatgtcagttgtgcaatagacttgttagaattttgtttgctttaataatttttaaagtgactttttgcattacttttgatcattttactcttagcttattttgagcttttgatgtctaaatataactttgtttgtctagtgttttagtgtctttagtcattgcttctacatggcaataggaaatatgaccataaaaacctcagtgaaagtaacccacatttagagaaggcttgtattccttaatcccgcccctctacacaccccacccattcaacccatctgtagcctccctttcagctgttcttaaaagaccttcccttttaagggaacttacattttcccttcaatactaaatcccaaaagctaatagcaatacagaagatccactgaccaacatttcttcccaagacaataatagtaacttatatgcataattgttaaagcaattttaagattttgttttgttttttgctatccaagttcctaagacatgttattcctctaaaagtttactatatgaaatgattgactaatggttgaacaaatactataaacacataaggaaggtgatatgggttttactcacagaagattcctcaaaacgcatacctgatttggttttaataaggatcacattacaggagatccaatagaagctacttaaaaagtgttttagaaaatgtttttaaatattaatttgcatccattataacattactatttgaatttaacttccttccaatatacctgtagaatgagctattgagtttaacttctttccaggcatggttatggagcctgctagtgtgtgggtgtcccggggccacaccgtattaaataggctagtgataaaatggataggacaagatttctcatcaggaacatttttaaacacagaatctgttgattctgtgttgggggcagaggctgggagaaatagggagatattagtcaatgcattacttttataagtgggcaacagaacccatgttgtgtggtcaaagtactgcagaacttctcaagcattgtacacgtttcagtttttgactacgactttaatggtccacaagaaaggcctctaagaatctttttcgtgtccatttctataagagagaacataatgctgtgttagacatagttgagatccattataataatgtcactacattttgaaataaaattctgaaatgccttaatacataaatccttttatgaagtctttaaaattggctgctaaaaccaataaaattatatttttggaacatagttaaccactttgtgcacataagtgaggctgtagaaactagggtttttaaatgacttaaaagatatatatttctccaaactataggtaattatatcaatattactttgacagagatatagtaattctccatcttatagtaaaatttatgaaaacattaagtaaaccaacaggtaaatacatttttggtcaaacaaaactttaaaaattatgtttttcttttatttggctcaagctaattctttctgttatttttattattaattgactactcaggtaaaattctatctgaattgaattgacatcattgatcccattgtcagaaaagacagccctctatcccattcaatttattaaactgctaatcttctggacttttcttcaaagcttgtcagttttgatccaaaaaaacttcagatttcattgtgtggacctgttacttcttgtgtgaaaaacagtatggtttcatggaatccactcttggccattgttaatattgtacagataggcacacaagcatttaaatatgctagcaccttattgcaaaaaaaaaaaagttctacttatattcattgcaatttattatagaaaatgttttctgaactgaaaattataaactgttgtcaataattcaggtcccaattctgaagtgtattgagattaccaaactgtgaagcaggaacaatatttattctctacataaagaaagaaaagaactattaaatgaacttgatattataagaagcacttcaggttgtcaaaactcatattatgacatctataatctggcctaaaatcacaagcaaacattccatgatggaatggcagatcatgctagatttgctggttattatcagttttattttacgttacctaagtagaatttaagcctttcagttaaaatatgactcccaagcaaaaggaagaggattaatggattaactattgtttgtgttatcaataatattggcaataactatttgtctatggtgctgtgtcagttacaaggcactctgccatgcattcttccatctgatcctcaccaaagccttggagatgcttcaagccaaaattgttattattctcattttacagatggaggtgaaggaactgatttgaggtcacactgtggtaaatgttcaacactaatctctggtccaggtccagtccagatcttctgatggcaaaccttataatcattccacttcataaatggaacacttaggtccaatcagtcattttctaaatgtgtatttactgttggtcacaagagtttgtgtgacactgtgtggataattaaatgccatccaccatctctactcggaaaaacccaagggtgtgtcagttaatcagtcttaacaggaaagataatgtactattatcattatggcaaaagtacacttgaaaatacaacaaaggatattgaagctattaaaataagcttcttatccttagggaaactatttcaacactagagctatcatcaaaagtccttgagacaagtaacccaggagtggaatggttatgattacactttataagcaaacttaaaaagatatcaggagctgctttactaggcccctgctatgaagtgaaaactggagaaaaatctacagcaaagcattctagcctgaggatgtgtactattttgcaacacagcagactgactacagccaaatattttcattggaaaaatgtaaatgaaaaatgttgctcaattctgctacctgggtagtacataagacatgtaatttaaattctaatcagggataacaaaaatcctatgatacttattttgcaaaggaaaatggcagtcctggcaaggttataagttagaaaattatattttctttgtgtaaatttgttctttagcttcattcagtaatcagaattatttatttccttattcaaattgtaagtgccttctaaacccgagcctactactattatgttgagccatgggaaattgccaatatttgactattttagtccattaaaatgcagtttcatatggtttaaactaatatgtgccaaagcatgaatagaaatacttgcaggaatactgtcctaagtataacctcagatgcacacagtattttagcaaaagtatcaatgggaaatcaggcaagtcctttcactgaaacaatttataagtataataatttattttgtgaaggccttttctttaccaaattagtaatatggtgaatattaaactaaacctgagtcatactacatttgtttttaaattttgtagggaaggggggaatagcaaataatattttatgctagtaatcaggcattatatcagttgttgtaaggaactacatgaaagttggtggtatacaggttaccagtagtaagtttgggaactgtgttgttttggctcacagaatataaagcgtgtatgtatatacctgtgtttccacatagacacactctgttacccttatatgtattgtataatcacatgtgtagatgttcattgtatctggagtgacagttgacaccttttaggggcattttacatgttttaaaacctgacatccacttacagcacttatctactactctcttcaggataaactacctttattgcaagacttttgctaaaaattcttagattatgtcaagggaaaaaaatcctctattgctttttaaagaaaaaattatcagaatgatttaattttgtgttattttttatctccacattagtttgttatttcagtggttatttcagttaaagacatttttctcttccattatttcaatttgttacattgtatccatttatctcatagaaagataaacttttgtgttgaattagctgtggaagaccagctcacacattaatcactactaagcaaatgcgttacaaaaaagagaggacaacaaaaatgagctggaatacagtttcagttcaaccaccaaacgatttgatatcatgaataaatttcttgggtatatgtagccagtaagtagacctcaacatttagctatttttttcaataaataaatattgagcactgtctttatggcaaacactgtcttaggtgcaggggataatggacattatgcttttgggggattagataagagaggaaataagtcagagaaaagatctctagcacagaaaagtctggttacaagattacagagagagagagaaaaaaaaaactgtagtgacttgtctagggaactgtgtggttgccacatagaaaatgtggaagggagtgatgggagacaggctatgttcctagcaattgccttgactcaccataattatttcacctactgaataactgaataaattgagtagagaggctgcttgtaccaaactgtaaaacagtttcaggatgagaaaattacattttaaacatacacttagggaaaacaaaaacaaaaacaaaacacctgccttgcagaaacatgtcatagaaacagattttaggcagaattatttccctgtacaacaattgtgattaagtaaatgttaaaataaaaagaaggatgtttagcagcataaggaatagaaacatttggagttttagctttagcttatacaatgcatcctgttttataattgttttccaacaatgtttacataatgggagggtcactctttaacatgaggggctctgtcactagaattgcagtgtgttagcccctcattttctccagtgtttttgtaaatctttccattgacaatcttttaataatttccaaaacaatcgggggtaatgttcgaattctaagttcttgtcataaatgaatcaatccagttggcaggagatggatgtagtctttttgctggtgttccgtgctaagaaaagcacacacatttttcttgagagtatggctagccgaaaagcatctgagaattgatggaatcctaaggcagacagaaacgccaaaagtcaagtaactggttttgtctccagcacttacagtttgttgtctgggtgccatgacataccctctactagttaattccattaagcaacatgggccatttaaatataggcaaaacaacaacaaaacaaagcaaacaagtaaaaactctgtgaccacagaaagagcctgtaacatagacagaagactacaaatagtgttcttagaagataaatcattaagacagtagcaaaatgagaaggaatagtgtcctgggcaacataaagtgtgtgtacccttctacctgcacaaacactcaactgaaatttgccaaggctcactagtgtctttgaggcaccctagagaggggaggctagaaataaccatcatcctcagctgttccatggtaaggccctacactaggactcagaggagagatagtttggaacattttatccctatcagtggaaaatagcacagttggtgcctaacttcctttcgttgaaaataacacaggtaattttttagccaaatgagatttttatcaaaaaagcaagcaaaggcagaatgtgaaaaggagctgatatcagtaattccaaggatactaaaatttgttttaaataataaagaaatagcatcttcaggccctttagactttggactccaaaattggatgcagatcaaataggatatttatatattaaaaaatcccaagagaacttgtacagcataaggtaaatacaaatcaaggttgaacaggtataaaataattaggtcaagagcaatcagcaaaatatatgcagaaccaaacaatactttgatattctggtctggaaagagaatttggggttattctgaaaaatactgtcactacaactctgtccagaacccacagctgcagaaatgagtaaacaagtcatcttattagaagactgcaaggttaaagaacagctaaagattcaaaactaaatgacattcttgttagttcccattgatacgattataactcacacaattccctaaaggaaaactacaaaaaggatgtttcttgagataggaatacaaataaacttttgcttgtttgtttgttttgttttaaatccagtgataagaatgaatgttttctgtatttgctttttttaaaaaaactctatattttatgtgcagacatttaacataaaatcttttcccaatgtctttcttagatgattaggtagttgaaagacgctactgtttacgaggcattgctaaaagcttttgggttccatgagggagagggccatgacctactcctttgtacatttccccactcctccgtttacatcacataaacatatatgtatggtcttccatgcagtcagccaaatcagacaaatcatgcctaggagttgaaagtgggaactgatttgtctagtttgaatattctgattagtgaactagctagcttagaattttgtggtatttgcatatgtcattcatttatgtactacagctacacctaaatcccagaaaaatcggtaacaaaataacctattattctagatttaaattttaaaatccacataagaatattaataacacaaattatttgtatgacaatgacttctatttttttcatttcaccctcagagatctatatacttcctctatccaaaaacaacacagaagcaaaatgttacagagacaccagaatgttgcccagaaaaccatgcattaattactcaagccaggaaattcccaattttgcaactctattttatcatttaagagagatctttccacatgtgtgttctaaaaaagaacagagaaataaccagtcctctgtaacttagcaaaaatacaaattggtgtttccactttgatttctctttttgaaataaattttcagcttgactttcttttgcctcgggtattctggattatcattttgtagcatctggataattttacattaacatctggagttgagggtctttttatttgtcggatgcatatagaatacttctgtaagaaatgtattttcccagctgctgtttattcattttaaagagacatggttaagtaagtctaacagcctccttaggaaattcaattcctaaattccttaggaaacacaaaccatgtttaatctgaagtcctgccagtctgttttctctcctaccagcttttcccatggcagaaatggttgagatctgtacagaaggaggactttagtctggtaacaggtggtgttgctgagtgcaagggcctttgaaatcaggcctggtttggaatcttggtccagcaatcaatagctgtgtaatcttaggtaactctttgaagtttagtttccgcatctaagaatgaggaagtataaatacatatctgcccacgttggttgtattaaatgagataatttacataacacatccgactaaggtgcagatgtaataaatgacagctgttattatcatttatttcagcacgttgcagaaagcaacttacaatttcttcttttcctgacctcctagggcttttatgcatgcaattagcaatttgggatttgcacaaggtttttccagagtacaagatttttgagagctgtgactgaatcttattctttagaaacttgctctttgagtggaggaaaaggaagaaactaagttgactaatgacattataaaagcaggtagagaatcatttctttctgagcttctgtagcacaggctatgaagtgtgctagtaaagtaaatacaattttaagcaaagtttcagaaatcaccataataaaataaagtctgtaagtcccagctattaaactggcagggacctacattcattaaattaaatgcaatgtgcaatgttgttcgaaagttgttcaaaatgtttttagaatttttcttggagttgattgcttttataatgatgacttcacgtcttgactctcagtgattttgtttgtctccttagccccaaaattattcaccttaaaagatgaaatttggtaatattaagacagtcaaaggaatgtcctgaagttctgatcacagctatgaatagttctaaaatcttctaaatatttttgggatatgtatagaaccaagatgatttgtgtgaagggtttttccattcacttagttgtattatattttaatataattgtttaaaaaagattcatgttatagtcacagattaaaaggcagtttttaaaggagatgaattaacagtttcagagaaacaattttaataacatgcattttatacatttatttattctgaaaacagtaattttcaatatactattttcttataaccactttaaagaaattaaggacttgcaggttgtctggttttttactatttttcttatccatagcaaggttggtgctcaataatactagatgagcaactgaatgaagagatgacaaaaataaatgaatttattaccactgcatgttaaagaagtgtacttttttatgcttgtctttgagaaaagtgtcaaggtggcatacatgacaaaacacaactttaaaatgacaacaaaaaattaaaatttcactgaacaaaataaaataaaagaaaaatgcatactagctgctcatctgggatgagttagttattgcaattcaacttgtaatttaatgcagaattttcagacaattagggccaaaaaagaaaatgttaaattagctagtgtctgacaaagaagaaagctttcaaactttcaagacgaacattttattagcaatgaattctcagagcaaatttaatgcagtccttatgtaaggatgtcagatagaaaaaagtaaaaggatttcaagcatcactagtgcaaaggacaatattacttgcttatttctgcagtgtaacaaagatgaagatattctcttaaattttttactcaatgatgattcatgtgtctctgagaaactaagataatatgatttaattctgtgcttttgggatagtctaacttaattcatgaaggagtacaggggatgggcgctttgtgtgtccactttgtttgtcactctcaaatgtcagatgtgcaggcaaattctcagagttaaattacttgacaggaacttaagcatccgtatttgttgccaggtagtcttctgtgtggttaaagtacagaatgtactcctacaaaagcagagaggcggcccgttgccacacaaaagtgttttttcagatggcttatggttagaaccaatatatttttctagcatacagtttgagtgataatagctcacattccccgatcacatgccttgtgccaagtaccattctaaatgccttgcatcttgtaactcattaaacctttacagtaacctcatgcaatgtacactcttgttgttcccattttgcaaataagaaaactgatgggcaatattaccttgcccaagtttatacagctggtaagtggcagagtcaggatttgaacccaggctgatggtatagtctgcgtgctcagccacaatcatgaacttaccctcaaactgcctgtgtttgcataatcatgtggatactacaggatagattctttagactcatcttatgtaggaggaatagtgacatgaaccatcataagaggagcattaactaaactttgcttgtcttacccatgaaagaacatcagtgtgactccctgccaaatatctgataatgaaaagaaatgcattgtgatcagcaagataaaatgaagaaaataaaaatgtacactgaaatagctgaacgaatgaattaacaacctattttatagcattgtgctggagaagaatgctcatcttacagaggtgattgtgtctaataaaaactgcactggatttgaagtaaaaaataaaaaacaaaaactggatctaatttccaattctatcactcgtagtctctgtaacctcctagtctctttcactgggatcttagatgtgccttcttagaagctaaattttcttatctgtgagttggtttacgattccttcttcctctatccactcactttattgtgatatcaaaataagatagcatatgtgcatatccttggagattttaaagctatctgaaaatgtgccatatttaaacatactgaacatagttaaaagacatgcatctgattaatgtaaaaactataccaatttattgtagtccacttggaaagacaagtagcttacttaaagatctattttgttgcatttaaagttggaaatgaacctgatataaatctcttcccaactactgtgatcctgtctttaatacaactttaatagactggaacatatgccaagagtatacagtcagaatctctctaagaatcaaagactgatgagaaacctctgaaagctgtgaaaagtgtgttattgtttttaattgcttccctaaagaatgagagaaggcaaagctgggaccctagtggtattgatgggctgttgctccttatccatgatgtgtaagagtgaggaactaagtctgaaaactttttaaggggaaaatagcagtatagcatactgaaagttttgttgtaatatttaaaaatgccaattaaaaaatagtgcaaaattgtataacgcaattatatgagaattgttttgggatcagcggtccaaagacaaagaaagtcccctcttctctccatgttcttttcactgctagcagcaattaacatttggcatatatcctcctagatttcattttttatgcataagtgaagacatatcaataaaatgtgttcttgttatattacatagttcttgttttaacacaagtggaattatcctctacatggtgtttatgatttgtttttgcacttatgaggttgtgtttaaaatgttgtacatttttttaattttagcattggtaaatttactttgtttttattttaacatagtattccactgaaatgtaattatactgcaaattatttatcatatctccactgacggtccttcaggttatttctaacttttcttgattataagcaatgttgtaatgactatcttgtacaagtatgtttatactcttccattaatacttatgtaaataaatctgataagggaaattgtaggctaaagcatatattatacattttattttattttttattaattaattaattaattatttatttatttttgagacggagtctcgatctgtcgcccaggctggactgcagtggctcgatcttggctcactgcaagctccgcctcccgggttcacgccattctcctgcctcagcctcctgagtagctggaactacaggcgcccgccaccacgcctggctaatttttttgtatttttagtacagacggggtttcaccgtgttagccaggatggtctcgatcttctgacctcgtgatctgcccacctcggcctcttaaagtgctgagattacaggcgtgagccactgctcccggcccacattttatttttgatatgcactggcacaaaattgtgtgaagaaccaattaataaatatgtctaaggaatatagtttccattgttttaattatcaaaaaattatcacttacatgggctctagttatacccatgatatgaccaatttaagaaacttgaaaatataatttctagcacgtgtatactaatgcgagatagagaagttttatttacaaccagaaattgttgggtccataaaagaaacaaatatgtctagaacattttaaagttgccagagcagatttcaagatattccagcctgagtccctcagatatgtattttggtgattgtaaaaatatcaaaagaaattatttgtgtccgaaagtcacaatatgcgtgagtcatcaacacaataagataaggctaaaattgagtttcagatattttgggatttctgaaaaaaatttataaaaatccataatgtaatcatttgtaaaattttaaagtttatcattacgaaaaggaaagtcaaaatcaaatgaaataaaacaagctttgttccatgggatagtgtcagtcataaagacttactagttaggtgctaattcattttgagcttacagggttttatcaggatcagactaagtaaaaatgtataattattttataaataaaaatgttttggggtttcagatttaaaaatcaagagtaagaagttttacaatatttactaaagattacgattagtataccacaaaacatctgaactttagatattatttatatgaccttaaaagtcagacctttccctgccaatgacttaacttctgtctttagtgctattttgtttgaaggcttatttatctgctatgaagtgatttttctacgactttctacatgtctcttcacattgggttaggaaatcttcaaggaaattaatatcctcgggtatacacaaccttttgctgtggtatttgctctgacatggaacaaaggcaaaagatacgggaaaatgtagaagtgggcattatagaagaatccaaatgtgtctaatgtcttcttcatactaattccttctagcctttatttaaaaaatagcttctgaattgcaaggatatttttaagccacatgaatcagtatgccccttcagctggacttttcaaggagcctgtgaatgctgaaatgattaacattatgtgaagctaaattgcactgaaccgtggaaccatgtggtgtggcaatagtgggtggggagacatattagtctagaggtccctgctgagcaaaagacaaagacctccttctccattgtcccgcactgatggtgggcttgggatgtattttcagaaataattatttgcagggaacttataaaaacaaatgaatcaccctcatcactgtgcttgttccgttttgggatgtttgtctactagactttctaaattgggagatttagaaattcagtaagaaagatatttaaaaaaattttttgaggtcctcagtgtcttctgcaagtacactttcaatttttattacagacagactctcttgatgctgttgtttaccattgcatttttatttaacttgaatattttaatttagcatgagtcattcccatggattagcaactttgtatgctagcatatctagttgtatcttctgtgtgttttcaatggtgtgtctgctactccaaagatcttcctgaattttacatattagaagtggcatagcctcatgacactttatatcaagcaggaagttctggaagatgatgctaacaaatacctcaaatctggaaattgtaggctttagaaaaataaagtcatcttgttagtgaatctctatattagactttctaataccttataaacaggttttcagaaattaattatatttatagcctcgagaaactagggaaaaagctggatctcaaagacattattacaaagcagtagtaaattataaacaatatattttgaattcataattaaaattaacgagtcaattttctgaggcattgacctattaaagatttatgagttacctaaaatcccaaatcttccctgaggtaatagcttcagttgagataaagggaaggtatcttatttgtcgcttcactgcaggaaaaaataaaatttgtgattatgactcattatcatgatgcctattgcaaaattacagctcactcttaaaattatgtgaaaaaagatcattaaatgttttagacatttcttaaaacttataagcaaaactttcaagttttttaaactgatttactggttgtatatgtagctaattgactatgaaaacttgaagcttaactctttgtagaccttccatcataccattgctttataaattattaccagaatattgaaggaaataaacttttttctaaccatatttatgcaatcaatatttattaggtagtttttgagaaaatcttatatgagaacttattccttgtataccaaatgtttcatggaacaccaccagcatagacatttttgtttactctgtgcaactggatttcgttctggggagcttcaatttgtacatgagctcattttcacaaaccatcttaccgatacttagagtccaaagtgaaattcaggaactatggcccagcaagctttcatgtgctattctttgcttcatgactttggaaatctatgggagaccctgtatcactagacagaatactgaaaagcaggattacatatgaagtttaccatctgatttttttcctaagggtttttacatgaacgtttattccttgtctttttgtgtggattcagcaatctccaggtttactgaacaggggttgtgaagggcagttgttcacaactgagctcattcccactgtgttgatatactccggttcccccacatagctccaccccgctaactcccaacctcatgcatagctccaccacactattgggcttgaatctaggctctgccactttctagctggttcctgagcaagttctttaacctctctgagcctgtttcctcatccacaaaaaggatgaagaacaaaaaggacgaggcaataccttcttaacactgataattaaataagataagcttaaattataaaatcagcacagagggaatgtaaattggttcaaccattatggaaggaaaaaagtaggaaggttcctcaaaaaattcaaaatgggactgcgaggccgggtgtggtggctcaagcctgtaatctcagcactttgggaggctgaggcaggcagagcattttgaggtcaggagttcgagagcagcctggccaacatggtgaaaccctgtctctactaaaaaacatccaaaaattagccaggcatagtggtgcacgtctgtaatcccagctacttgggaggctgaggcagaagaattgtgtgaaccgggcaggcagaggttgcagtgaactgagatggtgccactgcacttcagcctgagcgatagagtaagactctgtctcaaaaaaaaaaaaaaaggaactaccatatgatccagccttctcacacatatatatatgtgtgtgagatatatatatatatatattcaaagcaattgaaatcaggatctcaaagagatatctgcatttccgtattcattttagcattattcacaatagtcaagatatggaagcaacctaaatatctgttgacagatgaataaataaggaaaatgtggtatatacatacaataggatattacttagccttagaaaaagaaggaaatcctgccatttcaggcaatgtggacaacatgaaggacattatgttaagtgaagtaagccaggagtggaaggacaaatattacatgatatcatttatataaggaaactaaaatagtcaaaactcagaaacatgagagtagaatggtagttaccagggtctgggttggagggggaaacaggaaagtattagtgaaaggataaaaagttttatttatacaagatgaattaagtcctcgagatctactgtaccgcatagtgcctagacttaacattactgtatcgtatgcttgaaattttcctaacaaagtcaatcttacaaatgttcttatcacaaaataataataataaagagagtgagagaaaacttttggaggttattgatatatatgtggcagagacggtggtgatggtttcgctggtgcatacttatctccaaactcattaggttgtatacatcaaatacgtaaggctttttgtatgtcaatcaacctcaacatgttttttttaaagcagtatagaaatacctattttttaaaattattacaactgaaagccttctaacttgtggtgttttcttgaaataataatcgtatcttggttaatagttgagatctaaaagcttaggcctaaattcagatagaaagcttggcacatctgttgtaagttttgaaaccaggtgcacagaccatctttgttccagacgatcttctcagggatgtttgtaaagtgaacagccttggaaggtagagatgatgtccccctgggaagcaaagggtaggtttactcatagcttgggaagagagagatggtgtctccctccagatgaggggaatatatttaccacccataagaaaagatttgaacccattaagctgagggttcctcttctgtaacaccacccactgtgagtggaggcatcagctggcctgctttctatctctctgcaggaagtagagcccaggcaactggcaccaaatatgccaaagcttatgctgcttcctgggctgtgagtaataaagtcccttttccctcttttagaagtctcatatgttctgtcagcagccaccaagctgtgtcaggctaaattgctgtcttgcaagtagaataaaatcccagaccctttgcaatctttttcataaaaaaaattttaaataccatatatttaccgcatacagttcagaattatttattaatagtatattcacagagttgtgcaaccaccaccacaatccaattttagatcatttcaacaactcaaaaagaaaccttgtacacgttaagtgtcattcctgtacccactccctgaaaatctgcttgctctagctgtgttggattgatgtcagaacacaggagggaagggcaaatgcaagggagcaggtaagaggctttcacagcaactcgggacaaatgatagtggcttggagcagggtagcagcatgaaagtagtgagaagtggcggaatagaagatacattttcaaagtggaaccaatagtatttcctgaccaattggctctgccaagaggatgtgctgatcaattttccgtgaggtgtgagaatgagatggctgagggatgagtccatggttttggcatgagcaaagggaaggattgagttgctttgaaatgagttggggaagactgtgggcatagcaggttttgacagagaagaataggagttcagcattgcatatgttaactgaaaatgtctattagacattttggtgaagctgaatagatagtgtatagtattctggaattcagatgagaaatgctgcttaaagatacgaattagagaatttaaaatcatgagactgcataatatcacccaggaagtacaagaagacctagaaaagtaacagtctgagaactgagctctaaggaacatctacctttagaggtcagagagatgaagtagagcttgtaaaaccaaggagcaagcacacacagttttggacacagagatttcccataagagcattgcaaacgttacatattctctttgttggatgtgaaaataatcttttgggaaatgtgtgcttagaccttgatgtgatgcatagggacaaatttctaattctatttgcttcctaagaaaatgaaatgttactaaataaacagcgtcagggcaaggagtccaggtccataaagaaaaacttgcacagcatggtgaataaaattaataatggtgtattgcagattttaaaattgctaaaagagtaaatttcaaatgctctcatcataaaaaatattagtatttgagggaatgggtatgttactagcttaattgaattattccacattgcattcatatattataacatcactttgtaccccataaatttacataattagaaattgtcaatttacaataaaaaataaaaagccatcaaaaaacgccaggcaaaaatatgtgatatacttatacccatatttaaacctacaccataaattatatttaaatttataattctgcctgctgctgttttcagtaattaatatcattaagaaagcacaggttaaatcaaatttcaacacagtatcatttcagtataaaatctcatattttgaataaaacaaacatatctttacacattattaaatgaactacgctgacaaattttgtttctttttttgagaaccagaaaaacaattatacttagatgggccatctaaaatgtccttccagcttgtggagtaggttgtgtttgtttttcaatgaacatctgtttgacaaattgaaatgctaattatgatttatcatttccatgacatcaaatatccagatagtaataaacgttgatgactaactatatttttcagtttcagccagatgtttggcatcacgtaagataccaccttagttttacataaaaataaaatgtttcttgagtctggcttatcataatggggaggaaactaatatgaatgaagcagaatggttcattttttttctcaatgtgtacaattctactggtaagacttttacaatatcataaataaaattgtactttaaaataagtgtctttcaaacttttacaaatacaaagaaagccagaatcaaaacccaattttgaatatcaagtgttaaatatgaatatcagaaactgaatatatcatcaatacaaattttaaaaaaaataagtttgtaaattcagagtttatccctcagatgttatttcaagcatatatcatagtgacatatccttgaatatatatttaagatccgatagggactgggcacagttgctcacaccagcattttgggaggctgaggcagatggattgcttgagctcaggagtttgagaccagaatgggcaacatggtgaaacgccaccagaaaaaatgcaaaattagcaaagtgcggtggtgtgcacctgtagtcccagcgacttcggaggttgagctgggaggattgcttgagcctggtaggcagaggttgcagtaagctgagactgtgctactgcacttcagcctggatgacacaggcagaccctgtctcaaaagaaaaaaagaaaaatctgatatgataatttagaatatgggtcctcagggccataaaacagcatatgctagtttgttggcttttactcaccatgctgtgcactaaaagtaaaaaaatataaagtaaagcccattcttttaactgagattttgtgccctttgacataatctctccattcccacagccctcagcctctgtaacttctatttcactcactccttctaagaatttgattgttttacatttcacatgcaagggagaacatgtaatctttccaaatgacagaattttcttttttaaagctaaatagtatttcatcgtgtatgtgtacgacgttttctttatccattcatctgttgatggacaggttgatttcaaaatgtggctaatgtgaagtgctgcagtgaacatgggagtgcagatatcttttcggcaaaactgatttcacatcttttgggtaaatacctggaagtgagattgctagatcgcatcgtgattctacttttagttgttttggaaaactccatgtagttttccataatggctgtactaatttacattcccaccaacagtgtacaaggattctgttttttccatattctcgccaacatttgttatcttctttttgatattacctattctgacaggtgtgagatgatatctcattgtaattttaatttgcatttccctaatgattagtgattttttcatttatctcttggccatttgttagtcttcttttgagcaatgtctattcagcttccttgctcatttttaatttttttttcttcctcttaagttgatggaactctttatatatttgtggatattaactttttattgaatatatggcttacaaatattttctccacattcatagtttgtctcttcacattgttgcttcctttgttgtgcagaagctttttagtttgatatgacccaatttgtttgtttttacttttgtggcctatactttgggggtcaaattcaaaacattattacccagatcaatgtcatatactttctcccctgtgttttcttctagcaatttggagttgctggccttatacttaaggctttaattcatttcgaattgagttttgtatatgatgtgaaataaggggccaattttattcttctgcatgtggatacctagtttccccaacaccattcattgaacagactatccttttctcattgtgtattcttagcatctttgtcaaaaataaattggttgtacatgcataagttgatttctgggctattatgctgcattgacctatatttcttttttgccagtaccatgctattttaattaatactacaatagctttgtagtattgtttgaagtcaagtagtgtgatatctttatttttgttttgtttgctcatgatgattttgactgttcttggtttgttgtggttccgtgcgattttaaaattgttttttctatatctgaaaaatgacatcaaaatcttgatagtggttgcactgaaatctgtagattgctttgggtattatgaacattttaacaatattaaattcttccaatccatgaacacaggatatctttccatttattcatgccttcttcaatttctttcatcaacattttacagtttgcagtgtatgcagatcttttcaactccttggttaaatttattcctaagcatttaatcttttttatagctattgtaaatgggattttttaactccaagtatatttcatagatggcattgatacagtaaaatcctttattctgtaaatggcatttatatagtaaaatcttttccatggtgaatgattattagtcttaagtgaaatacaaagatttgattttataagtgaaatatttcttaagtaaactatccttggctgccagtttctttcttaaaagtttaatatttcccagcaacttcctgtggttgactcttaaggatactgaagctgaaaggagcccagcaattctgggtgatggaggaaatacgtggccaggctctgctgtccgtatcttcctcaattttcaacttgaattttatacttctactctgacctttaatttttgtgatctaatttccttttccccaataatatttgtttttgaactagtcttcctcatgccatttaaagaaaaatttcaggaataaggaaaaacacaggagtattaaaatggagaaacatcaatattgttataaacagagcaccccaaaataattattttgaaagagatgcactcatttgaatttataaactctggaatgcttattttaaaattaactaatgtgttaacctacatacaaatttgtatttttacttgaaggaaaagcagcattgctggtagtgcacatgtgcttctgtacatacagattgtacacattgaggatgatgtttatgccataagagaatcatttcctctctttttatcagggccattacatcatttctcaaatagaccactgttaggaagtagggatatataagtataagggaggagactcaagtaaaaccagagtggtgcatatcctacaaattgagaataaggcatattttatcttttaaaataacatattttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccaggcgtagtggcgggcgcctgtagtcccagctacttgggaggctgaggcaggagaatggcgtgaacccgggaggcggagcttgcagtgagccgagatcccgccactgcactccagcctgggcgacagagcgagattccgtctcaaaaaaaaaaaaaaaaaaaataacatattttagagactcagtaaaataattttaaaggggcagaagtacagatgtagctgttaggaggaagcattatttcagctacagcacattattggaggataggaagagcatatggtattccagtgaaagagcttaattataatagagcagaaaggattagaaacagaaaagaaggtggattatcaggaataaagtcaaagaagggactgaatattgatcagattttcagaaaaacctgcaaacaaaccccaccacatactagcactagtcataggactgagatttgtcaaagctagctctcttctggtgcactctggttcactgtgaatataagtgggccatagagtgtgaccattgtggtctctggccctaggccatggagtgagataattgagacaagagaagtctgtatatcatctctccacataagcaatagagctgattgggctgcctgtaaacaagattttagagactcacttttctttttcttaaaagactgccacacttagccatctgatatggaatggcatctcctcttaatgagcctgtgtctttatttgcaccttatcaaactgggagatactgaagatggcagtgatgctgatagtggtgagacatggaagatgtagaggaaacctacaaagaagcctgagataggagagaaagggtaatttttagaagtagattgggagaactgcattctgggcaataaatattcactggacttacagcgtattcctttttttaaggaaccaagttcacagttgttagaactacaagagcacaacattacataatcatgacatcaaataagcataaaaataatgcttatttttaatttttacaggtgccattttataaactatctctataaagagattaatgttagcttcttgttttggaaataagataatgggagggaaggataaatgaaacagttttgttgccatctctcattgtgagccagtttagaaatgaaaacaaacaaacaaaacaactcttaagcccaacagcaacattcattataattttcctaattacactcccttttctttttgctaagaaagaacggttgtatttttgtccttaatagaaaagggaacagtgcctaaacaacctattataaattcttctgggaaagcatattacaaataattgaaaacaaccctgattctgtgaacttggcagcaaatgtataaaagaaagcaattcagccctggcccctggatgattgattaaatgttttattctttttacctttcattcatgctgtgtttgtcaagaggaaagagaaaaggaatgttgtgaaatgaagtccactttagacaaataacttacaataatgatcagtgacttctcatcagctgtttattcatttttcttgagttgtaatatttcttaatattagctatcctgcatggacccgacagaaaataaggtcctgagttttagcttgtccccaactccctgccagctaaccatcaacacaagctgtatctgagcttctttgagggcatggccctgcagctccctgtggtcagttattagtctgagtccagcaaaggaacaagaacactgtgtgcttgctaaatctacagaaaacttcatcttctggttgtgtgggaggagaggtccctttgtgtactctgtttctttgaaggaactagggatctgttggtgctgtacagatgtcgaggtgcacagagccaacatcctacaaaactagtaaatagatgattaggatccaactctgtacagaataatggtaggaacctaaaccttggggtactgtttacttgtatcaaaattgttgttgtcctataagccatgtaaaattaactacaaatctcctcaatgaaacactttcttagaactttgatatttttaaatgatatctcaccatctgtgtacatcacaatgttgagctacaaatgtggtggctctaacaaaattttaagtatgaagtcagatgtatagaggatcccttctccatcacgttcttctgtttttcatttcccgcttctcacaaactactccccagatgtcaataattctacaatctcctcttcctacaaccttcgtgttggtccttagtcgtctactctgatctcaaccgcaaaagtcaggggatgagactataggccatccccagagcaacagcctcagcacctcagcacagatctggaggggatttgagctagaaagaactctgaccttactcttttttttttttttttgagacagagtctcgctctgtcacccaggctggagtgcagtggcacaatctcggctcactgcaagctccacctcccgggttcatgccattctcccacctcagcctcctgagtagctaggactacaggcgcccgccaccacgcctggctaattttttgtatttttagtagagacggggtttcactgtgttagccaggatggtctcgatctcctgacctcgtgatcggcccgcctcggcctcccaaagtgctgggattacaggcgtgagccaccgcaccagcctctgaccttactcttaattgcttgcatgaaaattggatatggataagaatgcaaacccaagaacatgtcctgctttccttgatgcacattctcctattgatgttcagtgaccttagcatttccagaagcacctctttattgtggatggaaacttacttattcatgttgtctcaggctgtccaggttggtaacaggtaactgctataaagggtggagcacatcctgctaaatggagagatccagtgtcatttacattttttttaactctttcaagggtaatggcaactaacaatagtttctcctgtgtgctagatattgttctaatcattttacataaattatttcttttaatccaccaaacagcactataagatagatattatttttatttacctttgttagagaaaactgaggtatagagagattaagtaaattgtctaaattcacacagatagtaagtggaggagccagaatttgaacacaagcaatttgtctccaacaaatttgatcttaaactatggttaactctctgaacacacacacaaacacacatacgtacatgcaatcacacaaagtatcaggcacatggggatagacaatattagaaaagcatatacatacaaacatccttacagttgtacacatagactcaggtttataaacccactgaagtgaagactcatcatttatgaaaatatacaattttgttctgcaaaataatttaattttttaaaattccttgtgcaatgagaaaagatcagagaggcctacagtttccttttacagagctaggccaggggctgtatttagagtaattgaacacatgattttacttgaatgcggagaaacttgaccaactgtgaatatgcaatttcactctacagatgaaataaaattaaacggggcaaaagtaaagaagaatggagactaggtaaagtgatggaaagagacaccaaaaaattagtcatgtgaaagcaaaactaagaggagagggaaaggtggcaaaagaagggaacattcagagaatgttgatatattgagaggtgagaatagggagttggtaggcaagtgtcagagtgtgggaggatggtgacagtcactaggaactccagtttgcatacacacaatgttaagaacattagaaattagctagccaatggaatgctcagtcttgaagagcttgtgtctctgcttaaactcctgtatgcattagtatgattccataaatttaaagtctctgacatcttgagttttaagctttctgaacattaaatcagtggaggctgctagtagctatcctgaaatgctgcttctatacatatgagtaaaaatccaaattaatgtatttatacagcttttcatttgtgtactcgtaaaatacacacacacacagagacaattcaacacacacacacacacgcgcacacacaattcaacttttctctgaagaacctttgagtcagagaatgagaatgaaggagactgaatttctcttttaagttcctgtctaggttttgttccaatctaatgacacaggatctggcactgtatttagacctcctgctccaagattttatttttattttaaacaagtgttcccacacggggactgaaaacaaaacaggaaaatgttgcttaagttttcctttgagctgctgttatctgactttcaagtgtactgattgttccgtctcaccaatgtaggtcattgtactctcagttactttgttttctatcggaactttctctagcagctctccacattaagggagatcatgttatttcacatatttatttttgttattaacatattttcttcatctccctataatttgaggttttagcactttcttctttgtagaatttaccataaagcatacgtatttttgaaaactagggaatagcttttacttactaaagtacttaagtactaaacctatcataaccaatttcatttattaagatgttagtaagactttaggagttgttggttcttttccggagaataatgctttagcccagcagtccccaacctttttggtaccagggattggttttgtggaagacagtttttccatggaattgacaggggggatggggagtggggatgggtttccagatgaaactgttttacctcatatcatcaagcattagttagagtctcataaggagcctgcaagctaggtccctcacatgcacagtttacaatagggcttgtgctcctttgagaacctaatgccacagctgctgatctgacaggaggtggagctcagacacctccttctgtgcagcctggttcctaacaggccacagatagtactggtccatggcccagcagttggggacccctgctttagccctcaactcttaggcatgtttcagttctgattttggtcagcatagagctttccttctatttaccaggagggtctctactgatatggatcaatggcaggaggtgatattgggtctggaactatcctttggcttagtgacatttgtactctaatctgcctcactcctgccccttctcaggggacctgggcaccgtcggatcccatgacaggtcctacatggtgacctagggcacggtaaaaagtctaccccaggaagcctagaatggatagaatacaaattcatccaacacaaattcatgaagaaaagccaagatctgcagaaaatcaaacagtaaagactattccagaagagcaacaggaggacgataaagaggagatggagttaaaatactgggtctgtcatagacaggattggaatggaatcccaaatcagatgatagaatgaagggaaggtacatggaatagactctcactagtggtgagctttcggtcactacaagtcttcaaaaggggcctagatgaccagttctttttcatccaacaaatgcttattgaacccttcctctgtgggtagtgatgggcacattcagtgaattcagactggaatcgaacacattgtaaccattaaatgagttaatcttatatgagttcatacatacagatcacatgcaagagtgtctcatatccagtaagtttgcaagaataactactattgtttttgtgtacaagatcttgtgtattgtaatttctgaaatagcaatgaggttggaatacatgactaatgattttatcctcttatgatatctctggttggggcacacccaaaacaaaatttggagcaatgcaaatgttcgaggagagtgagagaacttccttctggtgtttttctctaatgacttgctctgaagctactcctcttagattctttcctagctgtgtattcctatatagtcttagcttaacagcacaaagatttaacagtggtgtctgcatttgataaaatgtaaatgagaagctcccaaaagagattgagaagctctattttgacaactcttcttttatctgtgtaattattatatactttaactgaagaaagaaaaacacaaagataaatacaatatttcaacttcgagtactttttaaaaattatttgaaagcatttaaaaatagatgtaaaatgaactcctgtatgtcaaattcctttcagagaaaaaaaaaagtgagagggaagggggaaatttgcatttagtaattttttttgtttttttgaaaatttcaggcacttagtaatcactgttccttttgtacgtcatgcccaatgggaacgataccaggatctttcactcaattctgtggattacaggtcacccacctgggcatgtttcagatgaaactaacctaagctcatcttgagtaaggggcttagaagtaaatgctttgttggttgctttgagttgtacaaagcaggacgaccaccagaggctttctaagaaaaagaatcatagagactttgataaaattggaactcctaaagcagctaaggctttgcttctatttttgatcatttttaaaaagttagttcttctggtgtttggtagttccatagtagttagaaagcactgccacatgaaatctgctattggtagaaaaagaaaatgttacagccaactctgatacaacatgagagagagacagagagagagagagaagggagagaagagacatgttcttctttgaccagcaggaaaaaaaaaaaagctgcacaaaccttttaactagtttcactagcagaaaagaaaaataaaaatataaaatagcaaataatctttaaagaaaactgattttcttattatgctgaaatttattaaagactgttgtgttgactgaagaatatgtttaaatattttgtggaaggcaaagctttcattcaggaatgacaagtgcaaggactgtaattctaaagaaattaaagaaaagaagaatggcaatttaagttcagggacaattggaatcaagcagtaatgatttacagctttttaaaattttcaggcacttagtggtcagtgttccttttatgcgttatgaccagtgggaaggataccaggatcttccattcagttattatgggttacaggtcacccatccgtgacctgtggtcacagtgttaggtatcgaaagcataataccttcttatctaagaaggaaagacctgttaagtctaagcttaggggtagagttgtcaacgatacagtcatatttgttgaacagttcaagttgccatttcttgtattcttggaagaggtaagttaaagaaggttgtgcacagttcttgacattttattattacagcactacctttcaagccactcagtagtcatcggacatgtaagagtggttgttctatttggtcgtgtaaatttctagtgacagtaggaaaaaaaaaaaagacctttattaaagaccttccaaactaattcagtgccctacatgctgcatgaaaatgaggactttccagttctgagtagaaggaatattaaggcacctgaagggacaaatccatttataaaattatttttctttttgtgataaaaatataaatggctctgctagtatactaaaaaatataaatggctctactagtatatttaataatccttcattgatttacctaaacgtatgaagatacccatataatatttttaaaaataagttattgtagctctaaaataatttattagactagaataaataaatttatactagaatttatgatgaacagtcaataaatggaattaaaaatataggtaaaatacagttaaaatatatacaaattttaagtgatacatgcaatgcacaaattgtaaatgtttgattgaggaaagagctaattcattggaagctctagtccagtctatagtatttggggactgctattgatatgttcattcaacaaataattactgataatatagtatgtactgaaatcattatgctaaacactgagggtttacaataaataagaaaatgtataacctcattgaacttaaatctagtagcagacacaagcaagtaaattggcaataaaaatagggggagtcaagggagtttggataaattatagaagaagctcctagacagtccatggaggtatttgtgggaggatggaattggcaacacagctgagattttaaagatatataaagtacatctgtgtaaatggcaagcagtgagaacacagaaaaggtgtttgaggaaagggcctaaagataagatagaccatgacacagaaaggaaagtaaaaatgattcagtgaccatctagtagatatccaatacatatatttgagtgaatgagtgatagactgactatatgaatgggaaatattgaaatataaagaggaaggccagagataaagctctgaaaggtaagcatatattttaagacttcagagtacctaattttctgaatatgcaaatgagcagtattagaattaataaaaataaccctaaaaatgagaactcttggttggagaaaataacaaaatatgaagtaaaggaaaattgacagaatacttcaaaaactgtgcctgatataattggaaataatgcctggaaacagattgagtccataatcctgtatgtgttcattaaggccaggaagattcttggtaaggaaatgtctagtctgaaaggtctaaagattttattaatctgtataataaattatatcttatgaaactcttgtcatttatccagtatatttgaattacccgtgcattactgtttcatatattcatggtactttcatattttataacatttaaaaatatttcaatattccattgatttgaataagattctttaaattacagtgaaagctttctgataaggtatggtaagattatttttcagtaattatgctgatacatataataaagctactgacaattcataaagatgataatacacttagtacaaactgagcttcaatgggattactaaatgagtatgtgaggacagagcagaggaaaaggccaagggttgagcactgtggtgctctattatgagaaagttaggaaggattaaagttggcactgaaggggattgagaaggagtagctgaagcggtagaaggaaaacaagaacagtgtgtcctggaagtcagtggagtaatcacttgtctcaaatgctgctaataggtcaaatatggtgagaactgagaactggacatttcatttagtaatgtgaaggacgttggtgactttcccaagagcagtttcagtggaatggaggaagaccaatggaataataggagcattgtggaggaataaaccaaaatgtacctatttaccatccagagccagactcagagcctttactctgtgctagaaacacaatgaccaattgttgcattgttccctttccttgagctttctacagctcacctcgcttcttcaaacatgtacaatcagacctctgaatctgtggattccacatccatggattcaactgactgcagaagaaaaatgttagaaaaaaatctgcatctgtaccgaacatgtgcagacttttttcttgtcattattccctaaataatatggtataacaactatttacatagcctttacattgtattgggtatttaaagtaatgtagatgtgatttaaataattttgaaatatgtgtataggttatatgcacatactatgccatttcatttcaaggacttgagcatcctcagattttgatatccacaggaggtcctggaaccaatccccacaaatcccctgaaactataactgatgaggggtgatggtacttctttttttacacagtcaaaataaaagagattaggcttgtttttgttatttctccccaaataatgccatattgagcatgactggatttaagaggtccccagatgtctcagccactcatttacataaaaattctttgtccatatctgtacatccttaatctcaagctacacatatggatttactgttctgtctcctggtgtcagcttactttcaatttgttttacctgtttcattggcacacttgtagagattgataatacaaaaatgttttaggagagagcataccacacatcaagttgtcaacttcatccacttctgctacttatttcaaagtttctgatacttattcatgatctttcagtagccttcattctcccatccatccattcactcaagaaacttgtattgttagggaatgtattagaattatagctcttcaagctttccaaaacaaatgtagcaacataaatagacaagcataataatggaaaatcgtctatacgagaaatctaattattttaggcacaaatcattttttaaaatgtattctaaaataaaaatgccattgaggcacagaggtcttactaatctgtaaagcaaacatgatttatatagtatgcttacattagtaaatcaggattatttgggtgaacagagtataatattgatatagttatttggttataaaaagagatgtttctgataaggtttccccccctttatttgccttggaaaacaaatttcaaagaagagtgtcattttaaactctaaaaaaccagttgataaccatagtctgatatttgcagttggaatgaattcctgtgacagcatgaacatacacccaccaacatgtctgtaatagaaaccactttggaagacactagaggctgccacagatttctcaggtcctcacagcaagacagtggtggtcttggggatggatacatttcatcttccttgaagacagataccaccctctggctgtcaccccataggaaatcaggaagtatgctaagctatccagtggacttggaattacactgtgctgtgctagtggaaatatcctatccaacattatgatttattttgaaggagaaaggaaaaaaaaatacacacaaaacggtggaaggaagctgcacacaacatcgccaaacagctggcttgttttatatcccagaaacagcttgggactaactatattcacaagatctcttggcagagtagcttgatgaaaataccaaagctgtgagaagtgttcttttgctgaatccttcatgtagctatcacacggtttattaacctaaatgagaatatgtacaccttttttccaaaaaggtcctttgtatgtttaagtgagaaacttactgattcttcatacggcacaaacatgattcaccacagcattcacaccaaataaactctaataatgttcagaaactataatcctagacatgtagcgatttcctcctttctttcaagtagtatttttggggacagtcaagagagaatttgatagaaatgtaagcctgagttcaatggcactggtgacttttttaggtgccaaggttaatctcagagggaaattagttttaatggcttcatccatatatttatccattcttttaacatttaactctaacctccttaagccaaaaatataactcaattctaaacacatttctggctcacctgctaggtgccagaaatgcggatcttgaggaatatacaagatctgcttcactcttttagaatccctgcattagagaggattcagtattttcagattcatattttagaagacattgcattctattccttactaagcatcccaggtagattcaattaggtggaacatattcatatttttatcatgaggcattttgagtctattctttgtgacaccagaattagtttctcatctcagagtttgctgtatttctctggtgactcaagtagtttattggcagtcagtttgtaaaaggctccctgggattatctaaatgcaggacgttaggaatggaaatatgtatcattgcctctcctgtcaaaaaatgtaattaacacacatgatatatcatcttacaaagtggatgaaaattccagtgggtgaccttgagtcacagctcctcagtgcacacactgtcctgtacccaagcatctcccagatagcacagaactcccacttcctgcatccctgtacctttagcactgtgtgcatgtttgtgtgtgtatgtgtgtgtgagtgtgagtgtgtatgtgtattttcagttcaaaatctaccactcaatttcactttctttaacaattttggtttggttcaatttgttgcataggtaataataatccatttacagaatacaaaaatagtgtaagtatgtgcttcttcctatctgtatgttgagagattcctcattcttttttatggttgcagataattcattatgcagatatacaatttatttaaccagtcccatattgatggatattaggttatttccagtcctttgatgtgaccaaaaaagattataataaaaaatgctgaaagaataatattgtctttgtcagtttgggcggccataagaaagttccatagactaggtgggttgtaaacaagagaaatttatttccccacagtactggaggctgaaaatctgagatcagggtgtccgcatggttatgctttggtgaggactgtttcggggcttgcagactgctgacttcttgtagcctcacatggttgaaagagagctagctagctctctggcctctttttattaggtcactaatctcattcaggagggctccaccctcaggatctaattacctaccaaacgccttgcccccaaatatcatcacatttgggattagggtttcaacatatgaattttagtaggggggaggcaaacattcagtccattagccatattcagttcacctgtaatatagtatctgtattattttatgtctgtagaataattcctagaagtggaattgctagctcagaattactgtgtgtttctaattttgatagttactgctcaattgactttcttgaaatttgtatcattttacagttatacctgtaaatgtaagaggtatgtatctactctcttagtctaaccatcagagagtattaccaatatttgtggggtttgccaacctgaaaaaatgggaagtttatcagtgtgtttttaattaacatttatcctattatgagggaggatcagtatcttataaacttttaacagtcattttaattttcttttctttgaatagggccctcatatatttgtgcattttgttatggtgttggtgcatttctttattgatttacaagagttctttgagtattaggaacatccttcctttatccgtgccaacagtaccttttattttgtcacacagtttattcttcatcagaattctttgctcttgagaagtccctgtgagagcctgccagccttctacacctttggagggcagtttgttggcaatttctcaatttttctttcacatagaaaatgatctgactgaattttatttctcttgatgtcaactgtgctgaattattgtcttaaaaaattcaccattccattcaggtttaacatattttttagagtgtgattttcatagggtatgttacattcttgatgaatttttatcttcttgacctattaattactaaaaaaaaaaatacagataacgacaacctaaaacaacctattgaaatatctcactgtgatgatagatttgtctagttttccttgtaatttttgttctccatattttaaggctatataatgtgatgttttcaagtacagaattattttaagttcctaatgggttccttttttaatctgatattttataactttttccccaagttttctggtttcccaccataccccagattcttaagtaatttagggcacaataattttcagagaaagaatgattaagaatttatggaaatcttaggaaggtcgaattgacgcagtgccttggaagagagaaatataggtagttgaagtataaggagaaatgcctatgatataaacaaacaaattgcatgtacatgtattaagaagactataacatatatcagttacttcactagatgccagtgcataggcatgtacctgaatctgcgtaactaattgggagaatgggaagttaactttatttttccaagaaaaagaaacaaaatcaatatttaaattttggaaaacataattgttaaattatttttcatattgtgtagattcacatctctttaatcaatgggagaccaagtgccgatgatccttctccagaactgctagaatttacctccgctcgctatattcgcctgagatttcagaggatccgcacactgaatgctgacttgatgatgtttgctcacaaagacccaagagaaattgaccccattgtcaccagaagagtaagttatgatgaatcatattagagcctacaaatgatatcccacttatctttttgtctgttaaatactttaaaaatgttttcagtgatttgtaggagtggttattatcaaatttttattttagaattgtagattattattattattattatttgaaatttgacagactttcctttgttcagatccaagctgtgccgcttattacatgtgtaacatttatcaaacattttagccttctcaaactttaatttcttcttttgtaaaatgagaatcacaatgtctacttaataatcttatttttcagaataaaattagcctttgtcaccttaggggatctatactactattataattggctttggcgagttactactggaagtgcaggggctttgaaacatttttttgccaccactgagccagtatacacacatgcacacatacagagagcagtatgtcttaaaccttaatgtgtatgggattagccagtgatcttgtggaaatataggttatgattcagtagggcagagctgagacgctgcacttcaaaaactttccaggtgatgctgatgttgccggtttgtgggccatcaaataatttggttttatgcttgattaatgaatcacaagccatagttttaaaaatgcagtgctataggagaaaactgattctacatactgttttattttcctttacaaataaaatattaggggaaaaagtttaaagcatcttttcaaaagctttttgaacacaagagctaacagaagtgctgtcttccagtgttaaacaggaatttgtgggattacaagatagatgatcaacccagattgctatgagtgataaccgtgcttcctcctgtctaccttctaccatattcactggtttatggcacctcccacatatgctgctacacaaccaaggcattattaccagggaagtcaattcagccataactctataaagtaaactcctgtgaatagagtatctactgtatgactagaggtatagctaagaaaaaagactatagggagaaattaatattgtaggacaaagcatttaattctagaatgatcccactaaggtaagaccaccgtcatcggttgcaaaattgctgaatcactagggttaatagttacagatcctaaatactcctcacatgttttctttcctcgttacttaacttcccacacccaacctctccatcatcacaagataacttttaaggctttagttagtcccatgcaacatatgtcagatgttttagtgccctgtattttccaaacttgaaataatttccccttgtattatacctcaacatattgtaaattgtctcatgcaaaactaatcattattttatagcaatgtttggatttttcacttgtttaagaaaacattttcaattctaattttggcgggacttaaaaatatacaccaaggaagactggtgtgaaattggagtgaaatttaatctttcttgacagtatgtctatcagagaaaaaaaatcaatgaaaataaattagtgttctttctatcatctcttgcaggaggtagagtgggggttggggtacacatctattatttataactttatcgtacatgagtctttaaaataatgcagtataagtcaacatataaatatgttttttgaaagtactcaagttcaataaacactcatttaaatatataaaaataagatagcaaatttcagctcttcttcatgactcaaaagcaaagcattatacatttatatttaaaatagatttcccagttttaaaagcatttacaaatactactgtatcagctttttaagcaaatatctctatttgtgtctatattattaagtgatgaggttaaatggaaaaaatatttttatactatccaaactccctagccagttccattagttcaaggtctaggtatatcaaataagataacataacaaaaatattttcaaagacactatatgtatgtaacaaaaacaaatagaaggaaaaagaaacaaagaagtaaattggaaaaaggggattcttagtcaaggaactcagatatgtgtccacctacatattctagctaaatctgttttttttgtgtgtgtgtataattggaataatagaactatctaacgctaagatgattatttgaatatgataatgtaaagtgctctgacaattataaaatgttatatacacattaattaaaattttaaaaatagtctagcctccataattatccttaaaaaatagctgggtagattaaaataattagtaacatagctctatgttaacttcatatacaaaggtaattgtatggactatattacatagtaatataaaaatgcaaatgttctgcacaataaacttacagttaatgactttttaattttcttcttaatatggttaaggaatatattgttatgagcacaatttctacccagattttgttggttcttttcaaatccatcaagtaaaacagtgtgcgtatgatttgtgaatactgcagttgctataatcacaataaaagagggtttcttgcaagaaactatgtaaaacaacttttatgaagaatagctgtccttagccccagataaaaactactgtcagccacaggtactctagcatggacttggtgctgactgggaaaaagatatttctaaaatgcccaactagcttaaattaaaggccactcttcctttgggctaagatcacagtgctaagagttactttgtcagttttgtgagtcctcacttgtcctcaagaaacacaaatgtccttcaaactaaggataaaagcagaaaataaagtttttactgaatgtccccttttgttactttgaccttgcagtcatcttaacaggatttctctctggattgctttttgcagtattactactcggtcaaggatatttcagttggagggatgtgcatctgctatggtcatgccagggcttgtccacttgatccagcgacaaatgtatgtatatttataggatgcttaggcaaaatgaagccctgagctgtaaaatgtttcatgacagtctttgctgacagagaacgctgtaaatgggagtcaggtccccacttagacagtgtaacagaaatccatgccagggtgaaataagagctggcagttaggatgatagactttgaaatcagccatcacagtataagaaaacagattagtttttcctttttttttttttttttcaaaaaggctccaaactggtctattttgaaatctctctagctatgacagcctgcctcatgatatagctttagagaacgcctgccatcaatcaacctgaccatttcttttaaagtttctaatcaaaaaattaatgcaaatgagtaaaaaaatgtgcagggaagtaaatatataagtgacaatggaacaggaggataaaatagggcaggggcaataagggggtggagggggtggagtgggtgagagagtcaagagagtactgatagtggcaagccggaaaatgccagaatgctttttgatagaattttttcattaatgacaatgaattaagtgaacataacctaaaggagaagatgaatgagcatctatttttcctgtcatagacaaactggtgaaattcaaactcatctcctgtatagtatatggaaaaatacattgaatagtaagatcagtgaatgtaaatcgggccacagattttttttctcaaatattgtaatgcaaatgacattatactcaaagctagttttctgatgattggattataatgttatctcctaggaagattaaagtacactaacatatttttatgggcaaagctgcagtgctgctttctgcctggtatgggtgctttcttcttttttttgttttccattttttaaaattttactttaaatcctggatactcgtgcacaacatgcaggtttgttacataggtaaatgtgtgtcatggtcatttgctgcccctatcaacccatcacctaggcataattttccacaggctttacagagtccctttgtctcactggctttctgcattttaaaaatccctttactgttattttatttggaggaagtgaaaaaatgcatatgccaccatagaatactacgctgccataaaaaggaatgagatcatgtcctttgcagggacatggatgaagctggaaaccatggtcctcaggaaactaacacaggaacagaaaaccaaacactatatgttctcactcataaatgagagctaaacaatgagaacacatggactcaaggaggggaacaacacacaccagggcctatcagatggagggaggcaaagggagggagaacatcaggacagacagctaatgcatgcagggtgctttctatcaggtgtacagatgatcagtgtttcccaggctttaaaagtccacaagacaggcttggaaggccaattccaggtggtaaattgagactgtattcagagcatgcacagacaggagatttagtcctagagacattagatttctggtttacctgcacccctagaggcctaggaatcaactccctccttcttgccatatccaaaaatattaacaacattttgaggggagccttaaaacaagctaatcgacccccaaaaaacacatagatcccaggcatcagagaaggagaattcagtcttcaagaccactcccagctgggccttcctgctttcttctgagcctaaacccagtgattaaagaaccagcctggacttccttaaggtgatgttgatcaaatatacccacttcaagcctggcaccactttcttcccaggctggctagttttacattttagtacacagtccagatgttttctcttttcttcatagtacctttagagagaggcttcctttatggttctaaatgaggctaaaatttgtgcttcctccctctttttgactagaaatctcgctgtgagtgtgagcataacacatgtggcgatagctgtgatcagtgctgtccaggattccatcagaaaccctggagagctggaacttttctaactaaaactgaatgtgaaggtatgttctttagaagccaacaaaatatgtcattcttcctttccaagaaaaaaagccagtaatgaaaaatagtgaaatggctggttatgcaaatgtgtcaacaaatactcatttatattatcacttcgaagacaacccatatgtctagcttttcctaaagggaaatatctaagaaatgtagcagatgactttatagcctaatagtgacaactggtctttttaggtgacaggtatcatggagaaacctgtgtttctggagattttctcaacccaagaaaagacctaaaaatagtcttgggctgaactgcaaacctaaactagtatgaagtccaattcaactgaatgcaaatattaatattacagtaaatcagccctaaccacatttttttcagctcactaagtatatatggccttcaaaaacagcttgatagacattttaaattaataccaacactatatatcctttgaataacaaattaactcaactcacatttatcatgtacaatgtgtcagacatgacaggtctttaaaactattgaatcataacacaccttaatcacaaaatgttccccacctataagatataaagtcggccttccatatccatggtttctccatccatgggtctaaccaactgcagatcaaaaatgtttgaaaaaaagttgcatctgtactgaacttgtaaagacctttttcttattattatttcctaagcaatataacaactatttatatagcatttacattttgttaggtattataagtaatctagagatgatctaaagtgtacaggaggatgtgcataggctgtatgcaagtactatgccactgtataacaggaacttgagtatccttgaatcttggtgtttgagggaggtcctggaaccattcccatggatattgagggatggctgtattttctttttagtttgagattctgcatatatgctattagctctccttattttctgcactcacttcatttgcttttggatttgtgtctgcctgtttataaagatattatggattagaaatctcccattattacaaaagcatatctggaggcatgagccaccattggatcatcactcaccatgcatggtaggggaccattggaagcccagccttttgtttccttcaactacttccagccatgttctggctaatcccttagttctccacagcttctccatagagaacagacatttgttcttaatagtgactttaaatgtaatgccacccagggatgtttgctctcgagctcctttaaattttaattaaatttctcttctgtttgtagaatatcagtaatcataagtgggagcagcacttgaaggtaggggtcttcctgttgccactgacatgccttcacacagtgataattgtgtaatgttaagtggctctgcaaaatcctttaccactctttacttgtgtttctacgtttaaatacaaaacaaaaacaatcgagcaacttgttagcaatagaggtagactaagcaaggcaagacatttcaaactgctactgtacacatttttaaaatagtggaattgtgaaacactttttttctttccctgtagggaagaggggaggtcgtatttccaaactgaaaaacaaacattttaaaaacgcagaaattcaagatggggatcttagccataaagccatacataaaaatcacactttcagcaatgagtacattcctgaaagcttaagtaaaaattttcttttccaagttgaatcatattccaatcaccttaatatttagaaaaatccttccatgacatgacaaatccctccataaaatgaataatcacattctaattcatttgagtttaatttggattttcatcaatctagcttacataaggcaagataatatctctaaaaagcatagaatattcattcagttgctgagcctttactaaacaacagtttcatatgatatatcttggacattctgtgaaatagtaagttgctgatgatagagaaaaaacatggctttgtgatcagttactagccatattcttgaaggttacagacagagcggggtaggctgcagcctacagacagaaagtggggctgtaggtgtagggtcctggctgcacagagtgtgtgatggaccgtttatttggcatcagggttttacatatagtagctcatagttctaaacactcttgacaacacgaattctaaatagtgtgagaataagtctatgttactttatgttttcctctgcttatactggcagcagaagttttgactgttttttgaaatacactattacaacaaagcttttaagaattcatagccaggtccagtggcatgctcctataatcccagctactggaaagaagctatggtgggaggatctcttgagcccaggagtttgaggccagcctgggccacatagtgagaccctgtctgtatcactccgttttcacactgctgtaaagatactacccgagactgggtaatttataaaggaaagaggtttagttgactcacccttctgcatggctaggaggcctcaggaaacttatgatcaaaggggaagagggagcaggcacatcttacatggtacaggagagagaggagaaagtgaatggggaagagccccttataaaaccatcagatcttgtacgaactcactcactatcatgaggacagcatgggggagctgcccccttgatccagtctcctccctccctccatacgtggagattacaatttcaaatgagatttgggtggggacacagagccaaaccatatcactgtctttctgaagaaaaaaaaggaattcttgtatgttgccctaaagatataaaactgcttacaatgcctagtgatttgtattgattactatgtgttccctaaagtttgaaactctccattaacatagcaaaactactatattctaaatcaaatgtcagcaggttgggaaaggtatttacaacaaacatgacaaggggataataacctttctatattaagagatcttacatatcaataagaaaaaagttaacctgttagaaagatcaaaacaggtattcctcagaaatgacatataactttgtaaaaagataatgacactcataatgaaggaagtatcaattaaaacaatgacatattatttttcacctatcaaagtgtttattcttctactcaacaaatatttgaatgcttattatgtccaggaattgtattcaagggttgataacacacaaggttggtggctatggagaaagtgttttatcatatctactagaggaaaagtcatttgtcatagcgttcctggaggggaattttttaagcgattaaaatttaaattttacatatcctttgactagaaattatgcttccaggaatttaccctatagatatattcatatagatgtacaggcatattatcatgatcctcgtcattattatacaagtgctaccactactgctactaacatttattgagctcagtatttagtatgtttcaggcattctgctaagcattctcaaaacatgtatgagacaagtactaaagtgatgctaggactcgagtttttgcctcaaagtcactcaactggcaaataggaaacttttctaacattagagcgcctccctccacccggcatccttgtcctcccagtatgtgtgtggtgttatttgtaaagggagaaacatggaaactgtgtaactgttcattaatagggacctgataaataccttcattcaagtagtaccctgtgtacccttaggggatacacatgctaatatggaaagggctccatgatttactgttagtaaaaagaaccggttctaaacagtatacaaatgccccttcccttttgtagaataaataaaaagattgagctgtatgcatacaagcacacctacacacacacacacacacgtggaaataaatgtaagtactcctaagaaactcaacatgtcaggtaggaaggagactgcatcgatatatttccctggttctatcctaatataaattcttcatatttagaagagtcttacccaatcctttctggagaaagtgatttttcacttcttggaattcttctaatgtaacatgaaaaagacaaggaggaagaaaagaagaaaaatcaattgctaacttctttataagacattacgctaatgatttcacatgcattatctcacttgtgcttttaaatatcccaatctagtaattactattgaccactccatgtattatatggaaactgagccttcgtgaaattaagaagtttccaatgtcatatgactgctaagtagaggagagcacacccacatccaagacagttggttgcaaaatagcatgatcttagccaccagtaaactagctctcggtttgtcttaattccttggcacctgccatgtatcttatttcattcaccgggtaggatgtgaagagattctggcagtctttagcagtgcagactctggagtctggcttcagaggttggtttccaatactgattagaatatcttttacacgttatttcacttctctggactcaggtttctagtatacaaaaataggttaataataataatacctaattcctaaaagcatttttgaggattaaaatcagtagcaacaaatatggagcatttagaacagtgtctggcattgagaaaacctatgttttagttgttattagtattaaaagaaaggaattatattatacatacttttctttacccacaggctctaatacagaaatttccatatggtagtaattcattacagattacctagctgttaatcattcagtgccatcattgaataatttattatttgttataataggaaattgtaagttgaaccatataaaattgcacgttagtcaaaaccaaatattggcaattgcatatgattgagcttaatttatatgttttaatcatttcaaattctattaaaatgtgtgaatttattaatacctccaatacatccagatactttctggatatgtttgtgtgtgtgtacgctaaatgtaatttcccgtatggtataaaagtctaggccgggggcagtggctcacgcctgtaattccagcactttgagaggctgaggcgggtggatcatgggtcaagagttcaagaccagcctggccaacatggtgaagccccatctctactaaaaatacagaaattagctgggtgtggtggtgcatgcctgttgtccccagctactcgggaggctgagacaggaggattgcttgaacctggaaggcagaggttgcagtgagccgagatcgtgccactctgcactccagcctgggcgacagagtgagactctgtctcaaaaaaaaaatctattatgtataacagaaatgatttttaaatgtatctgaaatcaaattgatgtttattaatttatttttccttaatgcagcatgcaattgtcatggaaaagctgaagaatgctattatgatgaaaatgttgccagaagaaatctgagtttgaatatacgtggaaagtacattggagggggtgtctgcattaattgtacccaaaacactgctggtataaactgcgagacatgtactgatggcttcttcagacccaaaggggtaaagtatgctttttctttcataaagagttatttttttgctttttcatacaaaaatgttttatacaaaaaaataataattttgaaagcttctgtaaacagttgaacttcaaattaaaaggtaagtaggaacatttcgtagttgaaactgacctaaatctttgaggatgtaagataaaacttttccatcactccagaaagttttatcatggctccttccagtcaaggagtggacccctaggcaaactctgttctgatttttagaacgtaaattagttgtgcctcttagagaatttcataaaaatgaaatcatacagtacatactagtgagtcttttttcactcgacataatatgttaagatttatccatgttgtttgtgcatcagtagttctttttcttttgaaagaaattgctgagtagtatttctctgcacgaacatatcaaaattttaaatccattctcctgttgatagaaattaggatcatttccagttttagcttagctcctacaaataattttatactagttattttatagtcatatttttatttaccttgtgtaaatacttaggaatagaaagcttttttcataggataggtagatgcttaactttataagaaaccgtcaacattttgccaaattagtaataatgtataaaatgttcaccaaaaagttatatgagtttcagtcattctatatcatctctaatatttgatgttgactatctttttggattttagtcatctagtgggtgtgaaatggcatctgattatggatttaattttaatcgtaagggcttattgaccattcctgtatcttctcttatgaagtagatgttcaaagtctaaatatttttttatcctaaaaaccaaaattttaacttatagagctattacccatatcaagtaaatgtttgtgtgtggtgtgaataagtaaccagatttatatggttaacctgaagttctagcaccatttgttgaaaaatcaattgatcatattacatggatcaatttctagaacctcagttatctatttttcctagcatctatttttccctctgcgtgctaataccatactatcttcattgctttagtaagtctagaatttaggtaatataatgtaccaactttattttttattttcaagattgtctatagtaggggcttttttgtgtgtgtttctatacaattttagaatcaacttgtcaattacagaaaatattaggattattgcttagactctatatacaaatatggaaaatggagcttgaggagatgttggtcaaagaatataaaatttcagttagatagtaggaatacattgaagatatttattgtacagcatggtgactgtagttaataacaatgtatttactcttaaaaaatgctgagagtagattttaagtgttctcaccaaaaaaattgataattatgttaggtaatatgttaattagcttgatataaccatttcacaatttgtatatatataatatatatatacaatgatattcaaaatatcatgtcacacatgataaatatatacaattttgtcaaaaaggaaattaaactttaaaagcaaacaagtattgaggaaaataacatcataataatattgaatcatttaaccaatgaacatagcatatctctccatttatttctatcttctttattcatgtcagtgttccagtacagagatcttgcatgtcttttgttaaattaatctttagaattttgctttgcatgactgtaaaaaaaatttttaaataattttccaattatttaatgtaattgttaaagaattttgaatattgactttatgccctatagccatccttaatttctttttttttttttaaataacttcccttttaaaagttactgagaataaagaatacagaacatggttataggcacttacattgctatcaaatgcaggaattcacttcaataagaagtgctttctctgtaagcatggttcatggcaatagaagctccaacttaggagaggatgttttccgtgacaaaaataataacaacaaaaaaaatggtggttgaaggaaaacagtccaaatttacagatgctttaaacttcttttggccttggcatcagctttcatgttaaaaaataaagctggtggggaagctatctcacttgcaaagtaaatggcttgtatgagattggcgaatcttggtcagatattgcatttttaaagcacaaaaccaccggccaccaatatcttcctgtgcatgcatataaattattttcttctaattcaaatggcaacagaggaatcctggcgtgcatgtgcatggagacacacacacatcactaaggagacaggacaaactatcataaactaagcagtatcccaaacacatcatcatctataggctgttttacaaaggtggaatacaaacgaactgaatgtctcaggtaaaaggcaaagtctatttctccaactctgctgcactcatttatcttcttaaggctttcacagaaagcaccgttttatgaacaggcaattcagtacccagagcttgactggagacactaatcaggattgaagtcttgatgcagttcataaaaacccatttaaaaaaaggcatcaaaaaccacatttaaaataaagttgtccatatataaagaatgaagtgtttagaagttcccagcttgtatcctaataagagtactgaaaggtttaatattagcagcctgtgaacacgtagtgaagaaagagtctgagaaccaagttaacatccttattccactctaattccacccatgccatgggtaaaaacagttcttgcagtctagagtttctcctccgatggtttaaccgtcagatttttacatcttgggattcaaccatcttggcaagcgtcttcttaattctcaacgctgtgagtctgggggctggattgtgggcccagcattctgacattagcttcaaaactgctcgtagacattcatcactgttccaccgattagacacaattggccgcaaacgtttgacacacacaacctcacgcatatcttcgtatgacggatcactcggtaccatgttataatatggcaattggtagtcttccacgatccctcctgtgatacaacgacgagccatctcccaaatgattaggccgaagctgtagatatcagccatgatgtagggctggaagtggtttttgttcaggctttcgtccagcacttctggagccaggtagcgtttggtgcccaccctggtattcaagggcacatcaacttcatttgtgtcactgttgaatttaacagcaaggcccaggtcagcaatgcagcaactcccatttttcttgatgaggatgtttttgctctttaggtctcgatgagcaattgcgggctttccttgggtgccatacgtttctgtgtgcaggtggcacagaccacaggcagctgaataagccaatttaagcagggctctggtgtccagcgtagcacatttcaggaagtcatagagagatccattttcatggtaatcagtaatcaaatagagctgagtccaggaacctgtacctttaatatctgccgctatgaaaccaagtatgttttcatggcgcattagcacagtttggtagatttctgtttctcgaaaccagctggcttcttcagtggtaaagaatactttcaccgccactctttcgccatgccatttgcccatccgtacttctccatatcggcctttaccaacttgccggaccatctgaatctgtttggcaatagttcgctgaaccaataaaggtagtccagacccactaccagaactttgtgactggtcaataaggtcttttagtgattttccaactggaataaatgcttcatcctgttccaaatcacgattgtaacgacgtctgcttgagatgctcttgcaataatgtttgtaacaaaagcagctggagaagatgatcatagcaattatgcagacagccatagaaatgagcaaaaccagccatcgaatgctgccatcaaaaaacggacctatgacaacagggggcatgtgggttgcaaatactggttacataaattggtccgacaacattctattgtccggcgtagctgggcttttggagaatctttgcactgaaaatcagatccttcatatttcatacaccctgaagctaatgtggtttctccctggtcatcttcttctatgatggcaaagcaacgtccattagttatgcatgtgttattaatagcatcatctgggcagtgccctcagcaatagcacttgaaaaaaggcaaggtatcctctggtgctaaggttactccattttctgactttttctggtcggagtctgatttcatcccagtgccgtggagcatactatccagattctgtccttgaacacgagaaatgatgaacaaataggctcccaataatctgatgtaaatgtatagctgagtcattgttcaattgtaatgtttcctgtgtactgtcacctttagtaattggtcttgctacttcaccaatttaaatgactgtcattcagtgagattttcttgtaaaagatcgcaagcacttgacaatgacttcaactcccactgctttcttacgactcctccaagatgtggctagataaaactgtacttccgattttctccaaacagctttgacctatgcttccatctcatgaattccaagacagtattaaactgatgcatattttcataagtcgctcccggcgtctcttcccgggctccttgccagcgtgccgaggcgcaggcagggtgatggaggcgccccggccgggaggatctgccggggagagcggctttcctcatcgattcgggagcacccaccatgcttaatttctttattaattctagtagttttaaactacatgctttagaaacgtacacataaacaatcattttacctgcaagtacattcaggcttacttcttcctttgcaatctttatgccaaggttaactaaaaatggcgagagctgacatcttcactttgttctgaattttaaagggaaacctaatatttcactatggagtatgatgtgaactgcatatttttttatggacaccctttatcagattcagtaggtcccctactattcctaagttgcagagagtttttataacaaaatggttttgcattttgtcatatgcttttcgaaacctactgaaatgaacataaggattttctcctttattctgttaacggggacaatttatgcaaattgaattttaaaatatgaaggcagctttgcatttgtgaattaatctccatttggttatgatatattatcatttttatatattggatgattcaattgactaatgtttggttaagaattttgacatcctctcataaaatatattggtctataattttattttcttataatgtttttgtcaggttttttattggggtatactggcatcaacaaatgatcggggaaatgcacttcctcttctgttttctaaagtaacttcagattaaaattaattctctttaaaatgcttgataaaatttcctagtgaaactatctgagtctctagttttcttcgtgcattgtattggctattttttattagacatagggttagataggttttgtattaatatctttagggagggtcaatttttgatatattgtatttttcaagtaatttgttcaattcatctaaattgtcaaatcattggcaattggcagttttaaaaattgccttattatcttcttgaagtctatagcatctatatagatatcccctgtgtaatttttaaaatgattaagttgtgcttttctccttttattgatcacttatgttaggggtttatcaattttcctaatcttttccaaaaaaacttctgcctttttattttttgtgtttttattgattctgttctatttattatattattcatttgacctgttttggttttaaatttcattttctttttctacctatcaatttggaaagttaaattatgattttacacctttcttcttttatcatataaacttttaaatatagatttccttctagcagttctttagctgtttctcatgaattcaggaatgctttatgttcattgtcatttatttaacataacttctaatttctcttgtgatttattttttgttaatttccaaatatttgagctttattaaatattatatttttgatttctacactggatgtttatgatctgagaacatactctctaagatgtcaaactttagaagtttattgaaatttaacttatggctcagtgcatggtctctcttggcaaacaaataaatgtggatttttccaatctgcgattatggattcctacctttctttcatttttttcagtatttcttcctgttctttgaagcactgttatgaggcacatacatatttagaatattttgaatctttagatttttatatcttataaattaatattttgataactgtgaagatctccacttaatctcagatatcactttttgtcctaaagtctactttattttttattaacattgccacagcagttttcatatgcttactctgtatggtatgttttttctgattttgtttaactttcaacctatctttattttcatttaaaagatttcttataaagagtaaaatagatggattttttatcctgacaattactgtgtgtttagtccctaaatttaatatagttaataatatgattgggttttgctatttgtttcccatttgtgtcacaaaatttttgttcccattcttccttttctgtctacttttatgttaaacaaatatttttcagtattccattttatttcctttattatctttttagcagtacctctttgtataattttccattccaacttttattttaggttcaggtagtacatgggtaaattatgtgtcatgggatttggtgtacagattattttgtcacccagataataagcataataaaattttcaatcttcacccccctcccacccttttcaagcaggccctggtgtctattgttgccttctttgtgtccatgtgtactcaatgtttagctccactcataagagagaacatgcagtatctggttttctattcttgcattaattcacttaggataatggccttctgctccatccatgttgcttcaaaggacatgattttattcttttttatggctgtgtagtattccatggtgtatatgtactacattttctttattcagtccaccaatgatggtacctaggttgattccatgtctttgttattgtgaatagggctgcaatgaacataggcatgcatgtggctttatgatagaatgatatatattcctttgggcatatacgcagtaatgggattgctgagttgagtgctagttctgttttaagttttttgagaaatctcccaacggcttcccacagtgtctgaactaatttactttcccaccagcagtgtataagtgttccctttctctgcaacctcaccagtatctgttatttttgactttcagtaatagccgttctgaccagtgtgagatggtagtattttaagctcatgatatagtgatatagtcctatcttttggactattgttttcatatattgcacataatttgtaagccagcaatacaatgttgtcatttttgtttgaagtcacaaaactatgaaaacaatcttaaagaaatgaaaagaaggaaaaaaatttacattaaccatacctttcccattttccatactctgtggttctagcttatatatattgccctcctgcttgaaaaatttcctttaacattttttttttggtagtgcagagctgctggtgacaaattttctcaacttccctttatctgaaaatgtctttaatctactttcattattgaaggatattttccacatagttacagaggtgtgtgttttcttctttgtttagcactttaaagatgtggcaccattattttctggatttcattcatccttatgacaacatagccattatttgtttctttgttctatatatatatatctttaattcactagatgatttcaaaaatttttttatatctgccttttgacacttataccatgtatgataaaactttggcccgtagaccaaatctgactcatggcctatatttgtatgatctgtaagcaaaggatgtttttacatttgtaaaggtttgttaaaaggagaagtagaagaaggggagaatgaagagaactaggaggggggggaagaagaggaggaagaatgaagagagtctttatatggcttattttactatctggccctttacagaaaagttttccaacctcagagttaaataaactatgatgtgtctatgtttggctttcaagcttaccttgcttgattcacaaagcttctaggaactataaattgagattttattccacatttaggaaattttaggctattttttttatttttacttattttttttaggcttttgtttaaaacctgttttttgaccagtgtttttccttctctttctaggactccagctgcatgtgtgctagggcgttcattgtatctgaggcagtgctaagtaattttttttctttctccgttctttagattggatcatttccattcatctgtcattatactttggtctacatataatgtatctttaatttactagctgattttaaaatattctcattaggccgggcacagtggttcaccccaggaatcccagtactttggaaggccgaagcaggcaagtcgcttgcggtcaggagtttaagaccaacctggccaacatggtgaaaccctgtctctattaaaaatacaaaatttagccaggcatggtggcaggcacctgtaatatcacctactcaggagactgaggcaggagaatagcttgaacccaggaagtgaggttgcagtgggtcaagcttgcaccagtgcacttcagcctgggcaagagagcgagaccctatctcaaaaataaatacaaataaataaataaataaattctcattatatttacttttaacaatagtatcatgtttgagaaaactttggcctgtagaccaaatcctggcctatggccagatgactacaaaagtagtcattaggttgactactcttcctcctatcatctctacctgatgttaagcatatccagtgaattattaaattgaggtattttacttttcagctttctggagttcttatgttccttacagcttccatttctctgaaatactccataccttcactcattataaacattgtttcctttatattctcggacatatttacagaacttacgttgacttccttgtatgctaatttcaatatctgggtcacctcaggatctgcttttatcaacttctttttttaataaggtcaacattttcctgtttctttcctgtatatctaatacagtagtcctcctttattcacagaggatatgttccaggaaccccagttgatacctgaaatcacagatagtaccaaacctatatatactatgttttttctatctgatacctgtgatgggactaagtgactaacaggagggtagtgtctatacagcatagatatgctggacaaggggatgattcatatccctggtgcgacagagcaagatggcccgagatttcaccacactattcaaaatgacatgcaaattaaaacttttcaattatttatttctggagttttccatttaatattttcgaactgtggttaaccatgataactgaaacctcagacagcaaaactacagatgaggtgaggactactgtaatttatcatctctacaggacatttcggagaatacaatgcagacactggtttctgttatgttcctctgaagagtttgaattggttctaattagtaataaacttgctgagtgatcaccatgaagtcatgaaagtttactttcatactttgttaggacagattagtggaaaactccaggtattcatcaaacatttctaatgtagttaacttaaagtctgaattctctttactttatggttggtagcacctgaaaactcttctcaccttgttcagtttccagcggttgctttccactgaatttcctagaatctcctgagtgaatatacaataaagggatcagttaaggctgggaagggtattgttatgcaaattttgtgaattgcagtttaacagctaaagaatttatctctatgatgttcataaaattattgtcttaaaatttgattttagatttttccacttaatgacatttaatttatatgtgtatataaaatatgccttacctattctgtgcacagtcccaacttcataatgggggaatgaatgaatgtatcttaaacaaatgatgattttgaaactgacctgtgaacttagttaattgagattcagtgaggtatataaataagtctaattttaacactctgatttatagtagcaaacaagttttcatttgtaaattaagcctagatatatatacatatgaactatattgaataggtgggcatttcttgggcaaataatttagttttttttttttttcctattacatctggaaaataaatcttgtatatacagtatatgaacacagtgtagttttgtttaagtaaactagctttgttgatatactatgtatacaagataaaaaggaataaaacatgaaaatatcaataagtattgaatctaagtaacaaatatataggaatttattattctattatctttacttttgtgtaagcatgtaaaagaactggattttagaaattataaacatgtattaaaggtaattcttatagttttctcaataatttgctgctctgtattattaaaactactttgtctataaaagtttgctgaagtgaaaaatattgctgtttctattacacttcgttaaattcattttaatatttttgttaggtatctccaaattatccaaggccatgccagccatgtcattgcgatccaattggttccttaaatgaagtctgtgtcaaggatgagaaacatgctcgacgaggtgagagctgcagcagaatgtcactgctctgataaaaggacaactaaaagccaaatatgattattttcagaagaatattttgcagtaaatgttattcatgtaataaatttattctttaatctatcagtgtattagcgttccctccaggaagtagtttttaaactcatctcaataattactttcatgtttaattataatgttttcatagcaagaagagttgaattatgtattttgagatacacacacacacatacacagagataaagaaagagagagagtcaatcacaaatctgtggtatatgtaattttttcatatcgtgttatttattagattgtttgtagcttctatgagttctagcatgaaatgccagcgttcactgaggaatgtgtgtgctgtagtgggaaaagcaaatagaagaactcacacactgagatgtaggcaataatatagaaagcaagaagtgttcataaaggactaagaaggtagtagtcatgaattaatgaacagaaagaggctgacactaatttaagctaaagccttcctttgaggaatgaaattcatgaactccaaacattaagaaatcaaatgccaacataactccttgatataaaagcgtttgggagctacttccagggcagttgctcgccaagtttaagtaggaaattcatagaatgcactgggacgcttcttctctagaaagactaaaattaatcaaggctacaatgtagtgtttttttccctaatgactttagcgttaaaagaccagcaatgtttcttaggtacaattcttgttacctgctttctttataaaactgtaggattatcaatctgagcattacatgtagactaaattttgaaatattaaaaaacggatacgttttgatagtcgaatgatgaattactgagctcacttttcgttttaagccttttctctttgtgtttacaagtaaatcacaatgttgttttcattaatatcatttaactcttccctacccctttttgagtaatgagtatatgatcacagaataaaaatggaaaagtagaaaaataaatatacaattcagtggtaattcaggagagataccactattaacattttcatatatttctgtcataatgcatacaaaaatttctgatattgctcctcttaactttatgtgatgagtttccccaaaaatctatgaaaactttctctgaagtctggcttcagcacctaaataacacattattatatggtcgtgccataattatttaccctctcaactttatatggacattaagattgtttcaaatttttgtttattttaaccaatcctttaataatacttattccatataattacttttcaattattgtaaaaacaatacatagtaaaataaattcttaatagtaaagaaataaaataataagtgtcctcttcaacctatttatcccagtcttacttccaaatttaaaaatattgagccttttttccgattcagtttttattttttttaattatactttaagttttagggtacatgtgcacaatgtgcaggttagttacatatgtatacatgtgccatgctggtgcactgcacccactaactcgtcatctagcattaggtatatctcccaatgctatccctcccccctccccccaccccacaacagtccccagagtgtgatattccccttcctgtgtccatgtgatagcattgttcaattcccacctatgagtgagaatatgtggtgtttggttttttgttcttgcaatcgtttactgagaatgatgttttccaatttcatccatgtccctacaaaggacatgaactcatcattttttatggctgcatagtattccatggtgtataagtgccacattttcttaatccagtctatcattgttggacatttgggttggttccaagtctttgctattgtggataatgccgcaataaacatacgtgtgcatgtgtcttcatagcagcatgatttacagtcctttgggtatatacccagtaatgggatggctgggtcaaagggtatttccagttctagatccctgaggaatggccacactgacttccacaatggttgaactagtttacagtcccaccaacagtgtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccacttgttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtactgcctaggttttcttctagggtttttatggttttaggtctaacgtttaagtctttaatccatcttgaattgatttttgtataaggtgtaaggaagggatccagtttcagctttctacatatggctagccagttctcccagcaccatttattaaacagggaatcctttccccattgcttgtttttctcaggtttgtcaaagatcaggtagttgtacatatgcggcgttatttctgagggctctgttctgttccattgatctatatctctgttttggtaccagtaccatgctgttttggttactgtagacttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgttgttgttgtataagaatgcttgtgacttttgtacattgattttgtatcctgagactttgctgaagttgcttatcagcttaaggagattttggactgagacaatggggttttctagatatacaatcatgtcgtctgcaaacggggacaatttgacttcctcttttcctaattgaataccctttatttccttctcctgcctaattgccctggccagaacttccaacactatgttgaataggagcggtgagagagggcatccctgtcttgtgccagttttcaaagggaatgcttccagtttttgcccattctgtatgatactggctgtgggtttgtcatagatagctcttaatattttgaattacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcctacttgatcatggtggataagctttttgatgtgctgctggattcgttttgccagtattttactgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcatagaggtgtttgtagtattctctgattttagtttgtatttctgtgggatccgtggtgatatcccctttatcattttttattgcatctattagattcttctctctttttttctttattagtcttgctagcggtctatcaattttgttgaccctttcaaaaaaccagctcctggattcattaattttttgaagggttttttgtgtctctatttccttcagttctgctctgattttagttatttcttgccttctgctagcttttgaatgtgtttgctcctgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcatgggtttcaaagaacatctttatttctgccttcatttcgttatgtacccagtagtcattcaggagcaggttgttcagtttccatgtagttgagcagttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtttattaggtccgcttggtgcagagctgtgttcaattcctgggtatccttgttgacttcttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatgtttgttggtttaaagtctgttttatcagagactaggattgcaacccctgcctttttttgttttccatttgcttggtagatcttcctccatccttttattttgagcctatgtgtgtctctgcacatgagatgggtttcctgaatacggaacactgatgggtcttgactctttatccaatttgccagtctgtgtcttttaattggagcatttagtccatttacatttaaagttaatattgttatgtgtgaatttgatcctgtcatgatgatgttagctggttattttgctcgttagttgatgcagtttcttcctagcatcgatggtctttacaatttggcatgcttttgcagtggctggtactggttgttcctttccatgtttagtgcttccttcaggagctcttttagggcaggactggtggtgacaaaatctctcagcatttgcttgtctgtaaagtattttatttctccttcgcttatgaagcttagtttggctggatatgaaattctgggttgaaaattcttttctttaagaatgttgaatattggcccccactctcttccggcttgtagagtttctgccgagcgatctgctgttagtctgatgggcttccctttgagggtaacccgacctttctctctggctgcccttaacattttttccttcatttcagctttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctacatttttttcaaagttttcaacttctttgcctttggtttgaatgtcctcccgtagctcagagtaatttgatcgtctgaagccttcttctctcagctcgtcaaagtcgttctccatccagctttgttccgttgctggtgaggaactgcgttcctttggaggaggagaggcactctgctttttagagtttccagtttttctgttctgttttttccccatctttgtggttttatctacttttggtctttgatgatggtgatgtacagatgggtttttcgtgtggatgtcctttctgtttgttagttttccttctaacagacaggaacctcagctgcaggtctgttgcaataccctgccgtgtgaggtgtcagtgtgcccctgctggggggtgcctcccagttacgctgctcaggggtcaggggtcagggacccacttgaggaggcagtctgcccgttcttagatctccagctgcgtgctgggagaaccactgctctcttcaaagctgtcagagggacatttaagtctgcagaggttactgctgtctttttgtttgtctgtgccctgcccccagaggtggagcctacagaggcaggcaggcctccttgagctgtggtgggctccacccagttggagcttcccagctgctttgtttacctaatcaagcctgggcaatggcggcgcccctcccccagcctcgctgctgccttgcagtttgatctcagactgctgtgctagcaatcagcgagactccatgggcgtaggaccctccaagccaggtgcaggatataatctcatggttcaccgttttttaagcccgtcggaaaagcgcagtattccggtgggagtgacccgattttccaggtgccgtccgtcacccctttctgtgactcggaaagggaactccctgaccccttgcgcttcccaagtgaggcaatgcctcgccctgcttcggctcgcgcagggtgcgcgcacccactgacctgcgcccactgtctggcattccctagtgagatgaacccggtacctcagatggaaatgcagaaatcaccgtcttctgcgtcgctcacgctgggagctgtagaccggagctgttcctattgggccatgttggctcctctccccgattcagttttttagtgagttacctttagtatctaaataatattcttatcagtacttttatcaccattacatattgcctattgactctccgtcttgaaaggtgaagaaatgtatcattcacaacacctccctccttcattccaccatccatacatttttattatgtgtttcttctacgatatctttatcatgttcaagagagcttacatgtctatttcatcaatgactacatttagactttctcttgaggtcctactatataagatgtgataaagactatcatccctacattcttcaccacttgtcagtgtctgtcaattacatatctttgaaatcttttcaaagattttcacagttacattcagctctggaccaataattaatgcttataattcaaaaatagaaatataataatcaagattgtaatactgtaattagatacatattatttgatacaggctcgaattgcaaaattggacacatatttgtaggtcatttttatcttcatgcttgctctgataacttatttaggaaagagtgtaagatgtggtctcatggtttgcacttcttcatcagattacataaccagatagtagaaaaggatattttagtgtattactggcattcatttgattacgagggaaatacgatgtatttcttctctgatttttcttttagttttcttcattttcttttagtagaaggaagttttctcccttgtagatttgtaagagcactttaaatattaaaaacagtgatagtatatcattttttaataatcagttttcagatttgctttgtgtctcactactgttgataatttctagtgcacaaacttcaaaaattttatgtaatcagctgtcaaagttcaggtaaaattctttacttataataatgataccaacccatgattattatatattttgatttttttgtgtatttcttacatgctttataatcctagaactctcatctatcccaagattagaaaaatgtatttgttttcttcatttgtatgatttcattttataatacttaattttttattccatctagaatttattttgttatatttcataaggaaattttcaaactacattttgttttccaatactcttttttactcatctacatttaatattactttcagctctttagacatattaaatatatttattttattttcggaatctgttagaagcactctgttattgagtctgagtctgcatttttatttctcttctaactcttattcatatggacttcattttcttatgtttcgtaagtgtgtgtgtgtgtgtgtgtgtatgtgtgtgttttgtggatgtatgcgtgcatatgtatttcttagtttattctttcagaagccttgaatttacatgaagttatgtgataatgacctaccttatataggacctagaattttttgttgttcttctgtaaaaccatgctccctgaactgtagtctagtcatcagaatttgccagtcaactccaggaaagacattgttttaaagaatgacgtaagctttctagaagtcaattttgtagtttctcatctccaaggggtttctttatttcttgccagcgcaacgattctgttatctgccatctgtctttcgatctatctacctacctacctacctacctacctatctatttttctacgtttaattttattctgtatcttcaactgttctgaacaggaggggttttttggacatctagtctacaatacttccagaaataaaagttaagatagacattgtttaatacatgaagtacttctacatttagcctcaatttctggaaattttaacatcagaaataatgttaaactatttaatgcctttgcaaactttattaaaattatcagatttatttcccatttggtctattgggtaatctattagaaacgaacttactaatatcaaacaatatttattttaccagagtatgttctacttggacatcatagaggatccttttaatgtactttaggattcagtttggtgttttgctcatctggattcataagttaattgcctgtgactcagacacccaccagttgtgctcctttggcaaatcacttaatttctccatgccttagttacctcatctgtgaaacaggaaaaataatagtgtctatctcatatagatgttttgagtactaactgaattaacccctgtgttttgtgtaatgctaagtataatgactaccataagataagtgctatttgagtcttagaagttttgtttatttggggttatcatttgcatttgggtatcaagttagaatttgcttcataaattgaattacatagctctccatttttatatgaccataagagtttcaagttttgaaaacagtctgtaaaaattaactagcattacagaaaaccaaacaccgcatgttcttactcgtaagtgggagttgaacaatgagaacacatgaacacagacaggggaacatcacatgccagggcctgtcagtgggtgggggtctaggggaggaacagcattaggagaaatacctaatgtagatgacaggtcgatggctgcagcaaaccaccatggcacgtgcatacctatgtgacaaacctggatgttctgcacatgtattccagaacttaaagtataataataaaaaaaattaactatcattaaaacatgtttgtggtagttctttgataatttgtcctcttttgatacccttgattagctttgtttaccgtttccttttgcttgcttttctttttttcaaatctctttacttcctgtggtgtttatattttctcttttttatacttaaatgaattaaattttaatttatctatttttaaaataatggactatttaagcctataagtttacttttgggtacagtttttccatactcaacaaaaattaagttccttttttactgctattatattctacctagatagctatttatttttaattgaagtcttgattttctctttaacccaagagttattaaagagaaatatttaggcattaatttttagaacagttgaattttgcataaaattctctcatcatgtttgatattcagaactaatttaatcttaatttttgtggcatttgatacacatctaaaagtagtaatttatgttaagaaaataagccttagataatttctgctttgataattgagtattttttatagtcaatcacaaactatggtaaatatttagttatataccacataatatgtaatttgatattattagattattcaaattttctgttttttcttacttcatctgtaaatacttaagatgagtaagttagcatcattttcagccattgacttttaaagtttttatttccaatatattttgttgtccacatatttttgtactgataattagtgcttatttgaagcataaacataataatttaaatcatgtttttattatatttttatcaatgtaaaatgagagcttgccttactgaacctagtttatttgagttctactttggccctatttaatatttcacaacttttttttcttttccatacgctttcttgacacacattcattttcttttacttgtaatattttatttgcaatattcctgttcattttgtttatctcttgtgcacattacatgtttatgtttttaataagaacagtaagactgcttaactcattagtatgtatttagtatgcatttctgacactaattctgtcattctgctttttgctttctctccctaatgtttccttgcctttttttccctcctcctttcttctttctgatggactatatatattactgatttgcttttatctttctccagattttgaaggtctgttagttgtattcattcatcctgtattatttctattttttaatcaaagacatgaataaacattgtgttttgtatttctgtatgttaaaaaagtaaatttaaacttttcattcccctcatctattgcttcttatccccaaaatatcaattccaatgaacacctttattttctttagtaatactgccagtggcatgttcttagagtatcattgttaaactgttattttaagtaatatgtctttattcccaaggctactttgcacctgtaatagtctggtggagcaggcttgttccgtgagccactagttttgcatttgttactgcttattcttctcaatgtagcatcatcagcattagcgtttgtggaaatttctccttggtcattgttttctatagccatagtttggtagatgctttgagatttcatctttcttgtttacatttttaatatttctattgacacttagaagatgctatgttcacgtaatcatagaaagcttttaattaaaccctctactctttggttttaacttttctttattgatatatataaaaaatctatttttgtgtcaaaatagcattttaaaggttactgtcattaaaactttaacaactaaattatgtacttgttttagaaatgttgatatgtggctcatctttctttaggtttggcacctggatcctgtcattgcaaaactggttttggaggtgtgagctgtgatcggtgtgccaggggctacactggctacccggactgcaaagcctgtaactgcagtgggttagggagcaaaaatgaggatccttgttttggcccctgtatctgcaaggtacattgtttattccagtaatgtcccactgtcaagacagaaggttatttttcttggcttctctgttgatttccttggcattaagcaattttaatgacttctggaagtatccataatctattctacgtgtggtgacccaccaggttcactgtagcaggatgtttataaggcacttatctaaaagcctacaaatgcacggaggataaaccacgtttaaaggcttgttattttataacaaaaacactttcaccccattgcccaactagtgtgttaatttaaaaatatacggcactagaaatagcaaccctttaaaactaaagtgcattcaaatctacctttgcatctaattcagtaatgaattctgtcaagggttttattctgaatttttaaataatcttctaaagtttgaacccagataagccttaaaatactcattatattcaaatttttctgttcaattataaaaaagtacaaagccctaatggaattaattaaaggctcaatattttcttccaagattacttttagaaatgcaactttatttgttgtacatgctcacctaataacaaatcatgttaacaccaagggatgcattacctctgcagcttataaacattatgaagcatacaggcatgcacaagtgaaaaatgaaaagactgatttactttacctatagtaatgagttctataacattctgaccagacggtgtataactacattagctgagagaatgaaccattctttgaaaaagttagcataccatacttatgtaaaaatgaaagttactacttttttctttattttcaattaaagagggacccttattaaaaatatttttattaacctgttagtcttatcttggcagctataaaatattatatagttatatttggtacatgtgagcatatgtgtacatatacaaccattaagccataatataagtagtaaatattagttttaatgaagtgtttatgaattgggacaagaatgtctggaaatatcaagctaaatataataataatagttacataataggtatatgttacatcaggggcaatttaggttcctattttgaactactgaaataataaaactcctgtggacacagtaagcagaaaagtccacaagcccatagtaaaaagttgccatgtcctggaatgtagtaaattttctaatctattacatttcattccaatattatctgaaatgaaaaattgcttgagttgaccaagattgtgtagcagtgtgtgagtgattgcttgcttaaggacacctcccctctccatcttgtatgtctctgtgggcaatcctgcaggctcttagtgcatcttctctagtatttatcaaaacatgtcttgtgtgtgctttattctcttttcaaaactccacagaaatctctaacctttaccacttgctcaaataaaggacagtcaaaactaagcttaaaatggaaaagaaacctcctgagtttctagaatatataaaatcaaacagggaagaaaaacaagtgcttttctacacctaccactcatacagtggtgatgtctggtatttgcaaggaaagggagtaataagcgagttaattttctttggtaaatatagcgagaaaggctggagcaagagagctgtagtgattagcagggctccaagggaaagccccttgagctacttactgcctgctctcagccgaactcaatattgtactgagaattattataatcctaataagaaagatgcctcctgtgtagacacttgaagctctacacagacaattaaaatgcaacaataaacagcaattaagaaatcataaaagagaatgaaaattaagtaaatagcattattaaaataaatgcctttctaccatgtgatatcttaaatagaaaactgtaagttcttataaactaaattgtttcaggattaaaaacttgcagaaagcaagtttcataaaacatctacataattataaaaatcacaaattatatgcatataacatgaattacatcacagaattatatatcacaataatatcacaatatgccacgatgagttatatcaaaatgtgcatgcaatgtactacaattaagtgcctacagtctcttgtttaaaaaataattaataacctagcatttcaacaaaatatgcatacaatttaaatactgaaaagacacttagtgtagtgtatttaaatactgaaaagacacttagtgtagtgtatttaaatactgaaaagacacttaatgtaacagttcatactgtttcacaaaaacatgatttgacatagatatgtcaactgattgtaaaaacagcatggatcaaaatgctgcttaagaagcaaaattttattgaaagactaaaatattggagatataaattcaaattaaatgacaggtttttagcagaaggggaagaatatatacataagtgtccatatatttctatccaagttagtaactttaaataagtatttatctgtaaatagaaataatataaatcacatatgaaataatgtgtatataagtattcatctccaaaatgcttattaaccttaaacatttgtacctttattctcttatactataacatatgagtttttaaatagtttttttttatcagaaagaaatatcttactgaagtgtgaagacatttttaaaaagagcttcattaggaagtcttgggcctaattgttttttgttttataaattttaaatgactgctctgtgatgagcccatttcagttgaggctgtattatttttcctgtgggtaaaatgacatactgagctgatatggacatcacttctcccacttttgctattttaaaaatacagatatgctgcataaacatagcaaatagatttataaacatttagattcaagaaagaaagggaaattcctagatgtcagaccaaagagggaaatctaagttaagcataagcaaaagctcaagctaaactgagcaactggggtcatggggtggagggtgggagacaagtcttagttctaagatcagggctaaagtttggagttttaatgccctcactaggacttgacactaggatttggacccacagacggaaattgcagctgaactccctgaagcagggacactagaaatgctttcagacagtgaaatgggggctagaaaattcttcctgcaagcctacagaggcagctagaaaatttttctcttaggggctctgggtgggtaaaagttactaccttgtgtaggaccgaatccccaaacctgtgtgccacgtgggaatgggatacatttttattctccccttatgtgctggcattcttcaacaagtcaaggaaatgatattcccataggaaaaataatacagcctcaactgaaaatgatctcatcacaaagcaagtaaagtacacaaaaggaaaataactacaaaaggaaaccagtagccacaaaaatgaggatatttgtacacaaagaactagaaagggtagtctgaaataaatttgtattcataaaaatctgtgatcatattcttatcacataaatcataaaaatatgtttaaaatgtacaattataaaagcatgattagaagattgaagaataaacaaagaaggaatagaaaaaagtaatataaaatagacgctatattaaaattcaaaagtaaccaggtttggaaaagaaacatgtataatttacttccagaaatgaaaaaaatatgcagtcattgaaattaaaaattcaatgattgggttaaacaagagatgagaaactgcaggatagaaaatcagaaatataggcctgaaaaaattacctataaattgacatagggaagtaaataaatatgatgctaactgactcacagaattgtaaaattgaacagaagtttagcagaagttgccaaagaagagattagaagaagttgagggaaacaatattcaaaaaaataatgaaggagagaagaatgatcatgagttaaaaactattataaatcctcagtttgaggatgataaaaaataagtctacccctagtagaaaacctgtcaaccagcaagacaaagagaaaaatattaaaactgggggcaaatatctttattgtgagtgtttaccactcacagtccaacttcatggaaagaatattaaataatatatgtcctttagtaagaatattgaacccataagacagtttcactagattatagtccagaagaatcaatctataaaaagcagtagtatttctatatgtcagtgacaagcaaataaaaaatgtaataaaaatacttagaatagcaagaaaaacttcatgatacctaaaaataagtgtttgtaaaattgagataatttttaaaggttattgaagaacataaaattctaaatgaggagacagctgaggatcaccaagtaccagtgaaaatctgtgaaatttgaaatgtttaccatttctattaatagagttaattagtaccacaatttaggagggcaatatggtattatctagtatctttgaaggtgataaaaccctgtcaaccagcaattccacatccaaacatttaccccaaaaaactcttacaatgtatagagaaaaaccatctaaaatgtgctcaacgtaaatgtacttactatgatgaaaatgagaaaaataaatagcaaaaataaattgtagtgtttcctttaatctgataaaagaaacagttaaagtggttgaaatagatcttcatgtataaaccatgataaatttcagaaacttcaggtggaaaaaacaatgtcattatggtattatttatatcaagttgtaaaacataaaacaatgctacattgtttgtgaatacatatattataattaaaaaatttaaatacacttgtagggtaagtactaatttcagaatagtagttacctctagagaaacaggaaagggaataaaacagaagtgaaatgagattcatttgtatctaagtatcattgctttaaaaatatatctgaggcaaatataaaatataaatattttgttacctctaggttgcatgggtaatgcatgttatatgtgctttttgaatgtcttaatataatttctaatttaaaatttctttaattgaatgtaaaaaagaattccagatttaaaaagaggagaatgaaatttttaatacaatgtcaactacattattacattttacacataagattttctcttcaacaatgatgttaatgaatattatcatcattatatttcaaaatgtgaaagcagtgctagctcaagacactcaaatgtttataatatttttgcattgttaaaaatgttgaaatttctctcacgaattacaagaggcaagtcaatctcagatatatgacaagtcattgactataagtgctgtctgactctcagtatttgtttatttcaagtaccatatgctagaaattggctcttttgcagtttggtgtcatattatttatgcaaaatcagttggtatgtagaatctcacacataatataaattgacattgatctagttaggaacatgtgcttttatttttatcaaagtcttataatagaaagataaatagtgaagtagaagactagaaatcaaagtctgtattttcatcttgttttgctttgtttttattgcattttccattaagtccttacaggcccacgagactatgtgatctggccttggcttacctctccagaatgttcttgagtttcagtcactgtttttcagctttgcttaaatttcttgagtctcttagttgtttgtagcatctggaattttataagttctattcagatttcttgggatacctcatttctagccctattcctttgcttagccaggcatttttaatggctcggcttaacttcaactttctcaggaaagctgcccctgcatcctcaagtcatatcattctcatggcataatcacttttcaaacctttttcttttcttttatgatctcataatgagtaattctgttttatgtctatcttacctctggtgatgatatggaccctatatattttctttaccattgcacaataagaagataacacaatgactcatacaaaagaaagaaggaaggaagagaactaaaatctcgtgaagctttgacagtcatttagcctttccgattctgttttataatctatgaaatggtgttattgaatcttttctgcctctcagtaggtataattatcacactgaagccctgtacaagtataaagtataaccataaatacctactggattactttttgttgttgtttatattgcttttcccaagtagagataagtttctgttctttttccctgaaaggatttttatggtgtgttaacatttttattggttttggatttccctcttctttttcatttgtgtacaggaatggtcacttcattaacttgtagacttgattcctgggcatttttacaaatggacttcaatgtgtacatttaatcctgaatctaaattacagatgtagaatttttggcataaaaggttcatgcatgaatgaatttatctcttgcaacccctacagttcaaataatattatgttagtcaattttttacatggacagactctctccttgaccaaattttggaaagtcttctctgagtcctctttttgatgaggcctcatcgttgacccttgtcctcaaacctagcttggttaaagcaagaattctgctaagtcagtgtgttaagaacaccttacccttgatatctgatccctctggcctgtcttcaacaagaatcctgttaatttggtttagcaagaatcccccctacctacccctgatgtctcctcttaatgattgttcgcccctgatccttgctcgtggctataaatctctacccttttccttggcactgaatccctacttgttcatgttgtattgggaatggaggctagttctttactaaggttgctttttctctattgccatagtttctcactgaagcctattttcatcgttttaactactgtccagctctggttctctttcacaatattaaaagctgaacttgtgaaaattgagaactaatgtttatgtatttccttctccctccctaacccatcaactattatctagccttggaaaagtgtgttttaggagtaagtcctcaacaaatactgctaattaactaattatccttcttttgttaacttattttaatactaggatgcattagtctaaaggtcataacagaagaaaacctgtaattaactacaaactaccaaaaaaccaagcatgactgagaaattcctgaagcaattatcacacaaaaaaaataacttaaatgtcactggagctattcctggtaactttgtcagtagtactcccagctgactaacaatcacagttcaatatgtactgctgaagttgtacctagtttataaagcagtagcttctatgagaaagaatacaagaaaactacggtgactatttctccagagaaaaactgtactgaggaaactatagcaaaaagaaaattgatgtcaacacaatagtatctcacttcaagaaatcaaaaacaaaagaacttagtaaaatttttctaattcaactttgtttttaaagggaaaagagaactaaagaaaaaaaagacagccatgattttttgtagcgtaggccacaacattgagctatgttcaaaggaaatagatgtctaaagcacacatttcttcctaaaagaatgaaaattggttctttgggaacaaaaatatcatattgattttatgtaaaggcaaacattcacatggtgcatctgtacataaaatatatctggagtattaaagtttcatggtggggatgattatgaaaaaatgactatataggctccatagggacatgatgataaaaaatagattaagtagattgaaaacactagtctaaagtgaagtgatgtgttttaatatcataatatgtgagaatataaaagtatttacgtatggattatttacaatggaaaaatgactattatagttcatatttcattttattaatgtaattgattagaataatggtatagaaatagcaaaagcagaatatttggttttaagaaaatatggtgatataagggaatgaatattaatttctagagtggaagtctgtagcgttctagaaattaccgtgttttataggctgtagtgtgaaaattatcattaaatacgcaaattgaaaagaatcactaatggactctatacaaataaagtgttaaaatgaatttattggatcaataggagcttcccagtaggaatgctgagaggtttaatagattagactccattttgtttagattaacagttaaaacaactttaaaaatttttattaaattatgtttttgcaaccattgaagtatagataaacaaaaaaagaaaaaaattaattatatgttaataactttttaaaattcatcagtacaaataaattatagaatcataaaggaaaatagaaatctcatgatgattaaaataacattcagtctggaaggtacaaaacttttaccttcatcattcgatatttaggttcaattatattcccatctatgctttagggactgaattggatggtggtaataaggtataatatatggtctgtgccaatcttatggatggcaagaaaagaacaaaattatggttttactgtgtgtatttatttatttatttatttcaataaatgccctttagtagatatttttacatctggagacattctcacatctggaagaggacactgcaacagtagcctattttaatcttgtcatgaaaatcttgggatacatcttttttgctcaactccctggtttttctgtcttatttttttcttcggggcatagtggacactggtgatgaatttggtgtcagatccagaacatgttgtctgtacccctcttacagcagtgattttcttccaccttgtaatataattatctgaagtccgcctcatcagaaagtacatagggaaactatcgtgactctatttctccaagtagaaactgtgctaagggaactaaagcaaaaaagaaaattcctacttcctttgctataatcctcttgagggcatttttatattccctgtgatatctcatatgtcttgtatatagtagttcagctatgagttgatgaacgaataatataaagaataaagcaacgataagaaataatgagcagagcatttattaataatttgatattgataacagaggaagttaaattattcaaagagctcaaccataaagcagatggcttcactttcaagctgggaatcaaaaaactttaagtgctagaatattcatgtcaagaggatcttccaagaataagccaggaatgcaattaggggctgactcatggatgacaatggtcgatgagtcacaaagaaattttgaaaaaacaatgatgtccctggggacacatagaaagaattggaactagactgtcaagatcatatatattaacaagctaatagaaggcgggaaattttggtctctatgaaaatgtgcacaaaagtcccagaacactatacttctgtgtttgaactgtgctactctaaattatataaaatatactctataatgtagtaaagaaagatttctttatgccaatgtctcacattttatagacattttacctgctactgtcaacttaagttactcaagtatagttctgttgatttatctcctaatgaacaaccgctaatgacttaccaattcctaaggaatatctcttaggatggactttctgagggcagggccctggatctcaagtaccaagtgaagttctagcatacaggaagtattaaatacaggctgagtatcccttatccaaaatgcttgagaccagaaatgtttccgatttggtattttttcggattttggaatatttgcagaatacatactggctgatcattcctaatcagaaaatccaaaatctgaaatgctctagtgaacattccatttgagcatcatataggtgcccccaaagtttcaaattttgaaacatttaagattttggattttctgattagggatgctcaacctgcacatttgtcttgaaaaataaataatgaataaacctccaacttttaaaatgaattcttgttcccaatgtctttgctaacatcggtctctcattctatctatgtccacaagttgaatttttaaaccatgcttcaaggatcaggtcaaactccactcctgtcataaagcttccttaagccttatagcaaaaattagtgcttcctctatgttcccgtaattatttatttctcagatgcacttaccatattccaccttgcattatagttgattgtgagtatatctttttacccaactagatattggcctttaaagacagacttatttaaagacagaccttgacttatttatcttcatagtgcctagaattcctaccctaatgtgttgcttcaggttattaaataaaattgaatgtgaaattatttaatcatattttttcaaggtcattttactaggctaaaatggagctaaggaaaatgtagctaatgtctgcaaatttctaattgttgaacttagtctgaatctcagaatagtggcattataagctttcaaattagagtaaatgaaaagtagattagaccaagcgcataagaacacagtatacagaacagctgtactgtgtcctcaacgggataaactaaatcataattacagatatgtttcatctttcttgcctttatactcttttgaagatgctctcaacttcagtgctttggggatttatttgtcactgtaagtctgaaattagtttgattagttttgctgatatctatcatttcaaaatgtctgaaatctgccttaaaaagtaagctggcacaaatcttggggcagtgcttattaaggttcccacatagaagtggctgagtttgtaaatgagtcatagaaattcagtatcaaaaagttaatttaaaacaaattattctcttggatataaggaggactgctttgtttattcttaaatttttctccttacttcttcatgctatttttctcttctcttctgattttccttatatgttctcagattttatcatccctatcttctgctcaatctgggtttgtttaaagtgtttttattcagctcgtactatgcgtatagcactttgctatgcatgaaaaacatgactgccaagagatttatttgaacttaataaattttatgaagctaatgctcagtgctgtaccaggaaccatgttattttctcagactataaagttagtaagacagaatttctacctctgaatagattatggtagatagctagagagaacaatctttgagcaatacttttttgtggttgtgatagggtaatgtatacagggccacgaaaactacatggagagagaagttagttgtccaagggaattttttaaaaagcctcagtattgataataagggaattcaaggaagaggggaaatgtagagaaaatgcgtatgtagggaatattacaaatctgtttcctggaaagcaggatgccttcctttagaattattagttaagattaaccactctttaaattgagagattatatccttccctgtttttcattatatggtcagctttcactggcctgagtccacattttaagctcaactatatacaaataatttttcagtatactgagagtaggattaatgaaaccagtctggagagcagtcacagaatgagaatagatctttcccatagtatcactatgtgactaactgattgtactgatgtgttacagaaaacactgtaaaaagttaaccagaggaaaactttgctttctactttatctgatctttaccccagtttctctacctgtcaaattcctatgcttgcctcaaatgtacatatttttaatctgaaatgtgaaaagtatttataactggtgtaatatcaatgttctattatacatccatgcattaatgtctttaattttaccatgaaattaaatgaagtacctcaataacagaacagtgaactttaaatgaagtagctcaataacagaacagtgaacctaactggccccattttagtcaatctaatgcattcctgcacaggtatttatcatgacatttactctacactcaacctacatgaagatcaacatagtcacttttacgagagtagatttgcatccatccaataatctttctcaccagtgtaattagaaaggatacagcttaacacatagcttttgagcagatttttaaaaatatcattatacgttaaatatagttgagagggtaaaatgaagaatgtacagttaatattttccttatacagacatggacgcagctcataatgttgaaggatacctctgttgctgatacatctctttatttgcaggaaaatgttgaaggaggagactgtagtcgttgcaaatccggcttcttcaatttgcaagaggataattggaaaggctgcgatgagtgtttctgttcaggggtttcaaacagatgtcagagttcctactggacctatggcaaagtaagcaagcaccatttggttctgtttgctgccccagcagccttctttgttgctttcatcgttgttcttttgtatgaacagtttctgatagtgaacttctacataaagttacaggaagaagtaatggaattttcttcaaatgctgttgtgtatttttgctcaaagcctttgaggttgtatttgtaatattgtgtagactggaatttcttagaataggtagacatagtctttttagtgtccatgattactctatgaaacaataatgcaattaaggtttcaactccaagggtgcatgatttaagagagaaaacactacattgtgatatgaattatattttccattactagtatgttcgtatgcaagttgagaaaaactctgtatcatctgtatacataatacatattatccaccaacgctttagttactatttgatgttgcctaggctctttcattattaaaaggggacattaaatataggcaataccttcattctgagttggtttgaaaaattattacttaaactatttaatagcaactgaaattttctttctttaacgtaaatgtgtttacctttctaacttcactgcctacactacccactgccttttcaaatctgtgcaaagagcatgttgtctccctatacagaaaagtgtcagaggaaaatgggaccttctgggaatttcacacagcctgtgtggctggacttaagagtgcagaatggtaggaaatgggctggagagagaaagaagtctagacgggggaatgagaatctagaacttatagggttgaatatactaagaatttgagatattttacttggagtgtcattgaagaaatttaagctaaagactgacattatcagagttgtgttttataaagactactatttagataaactatttcctaaacacttcttcctttcaactttaatcagtgaactaatcctgaacagagctataaaatattttctctgcctgcagtgcttttaagtcaagcctcatattatgaaatattatctatacgttatcaactgtattgctttcagagcagacttcaaagaatcaaccacagatggacatctagtctaacttcctcttttgtttataaagtcccaccccaccctccagactgccccactgatagatcaaagtttcatagccagccaaggggcagagctggtactcaagctttgatcatcagatgctagagacacagaatcccattcaactgtcttacaatgcctcaagggtgacgttagaaagggaagaaatgcaaggaatatattacttgttgtccagaaagtcaacaggttgtacctggtttctatttctcatttaactaagggaattgcagtgattccacagctttgggataagcagagtcaaatagtctatgaagaaattttaaaaaatatttcagccacatagagtcacccttagcattctgcttcccatcacccacaacatgaagcagctcatgcatgtctagtaggttcctggtagctggtaccctaagccctcagtaatcagtgttttgtcctgactaggtaggatgctttaaattagaggtgtagctgtaggcctgaccttggctgaagcataaagatgtaaaaacaaatcattatgcattcccagattcctcctttaaggttccttccatttctgggccagggatctaggctgtaggtccccacagcacttctgaccctatctgaaggaatacatacagtattgccaggtgttgtcatagcaccaaggctggtgggttcaaatatccttaagcctcaaagtagaaattttaaaaagtgggaggggtggaaatactgaatgaaacaccacctttcaggtacttgcatagtttctttctttttccctctgcattacaaatacatacgcaatactttttcaggttgttttttccaaaagcaacaataaactactagtggagtaaaaaatacggaactgaaagtccaactgtttgattaagtgtatgttataaccattgtatgactttgagtgaatttctatttttaagaaagtggtatttggaaccacaattttttaaaaagcataggttcaatgaaaacagattattatagaataccttggaaactcctagaaacatcaaggaaaaaaaataaacaatggaagcctatgtgagtacatataatatgtctaatgatattcataatgctcaggtttttttctaaatgtttgtggtttggttttttttgtttttaatttccaaaagtggacacgaccaggaacatgaaagagaaaagcagctgatagatattttttaaaaattaatgatgactgtgtgttttctctaagatacaagatatgagtggctggtatctgactgaccttcctggccgcattcgagtggctccccagcaggacgacttggactcacctcagcagatcagcatcagtaacgcggaggcccggcaagccctgccgcacagctactactggagcgcgccggctccctatctgggaaacaaagtaagtccacgcttgcttcccgctattctgctttaactgactgatcgtgagaatgggttttagttggtaattcttttaaagaaagacaaaatcaaatacacactgaattggattgccagaaccagctaaatcacattgagttgggcgtttcttccatgttgcacaagaccttaaagagccacggcatccttaatatgcaactttgtatagctgatgttctatgtaaactttttgaatgggcaaataaattaatgaagccgctagtgtattttcgtaaagcaaattataggtattggaagaaactgtgttgtgtttatgtgaaaagagctgttttctggagttgtctgtggtgggatacttactaaagtttttctcatcggtttctatttcatttcaaaactgatactcaggagatttacttttccttctacctgatatgaatgttaattggaaaagaaatgtattacataactaattaaatgcttgccatgaggcttatgtaaacaacatatttgctggagctcaggcagaaactaccctaaaagtgccagattggaagcacgtttgttttaaagcccacacatatgtaaaaacatacacagataaacaaatgtagcagcctcagaaatacaggcttatttttttctgttgtggattacttctatctagatagatatcctggggtttagaattttattttatcttgcctaatactttgttggaaacaaaatttggtgacttatttataaacgtgaatacttgcttgttctgtgaaagttaataccttctcagctgatagttaaaatacctgatcacaccagaaggtgtgatgggaaaatcccttcctaaattaatgttgtttaagcctagtttacacctaacaaaatatagcattatttatgaagaaatcataattgattaagcaaataaaagtatgtttatagtcagtggttttcttgcatgacatgtgagtattgaaatagaaaaacttagtatctcatatgctactcagtgaatgggaactggtggtgttggctggttgaaacacttttaacttatggccagtttcttatatttaacagaactctgaatgctattacaaaaaatgtgtaaatgtctaaaagacattttcaatgaacatgtattttaagagacagagtatgttgcataaaattcaatagctgtaaaataaaaatcgaattaaacttttatttgcaaggccctttacagcaagaagtcattttatcctattctatttaggaaactctggtattcccaaaagaacaaaacagcacataagacttgaatttctactgcttaaaattgccaaaaaaatataaaaatatactgtcaatttaaaaaaaaaacaactgagagctccaagaagagccttaggtcaaaattggatgaatttcagaggccttatttcttatatgatggcaacacttaattaaagtagcttataatagaaatattctttaccagattttccatcctttcttctttggtcatatgcatttttttttctgttggctgacaatcaaactgacagaaggaaagcaagcaaatggaatattcggtagaatcagaacaaagaatttggacatcccattagtagttgttggttcccgaagataacttcccttatcctggctgaaatatttttcttataacccacagtgaagctcttcatattcccctaccgatcattttcacatcaaaacactgttcttgcctgtactgccgtttccattcagtgaacaaaataacattaacagggtgtgcaaattgtttgaatacggaggacatttttaatgtaacgtggaagcccttggtggtttactgtcaggcatctcagtatgaatgaaacaatttgccttaataactgaaccatgtaaatttttgatactacaataatactgcaagctctcagaaattaccacagtacatcttaactgtcatgtcacatcacgtaaattatagtcatgatgacatgcttagcttggttgatttaatatcttgctaaggaagtggaaaattgtagggccttgttggtaaattcaataaagccacttttctaaatagttgaggctaaattctttaccagtaattgctgttcgaatcagaaccattgccagaatctgacagaaatagcgtatcaagatacaagtgcatctgcttaaatattgaattttatttacatccatgaccaggagtctatggtacataatccttcctctgcttttttagtgttatttcctaattggaaaaaattatgagatgctattagcttttcctaaatatttatatacagactttcaaacattttccaagttgcttggttataaggcttcttctaacagaagggcgatatgctgtgcatgttctcttataatggagatgccacatgctgttattctttttttaggagcctaatcccaaataataaaagtggctcacatgggacacatttttgctaacatggatgtctgcctggttgtaataaaactcaagaatactagccaatttagcaaaggagtgctttgtatcctgtgaaacatttttcacatttttactgttttggaataatgaagtataagtaagtgattataagtgtatgtgtggataatggatgaggcctaggaaaacttagcacgtttttatactttctatttttgaaattcccacagtctcagctaggagttgttcctccaattttttcccctatgtaccagtgaatatttggcacaactggcagaatcaagtgttaattttcccgcctcgttcttgatagtcaaagagaattaaatcaggcacccacagggctatcctaggtgcatttcattttcaaaatgcttggcaaatgttaatgcttggttttagggcatttgtttaagcaactaggcagcagtggaaagagctagaggacaaagaatcctgctggtttgctgcaggctacagctattcagaaacagtttgggaatttcagagttgggataatttactgccctagtaaactaagtgctactggaacattgcaacagtcatttgcttaaggttgccctagtggtctgaaatagttgaggcagcttccaaaagcaattctctttgcatctgtaaagttctgggagaagctagcttggcttgtctgctgttcctgcattaccattaaggtttgaaattctctctctgaatattattaaattaatcttatgtgatttgttctttaccaaaacctgcttattttctacagcattatgctatctttctgtttctagcttagagaagcctttaaatttgttcatatagttgccaagaatacctatagtctagtttaagatgcacattaggagagtctgctgacataatagcatctggcttctaaaagtaatctctggtaaactcttttgttttgttgttcttgcttgactttccattctacttcacggatctcaaattaaagctatagatttgaagaaggaaactgatatttgagatttgtaggacagggtagatctcatcatataaaagaagctcaacaaataccttgtaattgatgctacatgcttaacacaaacaaacaaaactctaagaaattgttttttttaggttgctcagaaatgcccattgagttggatttgtgggagttgaaagatgaattctgtcttgctttacaaaataattaaaaactcgctaacaaatatgttccactctcctttgagcagcatattttgtgacttctttgctccatagtcctcaaaattattcagaagtggagttcaaacccctcctcgccatccataacttcctcctatttaaatcttggattaaatgggttagttaagaagatcattatgcaagtgaagaatggtatggctataaaagtaaataggataaatcaactgtggttgattttttattccataaatcagatcccatcaagactaacttggcaatggagtagaaccaggaagaaggtttgctgcctagaataaactgaatgaatttgtaaaccaaaaataaaattctaagacccctgactgaacggacccccttcttggccaagggaatcccaaagaaacctaaagaaacctgaacatcatgggaagggacgattacacattcctcattataccctgctccctttggagtttagacaccacagaccaacagtaacattaaaacagagattttaaaactgactagacagacactttacagcaacaagataccaaattctaacctcactctggtatagcataacataacagatagcaggccctaaaagaaatcaaagtattttataccaaaatatatttatttgacatattctgaaatgaccttgcaaagctgtctcttggggaaatttgcattctatagagaatctccttcccttactaagtcttttctggagagtcagataccttttaaggtctggcaagagacattcaccatcagcctgctactttaccctactaccttgaggcttcatctacatgacaagaaccgtggcttccacaacccactctcttaactcaagctgacttcaactgttcaggcagaattttactctttcgaccaattgccagtcagaaaatctttgaatccatcaatgacttggaagcccccacctcgcttcaagatgtcctacttttctgggccgaaccaatgtgtaacttagtactggtgtatgtctttgcctgcaactttcgtctccctaaaatatataacgccaagctgtaacccagtcatctttggcacatattctcaggacctcctaaggctgtgtcacaggccatggtccttaaccttgccaaataaacctctaaattgattgagacctgtttctgatactttttggtttacaaattgttaaggataaatgagaaaataagtattaaaaaacaaaaaaaatcaaggactcatttatttcccatagctatgatagaatctgctgtgtaaaagtaacacaaatgcaggagctcaaggtcaaacatagaaacctctgtcttacatatccgtcataacattctcttgacgtttttcctaattaaatttataaagcattagttctaatgttaaaaattgttatataaaaagcattttaatattcacatgcatctgtctacagtgttttacattttgtttataattcgtcaactgaatgaatactagataggagaatgttccatttaataaaaactcttgagaaaaataaaatagcttacttaacagtaatttcaatgtgagttggtttgtgatgtggttggcaacaaaacttacgtaatctagggctacattggcaggaatttactggtcaggacaaaggaggtagtgtttatacagattctgcacaaaacgcatgtcacctaatattattattaaatattattaaatattattaatatttagcttacttgtgaatttctctttttatctttgttaatatacatgacccaagtcatcagctaataaaccaagaaatccaaattaggaagaaatagagccaggattacaatccagatgtgtctatagcccattccagttaagcattttttcaatcagttaagtttattagttcttgcaaggcattgatctttggaatagagatgctgaagcagcttattcaaaagaaagggaacgacaaagatatgaatttataaaaatacaaatgaatgagatgaataacaaatgtcaatagaggggacacaaatccaacaagttttttaaatggtttcaaagctctggcaagattaatcaagcaaaacgtgggtaaaacacaaataaacaattttagaaatgtaaaaatgggcataactgcaattacttcaaaaataaacaaataaggaagtatcagaaaataaacaaattaagagtattatgaaaatttacacacaataagaatacaatttagaaaaaggaatatccttctaggaaaatgcaacttaaaaaaactgactcaaagaaaaaaaatctataatgtcagataaacattaaagtaattgaatcagcagtcaaataaaccttccaatgaagttaactccaagcctattgatttgcaagtaatatcaatcaaaattcaaaaatttttaaaaatgcaaaattatacaaactttccagagaatagaacaactgggacgtactcctcacataattttatgtggcttgatataaaatcttgacaagaggactatgaagaagaaaacccctacccaaagtcactcatgaacgtagatgaaaatatcctaaataaaatattaacaacccaaatccatcagtttataaaaatagtcaggctaaattggccaagtggattttatcatccgtgtttgaggttactttaaaattagaaaaccagtttaagtaattgaccatattgactgattaaaagagaaaaaaatcaattatctcaatagacacagaaaaagaaatgggtaaaattaaacattcttcatgtctgaaaaattttgaaaactagaattggaaaagcactttaactgatgaaggctatctacataaaaatcaatagcaaatatcttatttaatataaaatgttcaaagtattgtttaagatcacaaacatgaaacaattctcactataacgactcccacttaacattgtgctagaagatgtggacagtgcagtagataggaaataaaatatatagggatcagaaaggaagaaataaaactcacttatagatgatatacttatctgcttgtaaaatcaagagaatctacagacaaattcttaatcagtgagtcaataaggagactatatgcaaaattaatatacaaaagtcaatcatgtttctttatatcaacaacacttttcaaaaaaaatttttaagaggccatgtataatagcaatacatataaatagtaccaaggattaaatttgtagggaaaagccaatggccaagaataatcaaaagaaattatagatggggtgcgatggctcacatatgtaatcccagcactttgggaggccaaggtaggtggatcacctgaggtcagaagttcgagaccaccctggccaacatggcaaaaccctgtctctactaaaaatacaaaaattagccaggtgtggtgacaaacgcctgcaatcccagctactcgggaggctgatgcaagagaattgcttggacccaggaggcagaggctgcagtgagccaagattgggtcactgcactccagcctggggcatagagcgagaccctctccaaaaatatatatatacacgtgtatatgtgtacacgtatatatatgtgtatatatatacgtgtacacatatacacgtgtatatatatatacgtgtacacatatacatgtgtatatatacatgtacacatatacatgtgtatatatatacgtgtacacatatacatgtgtatatatatacgtgtacacatatacatgtgtatatatatacgtgtacacatatacatgtgtgtatatatatacgtgtacacatatacatatacacgtatatgtgtacacatatacatatacacgtgtatgtgtacacatatacatgtgtatatacatgtacacatatacatatacgtgtatatgtgtacacatatacatatatgtatatatatacatgtacacatatacatgtatatatatgtgtatgtacacatatatatgtgtgtgtatatgcatatatgtatatatgtgagtgtgtgtatatatatatatttagaaattctaaaggaaagaagtggggctttttggaaagggattaggtcatgagggttctaatctccatgaatggaattaatgcccttatgaaaatcttatctgatataaagagttaggacttactttaaaagatataatgactaaggcaaaatgctatcagtgtgaaaataaaccaatagacctgaaaaaatagcccatagatatcacatacatagatgaatacttaacttttattgaaataggcattgcagatcaatgacaatgggatagaccctatacagtaaatggtctggtaccactgattatctagagaaaaaaaataaaatttctgcatccttactccacattatacataaaaataaactccccttgaaacaaatcataaattttcaaaaattatgctaaagacaaacctttataaagacaacacattgagatttctgctcctgaccataattgaataatagtatctagatttccttatctaccttaaacaacaacaaagcctgagggggaaaaaatgtggaacaacagtttttagacactcttccacagatagcataaaactgtgatctctgaaaaagagaaacaaatggggtgaggtttacaattgccccaagattattgcctggggacagtctccagggtgaagtgcattggtatattgagaaaaaagccaaacacagcctggccttgccaaattgaaagacagaggttagggttcatggaggccaaggcagctagcatttgtgaggcagcatacaagggaagaggaacctgacctgcacagagagagagacgaggagagagctgcagctatctgcaaagagaaaccggagtactgagttgcaaatatgtgaaagaaaactacctaaggctaatgaaagaatcactaaaaagtagtaagagaaacaattcctgagctgatacagggctgctaatagtttattttcctaacacccaaagtggaatgtcttcataagagggactaaattagctccaaactacaagctactctaggttcaccccaacaaatcttgaaaacagccttaaaagaagtcaacttattccaaataaattaactgcatgccagaacaaagtccaatactatttaattacaacaaaatccagcactcaacaatgtaaaattcatgatgtttggcatcaaatcaaaaactaccaggtacataaacaagcagagcatataagccactaccaggaggaaaatcaatcaatggaaacagaaccccaaatggcaagaaaatcatgtcaagatatatcagaatcaaattattaaaaagacagataactggaaaattgtaaaagcaatcagaaaaaaactaacatggccaggcgcggtggctcatgcctgtaatcccagcactttgggaggccaaggcaggtggatcacgaggtcaggagttcaagaccagcctggccaatatggtgaaaccccatctctactaaaaatacaaaaattagctgggcatggtggtgcacacctgtagtcccagctgctcaggaggctgaggcaggagaatcacttgaacctgggaggcgatggtttcagtgagccgagatcataccactgcactccagcctaagcaacagagcgagagtctgtctcaaaaaaaaaaaaaaaaaaaaaagaaaagaaaagaaaacacaacaggtgcagaggaacaaagataaggaagaatagtttcttgtcagaccctatatgctatggtccaaatgttggtgtccccctaaaacttatatgctggaacctaatgcctaatgtgatagtatttagaggtggggcttttgggggagtgattaagtcatgagggctctaatctccatgaatgggattaacatccttacaaaagaggttgaggatgctgccttgccctttcctttacgtgaaggggcagcaaggaggtaccaccttggaagcagagagcaagccctcaccacacatcaaatctgctgatgcctggatcttggatttcctagtctccagcactgtgagcagtatatttttaatgcttaaaaactacctagtccctgttattttgttgtagcagcctgaatgcatcagtacactttgcaagccagaatacaatacagagatatgttaaagtattaggaaaaaacaacgcaagcaatcaaatgaacaaaacaaatactatcagtctataattctttaccaggcaaaaatgtcttccaaaactgaagaaaaaacaaagattgtttcagagaaatagaagttgaaagaatgtgtcacagactgatgtacacaagaagaaatgtagaaagttcttcaggcaaaagaaaaatgttaccagatggaaatttactcctacaaatagaaattaagtgtatcaaacaggtgaatagcaatgctttgtcactagtgctagctgtcacaagacctctagccagtcatgttttcagctgtagggcctaacaccatggttaaggaatggttacctaaatacacaaacttaaagtagaacttcaaatacttcctgtataaaattttccctctgaagttttaaaaagaaagactgggttgtaagaagagtataaaaaaggcttgcttctccagctctcatttctcatttcaaacttaaagaaagaaaaccagcaccaatttgaaagtgtttcaataaactctcaatgtaaaacttcacgttgttttctgtagcttttcagtaacttcttacactcatgttctatgtgcggctcagtggggaactatctgtatccagtggattgttggttctgacacactagcctacgtgcatatggggcaacccccaacatgctggcccctgccacttgcaatagatcagacccaccccttgtggttgagtgaggcagtattatgtcaattctaaacctggcattttgtttactgttgttgagtgttgttggtagtgggagaagaaaataggtcacagacagtgtgaagacacaaggagaagacagccatctacaagctaaggagagagggctgcaacagcttaattccttgtagtgttcataaagaaccaatcctgctgacagcttgatctcacatagcaaaataatacatgactttttttcctccttgatttccatgagaattgggtgaaagctattactcatataagcggatgacctgattctctcatttttgtggttacctttgattagtgttttggtctttatgcgtttcacagacctgattcaaatgctggatctctgctttattagctttgtgatcttggacatatcccttaatctagttgagccagattctcattatctgcaaaatgaggcttctagcacccctcagaattgtacaaagctctcgaaaatgtccttagcacacagaagctgtccgataaatgccaattgctttatgaatttctgtagttgtatgctgcagtaatttattttggagatcttccttatatcagtaaaagacgtttgttaaaaaacactttgtcacctgtctgacatagtatctggtggtagtaaggataagacatcattaaaaataaaaattgacaatcagagagagttaattttagcaagtacgtagattatatgcctttaatggcagctttgcagcaaagtgcaaaacataaataaatcagttaaccagatttgtgaaatacccgcagagtgttttagactttattttgaaggtgccaaattagagctaacatgcatcgcttcatgtcttcccaagaaaattacatgacaaatatctatctctgcttcactgacaacctggcagtgaaagggatttgaggtttgtgcccatcagtaactaattagagaagtaaatgttataactagtcagtattctgtggctacaatgtggcaagttaaaataatatccttaaggtgggcgctaacgcaatatgactggtatccttatgaaaaaaaaaaaaaaggacaatttggagataaacacaccgacagggtaaacaccatgtgaacatgatgatggccattcacaagcaaaggagagaggcctggaacagattcctcttagccctcaaagggaactaaccctgccgataccttgatttcagacttgtagcctctagaactgtgaaacaatacatttctgttgtataagccacccagtctatggtattttattatggcagccctagcaaaccaatacaaatcataaaacatcaattatttttaaaatctcataattttcattcttgttatatatatataaaacaaataaaaggtgactctctctaatgtataaagaagttaaagaaattgataacagaaaggccagcagtccaacagaaatgaatgagcagtttatagagaaggaaatttaaatggctcttaaatgtatgaaacggtactcaacccgactcatagtatgctaactacactgagaaatcattgtcttctaacatataggaaagtcaaccaaatgaataacacatgccattcctgtggcttcttcaggaacaaaggtcctcctaaattggtagtgtgaatatacattgatgcaatccaaaaaaaaaatccaaagttatagctgggcagggtggctcatgcctgtaatcccagcactttgggaggctgaggcagatggatcacgacgtcaggagatggagaccatcctggttaacatggtgaaaccccgtctctactaaaaaaaatacaaaaaattagctggacctagtggcacacgcctgtagtcccagctacttgagaggctgaggcaggagaatcgcttgaatccaggaggcagaggttgcagtgagcagagatcatgccactacactccagcctgggtgacagagcaagggattccatctcaaaaaaaaaagaaaaaagaaaaaaaaatccaaagttataaatgcacagtcttacatacttctcttctgggaatttattctgtaagtatatatatatatatacacacacacacacacacacacacacacacacacacacacgtgtgtgaaatgacatatatgcaaagtgattcattccagaaatgtttgtaattgtcaccacaaagctgccaatcactgagagactgattaaatgagttttggtacactcgtgccatcaaacactataaaattattaaaaaaggaaggaagatttttgtataataatatggaatgatccaaggtgtattttaaataaattaaacttaggaggccaggtgcactggctcacgcctgtaatcccaacacttttggtggttgagacaggcagatcactggagaccaggagttcaagaccagcctggccaacatggtgaaaccccactctactaaaaatacaaaaattagcgggtgtggtggtgtgtgcatgtagtccccactaccagggaggctgaggcatgagaatcacctgaactccggaggcggagattgcagtgagctgaaattgtgccactgcactccagcctgggtgacagactgagactccatctcaaaaaaaaaagaaaggaaaagaaaaaaaggaagggaagggaagggaaaggaaaggaaaggaggaaggaagggagggagggagggaggaaggaaggaaggaaggaaggaaggaaggaaggaaggaaggaaggaaggaaggaaggaaattaaacctaggaacaaagtagtttatctatctaatctatatgtatgactactatttgtcttttaaagtggagaaacgaatatgtccttgtaattataaggtgacttagctatttagagtcacatctagcatttgcatcaaggtgagtttgtctcaaaagctctgttctagtgccccactcaagaacagatattgtcaaatttgtaaaagatattttaactggaatagacttgatttttattgctgatttaatctattacaaactattgcttttctattctaagctgttgtaaaaattattgctttaatatgatcacttaataagcattaaatgccccaatcctatctgctaaaaattgtttggcatgtttaattgatcacaaggatttgaatagcactcttatcttttcaagtatcttcaagaaattcttattttcagcagggcatgttgaggaaacataaagcttacattttttattcctgatgtcttctcatcacttccaacagtagccactgagtcaaagcagttgctctctttccttactttttctaaagctctccctctatattagctgtgtctgagattgcaggcagttaaaatccaacatttggcacactgaaaaaggggctatgtgatagggcctccaactgaaatgtgatgaattattaaacaggtagtttgttgggtgattgaaaattacctgtgaaagagtgcttatctccttgaggcacatcgaaagctgacggaattgagccaattagactgactgtctcttcaatgagttgtgacctatcaatggtaatagcttattatgatgataaatgaacccatctctcaaactgaagcctgagtacacacttcagcagttgccttgaatcatgaggccattgcctctcaacttcagatcgacagcagtgacagccacaggagcagagagcatgcatgactagacacagatgattgttttactcagatgaatatatttacagctatttccaaagaaacgggcccttcttttgcattgtgtattcgtatctgaaatagttaccatatgacgtttccttcattaggaagagaacccctccctggctgtagcattctgaaataactggattttgaaggtcttttttttttcttcactttttgtttattgtttacaatgttttaatttctcattcttgtgagtaataactcaactcctggttaagtaaaatttcagaataaaaatattgttttatagtaaagatgcttgtaatatcaaaacaagtatgtttttaaaaaattaatttcatcctattacatttcacattttatatttgatgtgggttggaggagccccttagagattcttttttctttgtagagaagttttgtagagatcaatagtgtaagaatcatacaagtgtaaatagttttgtttccttttaatttttcaaaatatttgaaaattctttaagtagttactgaaatttggtaagttccatgtgctgctatattgatacattttgttttagaagaattaggagcaaaagggttatttttataatgaaatacaatcttccagttcctaataagtattagacacctgttagctgccaacttcccaaaaatacccctgagaaaaaaaaaaacctgttggtcaagaaagttcacgaagttattacagtaaacaagaacatcaccttgatattcttagtaatgtctcagaaggtgagggtcaggggaagatatttacaggctttagggaaaaggctggttgatttcaaggcaaatcttgagtgagagggaactggttgggattctgcagggtttattatataatagttttggatttgtcaccagagtgaacaaacattgaagaacatgttatgagtctataaggaagttagcttagatggatcacagagcagacaaggttttcttggagattgctcacagcattcttaaaatagggggtggacatttttcttactcccagcattatttagcacaggaaaggaaattgtgttagcgttagaagaaattgtgtttgctttagttcttacagacaatatatttacttaatcttctgtgacactgtttcttaatgtataaaatgaaaataatatgaatacctactttatagtgttattttgagggttaaatgagttaacacatatgcagtactcaagatggtgtctgaaaatgataagcatttggtattagctattattattaactccaactgggcttaatttgaggtcaggcattattttgttgaaattttagaaagactcccctcacacataaacagacagaaagagagagaggaagaaagaagaaaagagagagatagagagaggcagaaagagaaaaagaaagaaagagagaaagaaaaggaagagaaagaaagaaagagaaagaaagagaaagaaaggaggaaggaaagaagagagggagaaagaatggaagaaagaaagaaagaagaaagaaagaaggaaggaagagagggagaaagaaagagaaagagaaggaaagaaagaaaaaggaaggaaggaaggaaaagggagggagggagggaaggaaggagggagggaggaaggaaggaagaggaagcagggagggcaaggaaaggaaaacaatggaaagaataaagaaataaatgcagcaggaaaggaaaaagaataggaagaatttgctcatatctgtctaatttttagggtattttgatatacaaagtaactgactgtcaggacctgtcttagagatgatctggtaggacagtaaatggcttttctttccagttttcatctgggactgggtttgaagtgatcatcagcctcagtgttctggaaataagtcatttataatgaaatggaactggaaataacccacagacaaaaagctttgcaagccattgaagttcccctaggccatttactgccttaagctcgtttttactcatactgcaggaaaaaaaagagtgagtagggaggtggtgttcttatatcacataattttaaattaagatgtgatggttttatataaaagcaaaaatgctttattttgctttttttgttcaagacaagtacagggatgaaatgtaaatatgttaatatctaatcttaagtctgctcttgatccgaaactcttttgaaactttacctagaaaatgatagagcaatttaatgtgtctcacaatctagcagagatttggagggtgatggatagaataagggcttaacacaagaaataatttctgttgtacaaagctcatgagcttcatgcatggtgaaagatatttaggctaaagaaaatgttaactatgcagggaatgaaactcgtgacagcttgatcccataaaactcagcaaggatgaggtttgactctgcatccctgatttatatagtacagtatgtttatttaaaggagataagccaggttaaggggttcagcaaaactgttaaattaactcctttaaaaatctagttattgctatgaaagtctctcaagtgcggtgctcaggcttttttgcatcagtcatctggagtctttatttaaaatgtttattattggccgggcgcggtggctcacgcctgtaatcccagcactttgggaggctgaggcgggcggataacgaggtcaggagatcgagaccatcctggctaacacgatgaaatcccatctctactaaatatacataaaaattagccaggcagggtagcgggcacctgtaatcccagctactcgggaggctgaggcaggagaatgacgtgaagccgggaggtggagcttgcagtgagccgtgatcgcgccactgcactccagcccgggcgacagagcgagactccatctcaaaaaaaaaaaaaaaaaaaaaatttttactattgacccttactctggattcacttatccagaagatctggggaaatctacgtttttaatcagctccccaagtgattatttacccataagaatttggggggcactcttttatgactacttttttaaattactgatgattaattatctgcagatagttccctagactttgactttccaaggctttaaaaaaacaaacaaacaaaaaaacctgcagtatgcttttagtctgaattcagggattgactttcttatccaatagtctatcctgtacaagggaaccctaaaataacctcgttagccaccaccaaagactatgtaaatacaaatttatttatcaatctcattagaaaccgaaccacgcatgtgcacgcacacacacacacacacaccacaccaaccacacatttacattggaataaaatgaatcttagaaagcagctatttttaaagaaacaggaagtctaacatgtactgccattaatttggaatgggagagaaaggagacttggcagaaccagaatattgcgtgaggattgaagatagcttcagattctagaagagtttctagctctttctgaatatgtgttaacagtttcgctgtttgagctctgctacccactagccagttataaacacaggtaagacccttaacttcacagggcctgttgggaagaggttataattttttagcaacagaacctgtttttcaaacaaaatcctaattagaacacccaaaaacaaacaaaataaaggattcaaatgggtgacatggccagtcctggttacagtatgagacagatgccggttacggtgggcaacagaacagatgctggctacagtggtcgacagagttcattttagttcaagcagaaggtagggctggtgcttgttacagtggccagtaggcctggtttctggttatagcacatggcagagttaggagctctacctacattatgtccccacggcctcatctgtggtttccccataagaaaactaccttttgggaaaacatgatacaaacagatcaggtgaattagaaggtctcctgcagatttaaaattttatgaatataatgccaaatataatcttacactcagttgactactaataataaataaccctacaaaatatggtaaagtgactccatgacaacaattgaaaagaaaataattgcactcagctgagctattgtccatatctagatgcactgatgatacacaaacccagccacagaaaatgtggcatgtgtcagagcaaagcaactagaatgattcaagacactgaacagccagtgttcaagctacgtaatttcttacctatattacaggaaaaaaccatctaactctttttctacctccaacctccctcctctgaaatgttattcacatacctggtggagaagaatctttataaaactcaaatttgattaccttagtcctctgcttaaaatttcagtgtctttcaatgaaagctcagagaccattctggacttataactcccttgcagctcagaagggacccgtggtccagtaattaaaatgcccgtggtaagtgttcaatgctctctcatgcttttcttctcacaatgtcccttcagtacgggatttctttctaccattttcctgagtaattaccttctagtcatcattcaaaaagcatttaagcattgaattctataggaaatgtttctaatcaccctatcccccagctctggctgagttaggccttctctgcacaattcccatgaaagcacctaccacccagcaggcagaaatatccctctttgactttctcactaaactgcaaattcctggtgagtgacaactggattctattcttcttctaacctctagaacctagcagattgctttggagaccttaggaacttaataattctttgttgagtgaataaagggatgctttttgtggacagcagttatttctgtttacacaaaagataagagaaaatacaggtaaaattatcctaaattttaaaaaatttgaaacttacaaaaagtgttggatttaagttcctttgtctgtctggatttccgaaatatttttaaaagattttttctgggatcatttaaggcctcatctgttcagaaccaaggggaggaccgaaatagtatgccaaattcttttccagccctcaaattttatgagcctgagttgcattgtgtgggtaaaagtcttgtgctctgtggatcaggaggaagttagatgttttggatatttacatagaaacaaagaatttgaagactggaaagaacttgagcaggactctattaaatgtgttttgtgtgagatggttttcaccctgtgttcttgtggttcctccatgctaggggcaggaggtaggatggagcagatagggagtctcttttcctcttaaaccggatgttttttttaaaatcagttttatatgttgagagtccatggaatggaatgtggaaactgagaccctgaaagattaagtcacttgaacaaagatatacagcttctccagagaccaggcagacactaggtttatgatttcctgacttccactgcagatctcttaccatttttctatgagagtcataaaaaaagaatcagctatttactttctagtcaaggtgggttaaaatcaagccacttgttttcaaacatcgatttcgggttcatgccatcaaattaaaaaattcacttaactgagtttaatttgctttcacttaggaagcagctgcctttcaagataataaaataaacagatacaataatatttggtcagctgtggcttttaatttaaatgtttgatttaatgttgtttagtttgctggattccaaaatattctctgcaagagaagcatacacattctaaagcatttcaaatgtttattatgatgtcctagaggtggctgtctttctgttgctgtgcataccctgagcagacttgacattgctttggaagcacatattttctgatagacatattactctcataatctaaaatttttcagaagtgacaaaagtggggttgaccattttcttcttcgctgtctccatgattttgctttttccaagatgtcatgtagttagaatcatacaatgtgttgtcttttcaggttggcttttttcacttagcaatatgcctgtaaggttccgccatgtcttttcttgccttgataattcatttctttttagctctgaatactattttgttgtctggatataaccacagttgaattatccatttacctcctgaaaaacatcctgcttgctaccatgttctggcaatatgaatcaagctgctataaacacttatgtgataagtcttgtgtggatataaatattcaacttatttgggtaaataccaaagagtgcaattactggatcatatggtcagagcatgctagttttgtaataaactgccaaactatcttccaatatggttgtataattttgcattctcaccagcaatgaacaagagttcctgtttctccacattctcaccagcatttcatattgtcaatgttttagacatcagctattctaatagatatgtagtggtatatcgttgttttaatttgaaattctctaatgatgtaagatgatgagcatgttttcatgtgcttattttccatctgtatataagctttgctgaggtatctgtttagattttttccaatttttaaatttattttcttgttgttgagatttaagagttctttgtatgttttggaccatatcaggtatatcttttgcaaatattttcttgcaaatggtagtttctcttattctcttcacagtgtctttcacagagaagatgatttttaattttaataaaatctaaaatgaatttttatttcatggatcttgactttagtgttatatataaagagttactgcaaactcagggttatttagattttcttctatgttatcttccaagagtcatagttttgcattttatatgatccattttgaggtctatgatccattttgtgttaatttttgtgagggtctatatctgcatttatgtattttttcacaagttatctcagtcaattttctgttgctataacagaatacctgagactaggtaatttataaaggagagagttctatttagcttgtgatcctgggagcttgactaggagatccaagttaggacaggtgcatttggtcaagttctggtgagagtcttgtgctgcatcttaacatggtggagaagtggaagaaaaagtgggcatgtgcaaaatgaccaaacacaagagggagccttcctttttaacaacccaccctcgaggtagctaatccagtcctacaagagcaagaactcactctaagaaaggtattaattcctttttaaaaacctaatcacctctccaaggcaccacctctcaacatcaccccattaggaaccaaacctcactatggattttgattgtgacaaaccatattctaaccataacacaaatgatgtccagtttttctagtgccatttgttgaaaacactttcctttcttcattgaattccctttgctcctttgtgaaagatcagatggccatattcatgcgggtgtatttctgggctggctattctgttccattgatctaagtgacttttttctgaccagtactatattgtcttgataactatagttttatactaagtcttgaagttgggtagtgttagctttacaagtttgttcaatattatttaatgatgtgttggctgttcttggtctttcctctccatataaattttagaatcagtgtgttgatatccaaaaaataacttgctgggattttgactgggattaccttgaatctacacaaattgggaagaactgacatcctaccttgagtcttcctatttatggacatggaatacctctccatttatttaatttttctttgatttctttcactggagttttatagttttcctcatatagattttgtacataatttgttagatttatattgaagtgttttgtggagcatgctagtataaatggtcttgtgtttttaacttcacattccaattttctttgctaatatataggaaagcaattgacttttataccacctttttcttcagacagatggaatcaagtgacttagaaattggctttgttgctctgcctgagtatcttgaaaattctcatcttccttctgagaaccataacctacatatctcaaggttatagataaaatgctacctacaaaatccttgtaatgcttacagtctaaaagactaaataaggcctcaagagattattcaaaatcagagttgttgattcccagtagagtcataaagggctatgttatgttagctgcaattctaatcctatatcaaagcttctgacttccactcccccatatctaaggaggtttccctcaacagttgaaaaataactgcagatactgctttgccatcccatgccacaaaaatgcatttctgaaggatgctgcagagagatatatatttcttaagcccagctcatatctatttctcaaggctgtgtgatatcatagaatgaatgatggagtcaaataaataaatatttatttatttatttatcagtcaaataaatctgatttaattttttagaacttaacatttagtagctgtgagatcttacagagatttcttcaccttgtatcctttgtcactttatctataaaatggagagtgtaaatactacttcttagagttatcatgattctttaatctaataactcatgagacactggatatgtaataggaactgaataattcttaacccccttgctttcccttgacatttccagaaaataaaacttgattgagtatctaagattatataacagatcccactagactaagtgaatctgagggaagatgtatttgtcacttttcttctcttctttggtttttaaaaagtatcattagaaatagaatcagtaactataaacaaatttctgtgtactgatccagtattaacagagaaaataatggttgactgtgccttactgtgcaaggcaaaaatgagctcaagatattatcaaagtcatgaatcagaaagagaatttcgttttacaaatgatggatagccacaaaacaactaggacatacaatctctgattacacaactgcagtctatagctacattctgcagattaaacaccacagtagagatggaaactttattgtttatattttatgaaaactgttctcttttgtttttatgtcagtttgagagtagaagaatatccttgagggcaaaacatgcctttcatacattagagctgcctagagcatagtctggcacattatataaatattaaataattcctataattaaactgatgttctttggaatgaggatggagacacatagttatctgaattgccttaagctagttttgcaataagtagatttttactattctagaatatgtaatgaatgaatcatgctatgttacaagtaagtattaattaatggttgaagtacaaaaacatcttccttgaattatatgataatctacatcacagtgaaaggaatttatcatgacaaatgctagtcaatgttgaatcacagagggctatatgagatccattttcattcttaaagaaaattattatatctttttattaatatggtggatatttactcagtaaataataaagaaaactaatatgaagtgcaatttgtaatattctatttatgatgcatgatttttgttgcacaattagaaaatacttaagttcttgagaatagttggaaagggttgtaatgatcagaaacacatattatacctaaacatgtattaagaccttgttttaaaaattagatcttggagcaagaaggtaagctgtatcattacgttcttagaatacagggttgggcgtgggggctcatgcctgtaatcccagcattttgggaggctgaggcgggtggatcacgaggtcaggagatcaagaccatcctggccaacatgacgaaaccctgtctgtactaaaaatacaaaaattacctgggtatggtggcgtgtgcctgtaatcccagctacttgggaggctgaggcaggagaatcgcttgaacccaggaggcggaggttgcagtgagctgagatcgtgcctctgcactccagcctggtgacagagcgagactccatctcaaaaaaaaaataataataataataagggtaaatacaaggagtgtgttttgaatacaaaatatctatttttagaatctcaaacccatgagttactttcttccatatataagtcccaacatgttttctataatcagtctatgtctattagatgtgtaattatattaattatgtaaatgcacatgaataccaaattatttggttaatcttcgaatttcttttagcaattatatactctcctccaggttagattgagctttcccttcaactcagagaaatcagtgtcaacaggctaccttctgtaagactaccagagagctatgcattactctgtacaaaggatatttctcctataaatagtgctttcaatagagaaaatctgttatcatgttgtcagtaaattcaaatattttctcttttggaatactctgttcctattaaaacaagagctgtttccttctttgaaacaagttatttatatttatgtggttaagatatcctatcttaaaccataagacctttttgaatacttcacatacagaaaaatgaaaaaaattaaacaaatatcagagttgctgggaaccccaggatataatctactgtggatagtcattcatagacaaagacacctcctatttataggcttgggacagttcagcttctccaacttgaagagagttttgaagatcaaatacaaatgggtcttgtgaagtttcaaaaaatgtttctcaaagtcctttgagaaaaataaacttgggcctgtagccaatagtttgtattccaggcttttaaaaaaaattcaaatacagaaacatcagattttcattgccataggggtcatgacatcttttaacataagtgcagaaactatctgtaatgaatcaaaacttaaatcagatgacattaagaccagctttgctattaccacagatggcatcacaattaacttttaatatatcaaaaatgtgagtgtactcatatattatcagtcatttgatcatgatattccaacattaacatctcagtgtattgtgaaaatgattcatttgtacaatatttttcttcttctagacttttaatttcttgaaggaaggaacgcattttactcatcttgtagtgaccctccctgtacatgttgcctgagacataataactattcaaaaatgtttacagtattcaatgaaattatataaatcttggtttaaaaagcttgatatacaatgaaacatacttgggcaaattataaagctgttcctgagaatgagctaatacatatttagttgttaaaattctgaggggaaaatgtaaattagatgtgaactacctctacaatataagatagcagtaggctgtaagttaaaataatcatttttctcatttttcagtaacattcattaaatgcctgatacaattctgtactttctgaaaattgactataataaagaaatcctggccattataaaattgtcatccactcataggtagaataaatgagagaattatggtgatctaaatatagaaagcatttaaattagagaacagctgaaattgtgcttctaaaacatttcagtgttgttcattttctatatgttatattgaaaaaagtaatatggaaatgtaatgttttcatttgcagatgcttaaatttagatacatgtttaatactgtaatcattttgatcaaacagcagctattatttattattcaatatttatatgtaaaacctgaaactttcatctaccttaatgatggtattgtgataaaagtacccatgtatcaccaagatttgccaattctttttattccttaaagaatatctgacaatttgctggtttgtataagtttgagttaagacaccgtaataatgtcctgcagtatatatgtcaaaatacatgggtcaaaaagacactctaaaatagcagtctccaagaacccaggaagtatgtgatccataggagtgtacatattttattttctttaaaaaataagacagacacttctcaaaagaagacatttatgcagccaaaaaacacatgaaaaaatgctcaccatcactggccatcagagaaatgcaaatcaaaaccacaatgagataccatctcacaccaattagaatggcagtcattaaaaagtcaggaaacaacagatgctggagaggatgtggagaaataggaacacttttacactgttggtgggactgtaaactagtttaaccattgtggaagtcagtgtggtgattcctcagggatctagaacttgaaataccatttgacccagccatcccattactgggtatgtacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaaggacaaaaaaacaaacaccacatgttctcactcataggtgggaattgaacaatgagaacacatggacacaggaaggggaacatcacactctggggactgttgtggggtgggggggaggggggagagatagcattaggagatgctaaatgacgagttaatgggtgcagcacaccagcatggcacatgtatacatatgtaactaactggcacatggtgcacatgtaccctaaaacttaaagtataataataataaaataaaaataaaataaaataagaccattaaaaaaaagttcatcgtatggattgacactgggctgctccctggtggagtaccagctcaagatgttttgaggaaaaaatttgcatttaccaagtgggaggatttatagtggtgatttcacttgttcattgatttagacatatgaaatattatattttttgcacaactaagttggctttcagattatatgaccatatttttaactaaatgaagctttgctgaataaatacatgacttaatatattccttcaaaaaacatatagtgaaataatattaactacacaaagataagcaatgagcaaaaaaacactagtgcttaccactgctcttggtaagagctttccttcaggcacaaaatgagataaaagtaatgacaaggtaaaactggatgaaaattggtcaacaagtgaggaattaactgccttgcaaaagcagtttttattatacagaaaccattttgaaagcagttattcagaaagtttctatcagtatatgatttgtagctcaaattattgttggtctatcaatcacaaatactattttctgcataatatagctagaaaatataattatctaacttatttttaaagtcttctaaacatgaagtttcagtgagctttgaagctttttgttaaatatgttaaaatgtcatactttccaaatagtttccaattataaccaattagcatcagaaaatttattagccaaatttcaccaagaacctaatttgtgagagaattgaaaaatgagtaccataatttagtatgctcagccactgatgtaatgcttataatgggacctgtgtattttttgtctgtgctgtatctcttttcagctgtgaaaactattattactaagtattaaaacaaactgagggcaaggcacggtggctcatgcccgtattcccagcactgtgggaggccgaggagggtggatcacttcagatcaggagttcaagaccagccttgccaacgcggtgaaaccctgtctctactaaaaatacaaaaattagccgggcatggtggcacatgcctgtaatcccagctactcgtgaggctgaggcaggagaatcgcttgaacctgggagacaagaggttgcagtgagccaagatcacaccactgcactccagcctgggagacagagcaagactccatctcaaaaaaaaaataaaaattaaaaaaaaagcctgaacctagaaacggacctacaaatgtcaatacttagtaatatttttaattattaagccaagatttccaaaaataagaaaagcataattgattatactggtttctttttttttttttttcatttggaacatataattgagaaagctttagtatcaagcatatgtaaagactcataaaataataaggaaaggccaaactgcctgatagaccaaaaaaaaaaaaatcaacaataaacattttacagaggagaaacagagaaacatatacagctaaaaacatatggaaggatcttgagtcttatagcaatattgatgagcaaatcaatatgtagaatagcaaatcagtatcattatcaaagagataatggatatctctttatactcaatttattggcaataattaagaatttaaactacagaaatattgaaaagtatttgaatcaaccagatttcttatatagtgctaatataaattggttaaccacttgacattatcttttaaagtttaatattcacacaccctatgacccaacaattttctagatgtatatactaaaggaaattattacatttgtgcacccagataaacacataaaagtgttcataaaagtactgtttatattaagaagagccgacagcagatgcctatccagaggtaaacaaattgtaatatatctggaataacttgttgcaatgaaaataaatgaactacaggtatacgtgataatatgatgcttagtgataggttctcagatgatcacagcatgatggtctttataagcaataacatttttgagcaaacatatatttgctgaaattatctttttaaaaatgtaagaaaataatataaacacaaaattcagcatgtcagggttatgctgcagggtaacggggtggtgaggattgtatagatagttgcaaacattgctcatgttcaacttcttgggttgggtagttggcttttatcactaacaaagtaataagccagggaatacaatgggtaaatgaaaaaataaaatagagtcacgattagaccaatgatgatagtatatcataaatcaagtcttctcatctttaaaatggaattagtaggagtacttagcttcctagggttgttatgaaggttgaaattcttagaataatgcctggtacatagcatttttttttttaagttaagttctagggtacatgtgcacaatgtgcaggtttgttatgtatgtgtacatgtgccatgttggtgtgctgcatccattaactcgttatttacgttaggtatatctcctaatgctatccctcccccctccccccaccctacgacaggccccggtgtgtgatgttccccttcctgtgtccaagtgttttcattgttcagttcccacctatgagtgagaatatgcgatgtttagtttgttgtccttgtgatagtttgctgagaatgatggtttctagcttcatccatgtccctacaaaggacgtgaactcatccttttttatggctgcatagtattccatggtgtatacatgccacattttcttaatccagtctatcattgatggacatttgggttggttccaagtctttgctattatgaatagtgccgcaataaacatacatgtgcatgtgtctttatagcagcatgatttataatcctttgggtatatacccagtaatgggatgactgggtcaaatggtatttctagttctagatccttgaggaatcgccccactgtcttccacaatggttgaactagtttacaatcccaccaacagtgtaaaagtgttcctatttctccacatcctctccagcacctgttgtttccagactttttaatgatcaccagtctaactggtgtaggatggtatctcattgtggttttgatttgcatttctctgatggccagtgatgatgagcattttttcatgtgtctgctggctgcatcagtgtcttcttttgagaagtgtctgttcatatcctttgcccaattttgatggggttatttgtttttttcttgtaagtttgtttgagttctttgtagattctggatattagccctttgtcagatgagtagattgcaaaaatcttctcccattctgtaggttgcctgttcactctgatggtagtttcttttgctgtgcagaagctctttagtttaattagatcccatttgtcaactttggcttttgttgcccttgcttttcgtgttttagacaaaaagtccttacccatgcctatgtcctcaatggtattgcctaggttttcttctagggtttttatggttttatgtctaacatttaagtctttaatccatcttgaattaatttttgtataaggtgtaaggaagggatccagtttcagctttctacatatggctagccagttttcccagcaccatttattaaatagggaatccattccccattgcttgtttttgtcaggtttgtcaaagatcagatggttgtagatgtgtggtattatttctgagggctctattctgttccattgatctacatctctcttttggtaccagtaccatgctgttttggttactgtagccttgtagtatagtttgaagtcaggtagcatgatgcctccagctttgttcttttggcttaggattgacttgggaatgtgggctcttttttggttccatatgaactttaaagtagttttttttccaattctgtgaagaaagtcactggtagcttgatagggatggcattgaatctatgaattaccttgggcagtatggccattttcacgatattgattcttcctatccataagcatggaatgttcttccatttgtttgtgtcctcttttattttgttgagcagtaatttgcagttctccttgaagaggtccttcacatcccttgtaagttggattcctaggtattttattctctttgaagcaattgtgaataggagttcactcatgatttggctctctgattgtctgttgttagtgtataagaatgcttgtgatttttctacattgattttgtatcctgagactttggtgaagttgcttatcagctttaggagattttgggctgagacaatggggttttctaaatatacaattatgtcatctgcaaacagggacaatttgactacctcttttcctaattaaatacccttcattactttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttggcatgaagggctgttgaattttgtcaaaggccttttctgcatttattgagataatcatgtggtttttgtttatatgctggattacgtttattgatttgtgtatgttgaaccagccttgcatcccgtggatgaagcccacttgatcgtggtggataagctttttgatgtgctgctgcattcagtttgccattattttattgaggatttttgcattgatgttcatcagggatattagtcaaaaattctcttttttgttgtgtctctgccaggcttttgtatcaggaggatgctggcctcatcaaatgagttagagaggattccctctttttctattgattggaatagtttcagaaggaatggtaccacctcctccttgtacctctggtagaattcggctgtgaatccatctggtcctggactttttttggttggtaggctattaattattgcctcaatttcagagcctgttattggtctattcagagattcaacttcttccttgtttagtattgggagggtgtatgtgtccaggaatctatccatttcttcaagattttctagtttatttgcatagaggtgtttatagtattctctgatggtagtttgtatttctgtgggatcggtggtgatatcccctttatcattttttattgcatctatttgattcttctctcttttcttctttattagtcttgctagcagtctatcaattttgttgatcttttcaaaaaatcatctcctggattcactgatttgttgaagggttttttgtgactctatctccttcagttctgctctgatcttagttatttcttgccttctgctagcttttgagtgtgtttgctcttgcttctctagttcttttaattgtgatgttagggtgtcaattttggatctttcctgctttctcttgtgggcatttagtgctataaatttccctctacacactgctttaaatgtgtcccagagattctggtatgttgtatctttgttctcattagtttcaaagaacatctttattccagccttcatttcgttatatacccagtagtcattcaggaacaggttgttcagtttccatgtagttgagccgttttcagtgagtttcttaatcctgagttctagtttgattgcactgtggtctgagagacagtttgttataatttctgatcttttacatttgctgaggagtgctttacttccaactatgtggtcaattttggaataagtgtgatgtggtgctgagcagaatgtatattctgttgatttggggtggagagttctgcaaatgtctattaggtccacttggtgcagagctgagttcaattcctggatatccttgttacctttctgtctcgttgatctgtctaatgttgacagtggggtgttaaagtctcccattattattgtgtgggagtctaagtctctttgtaggtctctaaggacttgctttatgaatctgagtgctcctgtattgggtgcatatatatttaggatagttagctcttcttgttgaattgatccctttaccattatgtaatggccttctttgtctcttttgatctttgttggtttaatgtctgttttatcagagactaggtttgcaacccctgcctttttttgttttctatttccttggtagatcttcctccatccctttattttgagcctgtgtgtgtctctgcacatgagatgggtctcttgaatacagcacactgatgggtcttgagtctttatccaatttgccagtctgtgtcttttaattagagcatttagcccatttacgtttaaggttaatattatgtgtgaatatgatcctgtcattatgatgttagctggttattttgctcgttagttgtttcagtttcttcctagcatcgatggtctttacaatttggcatgtttttgcagtggctggtactggttgttcctttccatgtttagcacttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttccggcttgtagagtttctgccgagcgatctgctgttagtctgatgggcttccctttgagggtaacccgacctttctctctggctgcccttaacattttttccttcatttcaactttggtgaatctgacaattatgtgtcttgaagttgctcttctcgaggagtatctttgtggcattctctgtgtttcctgaatttgaatgttggcctgccttgctaggttggggaagttctcctggataatatcctgcagaatgttttccaacttggttccattctccccgccactttcatgtacccaatcaggcatagatttggtcttttcacatagtcccatatttcttggaggctttgttcgtttccttttactcttttttctctaaacttctcttctcacttcatttcattcatttgatcttcaatcactgataccctttcttccagttgatcgaatcagctcctgaggcttgtgcatttgtcaggtacttctcgtgccatagttttcagctccatcaggtcatttaaggacttctctacactggttattctaggtagccatttgtcctatcttttttcaaggtttttagcttctttgtgatgggttcgaacttcctcctttagctcagagaagtttgatcgtctgaagccttcttctctcaactcctcaaagtcattctccatccagctttgttccattgctggcaaggagcttcattcctttggaggaggagaggcgctctgatttttagagttttcagcttctctgctctgttttttccccatctttgtggttttatctacctttggtctttgatgatgatgtacggatggggttttggtgtgggtgtcctttctatttgttagttttccttcttacagtcaggaccctcagctgcaggtctgttggagtttgctggaggtccactccagaccctgtttgcctgggtatcagcagcggaggctgcagaacagcagatattgctgaacagcaaatgttgccgcctgatcgttcctctggaagcttcgtctcagaggggtactcggccgtgtgggatgtcagtctgcccctactgggtggtgcctcacagttaggctattcagggctcagggatccacttgaggaggcagtctgttcattctcagatctcaaactccatgctgggagaaccactactctcttcaaagctgtcagacagggacatttaagtctgcagaggtttctgctgtcttttgttcggctatgtcctactcccagaggtggagtctacagaggcaggcaggcatccttgagctgcagtgggcttcacccagttcaagcttcccagccacagtttgtttgcctactcaagcctcggcaatggcgggcgcccctctcccaaccttgctgccaccttgcagttcagtctcagactgctgggctagcaatgaacaaggctccgtaggcatgggaccctccgagccaggtgtgggatataatctcctggtgtgccgtttgctaagaccattggaaaagcgtggtattagggtgggagtgacccgattttccaggtgccgtctgtcacagcttcccttggctaggaaagggaatttcctgaccccttgtgcttcccgggtgaggtgatgcctcgccctgctttggctgacacttgatgggctgcaaccactgtcctgcacccactgtcagacaagccccagtgaggtgaacctggtacctcaattggaaatgtggaagtcacccatattctgtgtcgctcatgctgggagctgtagactggagctgttcctattccaattatactggtttctaaaaaagattgtaatatattgttgagagtgaagggagttttatatcaataattaaattattttaaaatattgtttatttcatttctcatacttcaaattacttatttacattttaataatatattagtatcataacacatgtgtataatacagctagaaagagagagcatatataccctgaaggcatttttaattataatattgtaaaaccaaactctaaagactcctgttctaggtaattgattagtccagtaaatgtaggcataagaaaaatgtatgaaatagatgacgttaatctttcatgcacaataacacctttctccagctgtggctctaactgtcctgatggattctttactgctctcagctaatccattatatggttttagacatccaggatagacactgaaaggaataactattacaaaagtaattttaagaggagcatttgattgactgatgctcctcttatgtattcattgtgtgtatgtattgaatttgtgtattcattgtatgtattcaatattcaatgtatgtattcattgatcctgcatatacttgatgatttgattggtggtttgattccagttatattaacttgccagaaactttctagtttccaaacagtgaatacaacttagacctcatgaagcttacattctagttagaagagagaatattaattagataagcacataaaatatacatgtgttagatagtgataaatgacaagaaaaaaagtagagcatggagggcctaggaaggatgatagtggttgaatagactttaattttatatagaatattaggtcagagatctgaaggtgactaggaaaaagttatgtgggtatctggagcaagagcatcttaggacaaagagaaagtaagtgaaaaggccctaagatatgaatgtggctggcatgttcaaagaccctcaaggatggggtaagagtggggaagagttgaaggatatggggaaggggaaaatatcgtaggtctttggcacactgtagttaatgtcttcacatttttcttgcaatgcaatgagaaacacagacatgtaatgatctgagttatgttttaatagggttagtatgattgttactttgagagttggttgaatgaggacaaacagatagaccagttaagagacttggcattcatccagtcattagctgtgaagtcttggaccacagtgataatggtgaaaatgatcaagtgtggtttgattccagatacattttgaaggtaatgctgaaaagatatgctaatagtttggctgtggaacatgaaagaaagaggagttgaggattatttcccaactatggacctgagcaactaaaagacttgtcattgatttagatggggaagactgtggtaaaaacaaattttttacaggagatcatgaactcagcttagctaattatataaagttagagatgcctattatatatcgaggtgtaaatgttaaagtgatagctagtatacaagtctgaagttcattgggtcaggaacatctgaactgaagatgtaaaatgtttgaatcatcaatccatatgtcatttaaaccagaagactagatgtgataaccaagaaaatgaataacgagacaaaatatgagatctaaggattgggccctatagcaccccaacatttagaggttaggaaactgaggacgaactagaaaggagactaagaatcagtgaccaaaaaagtagaaggaaaaccacagaagtcatgtattgaaagtcatttgaatgaatcaagtgatcaactttgtcagatactgttgatgggccaaataaggtaagaaatgagaattgaccattggatatagcaatgcattcgaccaatgaccttgagaagagtatttcagtggaatgaagggcaacatggaaactagagtggatttaagagagaataagaagaaagaatatggagatagcaagtgtagacttgtctttttctagaaagaaaataagggcatagatacttttatgggatgtggaatggtgctgggacatgtggaagtctcttctattggtctgtatattcttagaaaatagaaaataattgagtatgagaacatgggaggaaaatgctgaagattcaaggagaaaagagaaagtatgaaaaagtatccaggaacatagcaaagaacatggaccagacagcattagggatctatgtgagtttagtaatcatgaatttgaagcaaggtcagtcaacaggtactatgagtttcttcagatgtatccagctcagcagttgcaggtacagagaagatagaggttagatttaactgacgttgtggttaagccaagtgaatacagtaaaactagagattaaaataattgaccatggaatctaagacagtgatgagaaaccctcaagctacagcgatttcccattgtctccctaaatgctattagtactgtagccaagacaagtctttcttttataggactatacaaggccttagaggatatttagtatccttggcctaaaggataaaggtaaagtggtacagtacacatttagtgtgctgtacactaaatatcagtagcactttgccacaaattaaaggaacagtatataatccttgacagtgctttaactccattgcatttccttcttttttagaatggaatttttttctatatgttccccaaagcaaggctagtttatataacattaaattacttatgcaaatgcaaaaattaatctgaacatctatttattatatctagcacaaaacatagaaacaaagaaggcataggttattattttgaaattatgctttactgaacacataggaattgctaccaatcgtttaaatagttgccttatttcttagacaaatagtaactgaaatgtatggagcattcatgcatatatttggaatgtattaagtgttcatgtgtatacctggcgcagagttaattgttttgcctgcattatctgatttgattttcccacagtgccatgaagtatgaattatcattatcactattatatagtaaacagtataaaaatgtgtctatgacttggagaatggaaaaatgttttacaatattacattctggttgttcacttcccttccattcatgttgacattgaattgttctaggctgctaaggcagcactgtcagaagccacgttttttctaggcatacacacactttattcctttgtcctttagttccttaaactacccatgcactttcctcctctttctttttacattgatgattaaaatagtgagcctgaatttttttaaataaaaaccaactaagttttttattatttattatttggaggaacatatgccctccaaaatatcatttagtgcatcttagacataaaacaatttaactgcttgaagaaaatgtccagcttctgaaatggcatgccattagatattagtgacatttgtttataaacaaataaatgtcttcaacctctatgtagttactatcaatatagccatgcaatatatatggagttccaaatacctttcaaaaagtaatgttgatacagtagtgatcacttatgtccttttgattgaaactgcattatacgaagttctttcctttcagcacaataacctgaaaaatatagctgtctatttaaagaagacattttcttgtttggcagaatattatcatcatacagcatatgtacaatatggtcctaatttgtgtcgatatgtgctaggcttagaaaactcactttaagttttactaaatttattttggagtttaactcttacttttgacatgatttatattctaaggagatctcagcttcttcctgcttaaatgacattacatagatagaaaggtatatattcttattatagcagtgtctgccagggctgcagtcctgttgttagaaggctgtcagaattttaaatgtaagccttcctttcccaggtgttataatttaatcttctaactcctattaatttctgaagactgtggggccatcctatatcttagaacaaaatatagatacgtacattcctgatttttttctccatatttaccttcccccaaatgttttaattttattatttcaaaattataataatagcaatggatttcaaattaaaattctggctagtgaatccctcaggtatttctttatattgactgatttgtatgttgtaggctaaataatgccctcctccaagatacccatagctgaatttccagaacctgtaaatatgttccctcttacatggcaaaagggactttgcaaatgtgactaagtttaagaaccttaaggtgggaagatgatcctgcgttatccaggtggaccgaatccagtcacatgagaccttaaaagtagaagagggggtcagagtgatgaaacaatggaagaagaggaaggagaagtttgaagcatgaaaaatatttcattcatcatttctggctttaaagatggagagtcccttgaaccaaggaatgtgaatgacctctagaacctggaaaagagcattggctgacaaacagcaaggaaatgggaacctcagttccacaaccacaagaaatgaattctgccaacaacctgaatgaacaaggagatagattctcctctagagccaccagaaaggaatgtatccatgccgacaccatcattttagtcattttagctaaaggagacccatattggaatattcgcctacagaactgtattccaacaaggatgcatatgttggaatattcacctacagaaccatgagataatatatttgtgttgctttcaattgctaagtttgttacggtagcaataggaaactaatgcaatgtacagttgacccttgcacaatgcagggattagggatgctgacctctacacagttgaaaatttgtttataatttttagctccctaaaaacataactactaagagtctactgttgaacagaagccttactgataacataagcaatttattaacatattttgtatttcatatgtatatatgctgtattcttataataaagtgtgttagagagaaaagaaaatactaagaaaatcataaggaagataaaatatatttgtgttaatcaagtgaaagttgatcatcttaaaggtcttcatctgcatcatcttcatgttgaaaaggctaaggaggaggaagaagaggaggggttggtcttgctgtctcaggggaggcagagacagaagaaaatccgcgtataaatggaccggacttgcacagttcaaacctgtgttgttcaggtgtcaactgtatatgaaggctttcttctttaaacagaaaggaagtattttgtgcccaagatttggagaaagcaatgggataaaaatatcatagagattttatggtatttgtcctttttttccttttccccttcactaagggtcttgaaaaactggtctgaaactccgctccagtagagcaaaaagaagaactgaaagttaagaagatatttttgtgaaaaatgttgtgagacaaattttgacacagggttgaggaactctttttttccgcatctgaccaagggcaggcttgatatcctgaaggttaagagcggctttgcctgaagcaaagttctcactatgggaagttgcagccgagtagtgaagagttatcttgatgggaggccggaacaaatttgctttggagacgtaaagggaactaagaactattcttactggactccaatatgagactttatttctatccattggtttgcaaggcctggagatatatgcattagataaaaagactgtatttgtaattagaaaagcctccagtaattaatgtccaaatatgcaaccaatttaaatgatgtctacataataccacacatagatgaaaatccaaaaagtcaaacattcattataataattcttccaatctagttgttgttatatagaagcccctcagagggcaccccattttgctgaatttcttgagttttttacttatatcacagaatcaggatgttcaaagtataacaaagatgagaagtaagttgaaaaaagaattattagtgatatttcttctaccatatacatgttatcttggaattggaattttttcataataagaaatccattagcataaatacagtttaaattgaataagtaaatttcattaaaaacaaaatatttatttgggggtacattttataaatagctgcaaaatcaaaactgcatttttgaaatgtaagccatattgatgctagtaagtcaatatgctcattatcaattgtgtatgtacttttatgttatttagaaaatttaattacacgtacggtgtttcaagtattcaatagataaaccacctaggaatataacagggggcataaaacatattatcgactctgtgtctttatgaaactagataaagcaaagaaaaatctgtcaattactcagccagtttcatcttagtagcctactgtaaattgaggtctatgtttttgagtgaatgaaatctagtaaattaagttcaccaggtcttattctagtttattttagatggaaatgtatgatttttaaaagtgggagtaaaatcttacacatatttctgaaatgttaagaagataattttataattcaaacctgtacaagaacttagtttgcctatctgagcaaattttacattcactagtgaatgcccatgtgaaagacaagcaggaaacttccaggggccaaggggcttagaaccaactgaactggtacaaaataaacattaggtatttcagtacgtagagtttgtggacaaaaagaataggctcttaccaattactatgctactagaatatccaattttgcttttaccaagccttagtgaaaagtgaatgaattctaacaagaagactcaaagacactggtgctccccctgtgtctcccttcacttattctgcatggtcagcacctcttcaaaagaccaataataatggtcccctacaagaagtatacaattgctcctctgatgtgaaagcatatgaagaaaataagtgtccaaagctgcataaatatttgcacccctttgagagtatgagaaagtgtgtgttttatgttgtgattgataggacaactttcatggcccactttgaactcttagcaggaactttggaatgtcctgagggtctgtctgcctttgtatggcaggaactctgttttcttagaaaatagtaaagaacagtttgtactcctttgttctaaagggtacctatagtttatgggaattggggaacttagtagaaaaatcaccaacgctctcatgtttctcataaaaaatgctcagctttatttggaaactttggccattgttttctttttcttctttcttcttctccttcctcttttgggttaaaaaggccacagtctgacctacttatatgtgtgatgaaatgtgcagactctgccaaggctatttattctaatgatttatctactcaagataaaaagaaataaagtgaagacaaatctgaaatactgtgcaatgtacttacttgaaagcagtaagttctcatgttagaaaatttccctattaagcaagaaatcttgaacacttcattaaagtcatatgatctgatttttattatcatttaagtcagggaattttagaactaaatgtgtcaattataaaactgtacatatgtatagcctccaaaatgtgttaaacattagttcatatgaatctcaaaatactgtaacacagtaaaatgagcaagaaaatttttgaaatttgcacagtagagacgatgctgttaatgttcaccgaggtaaataatttgtccaaagttctatttctgtgagatactcaactgagacataatctcagcttttttcactttcatattctatattttggttttcattttgttcttaagaaacaagtatttttaaaatgaaacatctggtttcggcagtgctggctaatgctcagaactcccttcccttgttttcttcaatgtcacccttctataaaaacctctgaatatctgaatacgttttaagagcaccccttataaaacactttttgctttgttatgtttcattttgcaggtgccaaagtcacaaatatttcacctcattcagatattccaggtagtaaggctgatatttttatgagtcatttcatctgacaaaattaatttaagaataaataacattgaaatagtaagtagcatgtattttggacttaactcttattttccctatttctattcttccatgttttaatagattaatatatactcatgtgtatatatgtacatgcacactcacacacatataagtatatatatatttatttttcctcatcttatacaagtggaaacatactatacacattataagagcacagtataatttttatgtaatataatttgaagttaattccatattggatagtttcttcattatatgtgtaagtatatgtaatatatcatatgtatctatgattgtgtatttcattgaatgaatgcactcaaacgtgttcagcaatcagcacagaggttaaacattgactctagtactagactgtgaaggttcaaatcctgctttcaccacctgccatctttgtaaccttgaacaagttatgtaagtactcaatgcttcaattccctcatctttaaaatcaatgtaacagttataagattcttaccacataaggttgtgtgtggtgttttgagaatgtaatgaatgaacatatccaaagccacattgtagagtgcttagcacttgcaaagcataatgtcagtgtgagttgtcatttccatcatcatttttaacatgtttaattgcaacccctattgatggacgtacggacattttcaatattttttactacaaacgttgttatacattgtttttctgttgttgttgttgttgttgttggagatggagtcttgctctatcacccaggctggagtgcagtggtgtgatctcggctcactgcaacctccacctcccgggttcaagtgattctctgcctcagcctcccgagtagctgggattacaggtgcttgccaccatgcccagctaatttttgtatttttagtagagacagggtttcaccatcttggccaggctggtcttgaactcctgaactcatgagtcacccttctcagcctcccaaagtgctgggattgcaagcgtgtttcagtgaatagccatgtgcccagctgtttctcacatgcacccttataactgtgggataaatctctgaaggtgaaactgctatgtcaaagtatatatgcatttataattttaacagatattgccaaattgaacccatatattttagacatgctaccaccaatgcatgagagtacttgtttccctaaacccctctctaatagagtatattatcaaacttttgggtctttggcaatccaatgggtgaaaaatgacattttgggctgggtgtggtggctcacgcctgtaatctcaccactttgggaggctgaggcaggcgaatccctgaggccatgagttcgagacctgcctggccaacatggtgaaaccctgtgtttactaaaaatacaaaaaaaaaaaaaaagccaggcatggtggtgcacacctataattccagctacttgggaggctgaggcatgagaatcacttaattgcttgaacctgggagacagaggttgcagtgagccaagatagtgccattgcactccagactgggcaacagagcaagactccatctcaaaaaaaaaaaaaggaagagagacaattatatttttttccacacaagcatttaaaatctaattcaaaaatctattctgaacttactgaatcccaagaataattaggagaggaaaagaaataatgtttaaataaattctatctgcctgttactatagaacatgaagaatgggttctgtgttcctcttatgaatttctttttaaaacccttcaaagtaggtattttcatgcccttttagacataacataacgtataattcagagttgaattaattttcccaaaatcacacagcaaatatatagactacaattagaaagtgggtaagtctcattcttaaacatatacttttgcattatagtcacatgaaaccactgagcgtgttcatgtgtgtgtgtgtgtgtgtgtgagagagagagagagagagagagagagaaagcccaagagtgagagtttgtcttgaggagaagtgtttaaaaggaatatataaatcaaggatgcactatagtatcaccaaagtaacagtgtgaacttgaacaatttaacctcttagagccacgattgctccatctatacaatagaataataataataaacctacattatacaatttccggagattaaatgaggataaagagtacttttgaaattctaaagttccatgaaaatgttagctttgattacatatggttcagcaattgggtctccttattttttgagatctaccttttttttttgtattatctgtagcttgctaaaataacataccagatgtttttgttttcaaattttaaaaatccagatcatactgatttgttgccatggtatagtagtcagagaatcttgctctgggcagttacaatattttggagattgttttacataatagcaacaataacaggaacaatgataactgctaacttgtttacatttacaaaatgtcaaatactattctagattattcaattgaatcatcacaacaacgctatgaggtagttactgttatattgttttgatttccctgatggagacttgacacaaagagagactaagtaattcactcctgtcacacacagctaaaaagtggcagagctgagtgttttgccccaggtagtccagttctagaactgtactcttttccactatgctataccatcttcctaatactatctgtacaagaaattttctcctaatgaaatgtattgctgtaccctatataagctttagctctaaaattgcagagcaggaagcaggtggataaagctaattgctattctattaccctacaatagaaatttcagtggactaactctaatatttaaataacccactgttaataaactggcatggtgcaattgcatgtttcccagtgagatcagatctagtccaatgtctcagcagatataggaattccttttctatcaccccagacaggtggatctctactcatgtatcttcagagaaatggataccctacaaagcagcacattccattttcaacagctctagatattattttatttatttattttagatgaagttctgctgtgttgtccaagctggtctcaaacccctgggctcaagcaatcctcctgcctcagcctcccaagtagctggaattatagttgtgtgccactgcatctagctccagattttagaagttaattcttacacagggttttctggagggacagaactaataggattgatgtatatatgaaggggagtttgttaggagaattggctcacatgatcacaaggtgaagtcccacaataggccatctgcaagctgagtagcaagaaagccagttcgattcccagaacctcaaaattagggaagccagcggtgcagccttcagtctgtggccgaaggcccgagagcccgtggcaaattactggtgtaagtgcaagggtccaaaagctgaaaaacttggaatctgatgttcaagggcaggaagcatccggcataggagaaagatgaagactagaagactgcgcaattctagaccttccacgttctcctgcctgctttatcctagccacgctggcagctgattaaatggtgcctacccagaatgagggtggttctgtctttcccagccctctgactcaaatgttaatctcctttggcaacaccctcacagacacactcaggtacaatactttgcatacttcagtcaagtagacagtcaatattaatcaccacattctccaacgctttctcatacaggttctatttctccactatgaacagtgagattttttttctggtatacttgataggccttcaaatgttccaagaaaacaatcatgcttttcctaagtcttctctttttaaatactcccattacctttccaaaccttttgttcagctgttgggaccatcaacatcctggtcacacctctatggatgaagtctaatttgtcaactactctcttaaatggtggtgtcatgaattgatcacagtgctctggatgtgctctgactagctatgactgctcctggatcgccgtttcctttaatctatacactatgtgtcttcctaatacagagagtatgttgtttgcctatatatcataacaaattgaaaatgcatttataacttataaagtatatattactaggtgctagaatttacactattatcctaatatacagaagctgggaaaagtaatgccatagagttgatttatgtgtgtaaatgtctaagtgacttaaatattgatttttctccttcaactgcagatcaaacttcccaaacactaaagcttccttattttaaaacaaatgcatttgtggttcaccagtctgcagtacagtaagctttttataggtaagctcaaatcacagaaaagctcaaatagatacatctcctttagcctatttttaggactgataaagctaagaacagagaaaccaataaagacatattttaatgatggcagggtatctcatggggtagtacaaatttatcccagttttttatgccttctctatgtgtaatacattgaagtgatatatggtgttgaatgtgattaaaattcagcagatacttatgcaagatctactatctataagatgcttatgcaaaattccatagggaaacattaagacgtgaataaaatctgaattgggccatcactatgatctctccccaaaacgtgggattttcaagtgcatttagaattatgaaataaaccactaggtttttagtgtgaaatgtttacagtattttaattttgaaaactatacttattaaaacagtatgacaacatttattgaatacatgttatgtgctaggtaccaagtggggagttttatgtttattttctcatttcatcctaagagcaaacttcggaggtaggtgtgattcgtctcattttagtgaaaattcactgatgctctgaaagcaaaattaactttcccaagggccttgtagtgcttaaaggcagaatcaaaatccacaaccagctctggaaaatctccagaaatgagcttaattttttgtgtgatttatatatgactccaatattaacagacatgtcaaacaactaacacaaccctttacctgtttattttggaagaagacacttaaaatgtattttattaccctgttgattctcctctggagtgtgacttagtatccattgcacctttgggattcttatcttctaaaattcacaaccactttctactgctgtaagaaagaatcacctgcagagttcacgaatgagggaagagtgaaaagggaatagtggcagatcaataccacttggcatcacatcaaaatagtattccaaggttggtgttctggcttctgcttttctgggaaatacgttgtctgctatttcaaaatgccctccatctgaataatgtaacctgaaattcattcaactcatatttagcactttaggccatatccagggttgtggaaggtgtacgtaagcaatgaggattgcctacaaggcaagatgagaactctgttttctatactttctattgttcctccctttgcaacagaagtagaaagggccataccatagccatctactgtccaacatgatgaatatccttaaagacaaaatctttaagcagtaagtgaaaggttaactacaattctcatttaaaaagaaaattgcattgctgatatctctttgttacataaattttccacaaggattatacattttctttttattcatttgttatctatttgacaatagcaagcctgtttctctttagcttaaaggaacttggattaaaattttttctgttattttaatcagcattgatgttgtatattatgagcgtgtggctttttgttttcttggcagagaccttgaaaaaattttgaaccctagtcaataagaaatctctgtattaatataaaactataacttatggtttatttgattagatcaatgtttaattatggataacatgtattttttgcactgaatatttacacacaaattaatctagcccatagtaaaagtgctaatggaatgtttcatccaaacataagttagtaaatggaaaacaaacagctgttgcaaagaccctgtttttgggtctgggcctaacagcacgaagcacttcagagaatttcaccactaccatttactcacatctgttgagattgtactatttcaactcaagatttgatcagtgtatgtcataaagtaacaagtagtacgctaagtcagaaaacttaaaggaaacattaaatactcatttcctatatggaatgttgcctttctaagcacatcatcttcttctatgtgatgttttgcaaatctattcataggagatttatattttcaagtgtgctcaaatggatctgtgttggggaaagatacgtgaaataagaaaataaaagctaatccatttgttttaaaattttgtctgcctaccacattttgttggacttcttgttatatgagaactcctaattgtctggttttcaattgcagccaaaagcattcttacctgatcaaactcttcaaattctatttactttgaattatagctgagtacatggaaagtataattgggccttactttgttacacagcagacaaaacatatgctcaagataggtcagtgctattccagtgaataaacattttaacaaaaatttgtatgagaaattcatgttggcctctcattcctctctatatgcctttcacagttactctttttccccttgccaatcaaaacactataatgaatatctcttggccttaacgataagaaacactgtatataaatattgtctaggctgtattttatgagaatgtggagttatatgaaatgtaggaagaaaaaatatgagtgagtaatcctgtgagcagtggacgggctgagcttctaggacactgataagcaatcagtgttagttacacttgaggcagtatctctggtggtctgttccagaactatgtccttgactctgtcacattcatacttttcatcactactttttatacttctgcaatttaggtcacccaatacaggttatcttatcaggttaaactgattgtagtggtcacattgaaaaagaaaaaaaaaatcccaaattcaggacttttcccaaccagttctaattaatgcacgtgtgaaaggacatagttattgtgaaaagaaatgctatcaaaacagtctaatggctacaagaagaaaaagaaaagaagaagaagaaggaggaggaagaggagaaggagatgaagaagaaagctaaggagaagatgggtaacaggaaaaaaagagggcaggaaaagcagataggaaggaaaaaaaaggtggaagagagaaatgaatgcaggcaggcaggatgttttcctcgaggttttttatttatatcccctggactgcataactcagtttattcccttctaaaccaacttttctagaatgtgttgtctctgttcgacacctacaactctggttcattttctatgcattaaggatgatgtaactttaaaacctctcatgtaaattctgcctgttttctaattctacaatcctcttgtttatgttctattctaataattatcgagcttttaaagaagagaaatctgttcttaactcaaatttatacatacactgaaggaaataacaaaaccttgaagtaaaacactgtttctatgataaaagagagctctacaaatagatgcatgaataaacacttctatgggagggataccttttcagagtttaaggctcgcgggctttgggatctaagaagatgaatcgcttgccctgtttgtgatcctaaatggaaattgacagatatgtttaatttatcctgctcagtattataaagcctttttctcatttgatttttgtgtatccctcctgaaatatttgctctggtaagcaaaagcaaatattaggttttacactccatttagtgaaataacagtgatgataatctgacatcagagaaccaaatgttccaggcttatttcatgaaaaggatttcctctccagaaacattatcctcaataggttatcccatccttcattcctcaattcatatttcttgagattgagagggaaaaaaaaagaggccagaccacaagtagcctactgctaaattcttttatgaagcttagttttatgaattaccttttagccttctccagtcatgtgggaaaactttcctgcctcattaaatctttaatgcaatgtgcaccatgcacactgtattgttatttgtgacattaggttatatattgcatagtaactataatattacttgcaaacaagctggtttttccccctgaaggtagaattaaaacaggtactcatgggaaacagctacttgtgttcttcttttcttaatggggtgaagctgaagaacaggaaagtgaatggcttagcctagaaccatctccaggaatggaggtaaattttttcctgcagtgccttctcaatttgatatctgaatctccctgaagagaatttgccttagtagatatggagaaagagggaaaaggccaagcctttggagacccttatgaaatggaatgaaccgctctcactaaattcactttctctttgtattgaaaagagatataattttcatccctagtaaatatagtcgaatccatccagtaatataagaattgcctcaaagtgaactaaaattgcacttactcctacctgtggaaaaccatatttctctagccaagagaacaatgacagattagttcctaaatagcaggagaaaatgaaatgttctattggctgaacacacagtgctctgtaaaatcagagaaatcaatattgtccccaaaatgaactaatttgaaagtctcaaagatgttcaattttatgaaagactcgtaaaattaataaatgagtctgcaaagtccaaaaatgtggaaaattacagttatttgcagtacgtataacttaccaagaccacttatattttgttagaatttttcaatgaatgttaatggatgaatttttttatatagagttctccctgtttggaatcttttagttcccttatttactgtggttgccactgactctgcatcaggctttggaaatatcactaaaaaactgttttttctttagtcttcttactagtcaaatatcagctaaacaaacaaagaaaataagtgtttgaatggtcagagaactataagaatgagaattctggcaggaaaattcatttttaaaaatccaagtaacagaatggataaatataaaaagaggctagatcagacatacccagacattctcagttcagaatgttcatagcgtattcataattttttcatagtgcctccttgaccaacagaaataagccacagttctatttcttaagtagttagtgccaaacaacttaataaatattcatgttttaacaacctagcaattgtttaaaaagaaaatggacagaaaataataatttttttcataaataaccagaatcacttactgatgggatgtggtacctttggggtagtatataccttctcaaacttgagtatcagattggataatgctatccttatttccttttccacattgacttttgtgcagttcttgcttttaattacagtctcttctgaaaacctttcttaataaagatataaagtggcctaaagtacaagtaagcagaaacatggctcaaaatgttgagaacattcttaagtggaatatagcatgttctaaggtttcaacttgtgaaccaccttgaattagttattgcagtgcccaacagatatttagtattgctgtgtgtccttcaaatgtttacaatattccactgtgcctttgtgagttcactgcagcaccctggggcacctctacacacagtttgtgaacacaggggtagatagatcctagaggcattgaaactacacggaaacttgaatgacgttagggatcccagagccactggggaatcttcattagggaagtgcaacaacatatgaaatagctcattaaactttccctatcaaaaaaactgaagtcagagagatgaattcagatgcttgatgagaacctacttggtaatggatttgaaggagagagtaaacgttaggatactgaagggattctaagagagtgcagaagcgagggcaaggaggcacaaaacgaaggcggcacctggaacatggaggagtggacagatggagaagaggcagagaattctttatctaaagcaagaggaaagggcaacgtatactcagaatattctcaaagctttttccctgaataatagcatccttcagaaaagaagtcttgtaactgactcattgcaaagtctcttacacaatggtatgtactctttggggaagacacaactggaaacaacaccaggaaaagcttgattttacagcttatggaaagattgtggagttgaaggaaaaatagaaggaaagaaattttaaaaagaataagttaatattcctaggggtgcatcctctaaattgcagagtgatatcttaagcaatccttttaagaattacttaagagcctgagcgtggtggctcacacctgtaatcccagcactttgggagacggaggtgagtagattgcttgaggttaggagttcaagaccagcctggccaacatggcgaaatcccatctctacaaaaaatacaaaaaattatgcagtcatgatggcacacacctgtagtcccagatactcgggaggctgaggcacaagaactgcttaagcctgggaggaggaggttgcagtgagctaagatggtgccactccacatcagcctgaatgacagagcaagactctaggtcaaaaaataaagaaagacagaattacttaagtaagtacttgactaactggttatataaatgtgatcataaacgcatacctttagggtaaatgaaaaagacattgattctaatattgtgtaaatgggtaactgtggcttgggaaaaaaacatctagtaacagtatcctgaaaattgtttaaatggtccgtgtttcacacaacttaaatggaagtaaaacagcttcgctcatgacaattttcaggcaattcaaaatacgttgtaataatggcaaacatgagtatcagagatacacaaaagagtttagaaaaaaatcattttatgaaatatgagctaaaacaatgttttactattatcgctattattattagccctcagcagaatagggtaaattatttctattccttagttcatgttttatattatcgctgacctgcatgaggagcccctatttttctgcgtatttatttgttcctcttttcccccttcccacctctaattcctctctcatagtattttagtttatgtcagggatccccaactcccgggctatacaggtctgtggcctgttaagaattgggcggcacaacaggaggtaagcatcaggcaagtgagcatcactgcctgagctctaccgcctgtcagatcagcggtggtattagattctcacaggagcaggaaccttattgtgaactgcgcatgcgagggatctaggctgcacgctccttatgagaatctaatgcccgatgatctgatgtggaacagttttatcccaaaacccctcctctgtgtccatggaaaaattgtcttccacgaaacccatgcctgatgccaaaaaggtggggagtgctgcaagtttccattatatgtgactttattataaataggtatgaaaaacacattagcaaatcaagtatcataggtgatctttttctacttcatctatagtcgtaacagctttgacattcaaattatacacactttgactctttttattgacaaaatggaaaattatccttaattcaaaatgtattttatttgagcatatgtggtgatttcatatattaagttgatatttttctttcctttttagagaagccatattcaagaaaaatagcatgtaattcaaattttaaataatcaaaatagatttgaaagctcaaaattttggaacattataggcctatgtcccaatattcttcccaaacctcctttcaaacgtatttattaatttagaaaattctaaatagttcagtccttgtttgaaatatatacaacataaaacttttttttctcctgcctttctagaatccttttattgagaaaatgtgtagctgatctgaagaagcatgctgtgtgaaattttgaatgtttatcttaatagaacctaaaatcttccacataggttcacccctcattactcacaataatgccaagtgctgtagtccaggcagatatttattattttatatgtgaaaagacattcgaataaggccatttctcagtggattaggggaatcagagttttctgaatttaagttccttatagagccccatgtaatgagctcttagaagacattgcagagctgcaatttaaaatcctgtttaatcagccgtagcgagctatgtgccattctctgtggaacactaagaggaatcagggttcttcctcctccatccagtacattcccaaccaggaattgctgtctggtcagggttggacgtgaaaggccatagagagccaaccctgcgaagccaagtctctgcatgtcagcacagagcaagcagcagaatacagatcatcagctttgttttatgaatatctctatttacagtgctggagtggaattttaaaaaaaggattgcagcatttgcattgaatctgtcactcacagcttcaattttgattcctgtcctataaatgatcttgctttcctatttttttctgaatttctacaaggtgactgtcaatgtcagaaaatgtaaacctcaagtgtacattgcatggggcttggcatgtatattagaaagaaagaagtttgcttaatgaaaagaggataatatttattcaaactaagcctatttaattgcacagaggaaagtataccttctttgcctgttttgtttgaattttaatataaaataaaatttgctgctaaccttttgtttttctttgaccaataacatttctcagcttagtgtatgggctatgtaaagtgcctgtcaaatggagggatgtctttgttgaaagaatccagactcacagaaagtgagtgactttctggtcagatggttagaactctcccaattttgacaaagatcgttctctgtttgggatttgtaaagctcaaactgtagactaagatgatgacaggaggatctgctgtttggcttcatggaacttaacctatttcagcaagcctgcaatactggggaaaataatacatatatttatgtttatgtcaggcttgcagttgatgggtaaggttcataaaaggttactcctaaataaatgcctatcattcccactccgtactccagtgatttctgcgtcttgcaaatactgccctatagaacaataaaattcgtatacaacagtaagtaaaatatgatttaatagcccatctcctatcccgtaatgattatgcatcttctgtcttgtagctcccagcagtaggaggacagttgacatttaccatatcatatgaccttgaagaagaggaagaagatacagaacgtgttctccagcttatgattatcttagaggtagagtactgagagcatgttcacccgtgttacttcctgatgttacttaaggttaccagtactgtattttttacctgcctggtttgacactgacttacaggactactaaaaaaaaatataccttaggagatttttgtgccactcttttgtttcactctgagacatatctagaagattgagtatatttgttgggtttgaatgataaaggagaactttagaccagacttgaaattaaatttcaaacataaggaccatatttccaaaatttaaatattatgaaagtgtttaggtacatgctaatttacatggttgtgtttttcctgttttctcttgcttccagatagattttattgtctactcccttgtttatattagataaaataaaatgaaacaggaaacttgtttatttagctatagttaaatcttgacttcagaatcctgttttaggtaagaaaggtacaggagaaactgctttcaagatttgaagggccataggcaacttcaaaatgctcaaagcctgaagtttccttagaggctctctgccaccctttcttatcatatccattctttccaataatgtatctcctccccttgacactgatacgtattcagaggcacacacatacatgcatgttcattattccaaatgggtagatgttaatttagcaccaggctctgttgtttcctgtcttgaaactttcatgcatgtgaatctatgacaaaatgaaaaattcttttctcaaaatggacattttccagtattggatgaagtggtctgctctctctctttctgtctctctctttctctctctctctgtctctctctttctctctctctctctctctctctctctctctctctctatatatatatatatatatatatatatatggcaactagatgtatactttggaattcctttaaggtgaaaagagttctctaaatgtaaagtgttgagtgaaattatttagcattcatgtgaatgaactaagacaagaaggattacctaagtgtcataggtcattcaatatactccttagatgccattgtcctattttgagaattagactgcagtcttttttgttgtttgttttttcccatgtagtaagttcctttaaaataatagcttaattcagttttaagtttctttccctattgttctacacaacccacatccatctacagtttgaaatatgtaactttcgtgcacttttttcaattcaaggtgtttgtaatcacatatatgtttatgagttgtcaggtagctattattttagttaacagggaactaaggtcatgccaaaccaagaagcatatgcttcataatgcatttggctaaggctaatattgaaattgcattgccttcccttcatgtataccacaaatatattccctgaatgacagggaaagccaacctgaaaataaaagtctactaaggccgggtgtggtggctcatgtctgtaatcctagcactttgggaggctgaggcaggtggatcacctgatgtcaggagtttgagaccagactggccaacatggcaaaacccccgcctcttctacaaatgcaaaaaattagccaggcttggtggcaggcgcctgtaatctcagctattatggaggctgaggcatgagaatcgcttgaacctgggaggcacaggtggcagcgagccgagatcgcgccgttgcactccagcctgggggatagagcgagactctgtctccaaaaaaaaataaataaataaaaaataaacataaatttttaaagttaaaagtctattgagggtggaggatacaaatatagatatgtttgacacttttgtaccctcttttcagttttactcttttttatttcttttttttccccctttagggtaatgacttgagcatcagcacagcccaagatgaggtgtacctgcacccatctgaagaacatactaatgtattgttacttaaagaagaatcatttaccatacatggcacacattttccagtccgtagaaaggaatttatgacagtgcttgcgaatttgaagagagtcctcctacaaatcacatacagctttgggatggatgccatcttcaggtaaaatcaagaactgcagctccaacgttcacacatttactttggggccaaggtgcaggagccgccccaggagtgaattttttaaggcacctaggatttgctgtcttcaaagagcagataagaacggagccctagttttctgaaagatttttctcttaaacctttacagttttaaatatgcagaataaatttgtctcggtttttattattattgatgattctttcacaattgtcagaacatgtgatcaataacgattcctatattgagaaatgttatattggaaaataaagtctcctttatgatggctcatagcgtgggaagctaaaaagatataaattccagggcacccctatttggaaagtggtttttaaaatatttccttccagtagttgttaactagtttctggcttaatagtatatagattgtaataagaaaagtaagtcttttcatttaagtgaccacccatctcactataaaacactttaagactataacagccatatggtataaaggaaagaatatgaactttggagccaaactgaatagaaattcaataagctttattgcttattttatgtgtgacctttggcaagtgattaagccttgaggaacgtttcttttcagtgtaaagtggatatagtaatgcctacttttcagggtctttgttaacatgatatgtgatcattaggaaagtactcatcacctagaacactttcagtttttttcttgttctccccgccccctttttttaaaagagtgaactacctgacttgaaccaaatatgctcgggtctgattaactgctgtaaggcggctttgttttttttatttttaaaacaatgacatttttatctgacagaattttaacttcaactgtgtctgaatgagctctttacgcttctcgttttctactctaataataaataacacaaggtgtcataggaacttccttctaaatcaggttaagttagacattcaaatgtgaccccagcctgacaacccggtatacctttaatgaaagcaatgtctccaatattggagtttttattgctgacaccaccacctctcacctccctgtccctcatcatttccctgtgctgcctagtttgcctttcactggtaatatttcaacttagtctaatcatcattaccatttcccaaaggagagaactgcagaatcataaacagaaccattgccaaacaatgtacctcttttgcataggcaattcttctagaagctgggttaaaatgccatggagatgagaagcagcacttaggaattaattatgtttttcacatttagcaaatagaggttgtcatgatgtttaaacagtacaaagaaatgagtcctccagctttcaaaatgaatgacaaccaaattgacaaaaaaagtgtctggggggcttatatatttttgtcagcattgcttttcaggctagttaatacaaagacatttccccctgatttatgttggacagtttcagtgtctacccgtcttaaaatcactggtttcatttgcagtcttctgaggtttcgccatacaggaggaatgcattcacagcgcggctctgtgaaatgacacaagagctaatccaagtaggtggctactttctgtcacctacattacctaaagcactgtggttcaataagtaaaagccaatgtcaaatttgaaactcctacccactcaggtgagctgaaagtcggcatgaatctggagtcagtcagtaagcttgttatattttatctttgatctactagtagattgagtcatatttgtaaaacatcacttgaattgatttcaacttgtcttgcacagtaggctttcgacttggtatactgtttgtgtacaagcacaagtaaattgaagctcaacaaaaattcatattcagacttatttacagtggatttacttccatggcagttctttcagcaaatgggcttaggttcctccagttagttatatgattagatggaattgtataacagaaggagaactggactgcgggtcaagaattttgacttttgttttcaactcagctatttaatagttgtaaacataagtatggctttgacctctttggacttcaatcacttcatctgtaaaataaggaggaggacaattgctctgccagcttcaaaaagtcaccgcaagaattgaattagagagctgcaaaagcacttggctagtggtaacccagcacacaaatatgaagcatttctatcttatctacttcatcccaaaggatcacattttctccaaataccattaagacttagagacctctaaagaaaggcacatactggcatttccatacatatgacagttcttactatcatttttatccagaatgctgagacccattagataaaattaatttattttcttctcgctgtcttcactaggaagatgaaggcacaagtagaaaactcttcattcttcttttaagaatataagagaaatcaacctaactgaactgtgcatctttcacctttaaattatccaagacttggatttagtaacatccttggtctttaaatcaagaaaggcttttatgaagcacctatattagatatagaactctgcacaaagtgtattttcctctaactttacagtagacattagtagagttcaccaaatttccaatctcatctataggggatattgcatttctctaatcctggagggtagatgtgtcacatgacttggtttagccaatgaaatgtggtagaaatgatgtatttttttttttcctgaggtaaacattgaatttccaatgtgagactctctgcagcttactcagcaatcagaagattaaaaaacagcctggggccgggcacggtggctcatgcctgtaatcccagcaatttgggaggctgaggcaggcagatcacgaggtcagttgttcgagaccagcctgaccaacatggtgaaaccccatctctactaaaaataccaaaattagccagacatggtggcacgtgtcagtaatcccagctactcaggaggctgaggcagtagaatcacttgaacccgggatgtggaggttgcagtgagccgagatcgcgccattgcactccagcctgggtgacagagggagactctgtctcaaaaaaaaaaaaaaaaaaaaaaaaaaaaaagcctggaatactgatttagcacacagaggtcagctgccctaacagtcacccaggcctgtagaggattttacatgagtaagcctttgttttctgttaagccattgagattttggagttgttaccacagcataaccgagtccatcgtgacttcatcacgatataactcatgagtattgcttgaaaataaatacagaatcttttcaaggcaagatatttttacacaacttttagtgtaaattttgcggtttgggatcaaaaaagattatacagaatttatataataaataatctagaaaaattcctttgtaaacaaaggagtctttgataatcatagaaatagtattgataggtacacagtatacctctgccttctgaagttaatgatttgggtaactacattttgaagacattttactgataacactaggacttaaaaagatttttgcagctcacttggcatccggccattggtaagaggtgcagccaacattttaccctacgtttccttcccattatctttgactacctcccaatgctattccataagtgttggattcgttcagtctgcaaatatttactgagcaccttccatgattatctctgtaaatctcagttcctcttgtatacaatggcagaaacaatgtctaaatttcaattggcaattaagtgaaaacataatgtatgttaagcacctgaaatagtatctaacatatgttgggaggcaatgcagggtaacaaggagatctttggttttggagtcatgcttgggtttgaatctatgctgcaccctttgctaatggtattatgttggacaaggctctttactcctctgagcctcagattcttcatttgtaaatgtgaatagacatgggttgttacattgtttattgatacttaaatgaaatgtctttccagcctgtatcatagtacacagaaaatagtagacagtaagtagtaactattaaaaagcagtcattctaggctaggctataaggatacaaaggtggacaaatgatcattcagttcaaagaaggcattgtacagtagagaagacagatatacatatacatactgtacatttatgataatataaatagtgcagaagaagtgtgcacaatgcatataaatagtgcagaagaagtgtgcgcagtgcatactggtagaactaagaaggaagcaatgaattcttgtgttagcatttaatacacttttaataaatagctgcaaaagtatcagtttctgtcagttactgctcttactcgatgtgggattgaaaatgtttaaagaaaatatcttgctatatatatataaaaaacaaattatatagcatatatatatatatatatatatatatatatatatatagtgggtagaaaaaagacaattgtaacatcaagggtatttttgttgttttaaagtgtcatgttttgtgctggttgttttagtgtaatatagcatatcttactctggtgggaaatgtagtaaaacaaaaatattgagaacaatctttaaggcagcaccaagacaacgtttctgaaatagttccaatattattcatagtggcttgtataattatgtcctctctcttcatccatcatcttttctgtattttcaaggcataaaaataagagggaagagtcagctaaagcatttgacttagttgacaattctttgatagctcatgcatctctaaaatttagtactatattattgccaacattatgtatttaaatgaatgcagcttgatatcaagagaatgaccatactgaaggggaaaaaaaaataaactgcagccttcttcatgagtaacacttgaaactgttaaacacattaaaatcccatttaacaaatagcagaacctaatgaacattgggattgctcagtgagtactaatgtggaatattactgggaaagatgtttgagtgttgaagtttctcatagctcagaatggttacacagattaaggagaggaatgtctgttgttcaaaagacaaatgaaatttgtcagttcactgaaaatatttttgtttttgtatcttttttaaaactgtttcttaaagtagtcaactgctcattcttctattttgaaatttccagaactctttgtttaagttttgcatgtcaattttatatgagaaattcttggactgtatctagatacagttaatcaatctgctgtttagtaaattgtggtgatctattgtatgataatcaactagtgtatcaaccatgaaatcatctaattctgaaattaaaaggatcagaattataggtttatcaagtgacagtccattaattccaggcagttagatttcacaatacattcaggcgagttctggtctctggcctcaagttctaatgataacagtttccatttatcttctatgtcaaatcaaacaagtaatttgtcttttacttttctgattttattcatctgaaatgtggctagtagtctttattgtatcctttgccatggagtttgttagtcattgtttgtaatagaactgttttccattcatctattcatttattatttaagtatttagtcagttacttttgtatacatttatctgtctatctacccatccgtccacccatccatccatccatccattcatcaattcacccattcgacaaaagtctactgaacatgaacatgtatggagatgatcatcctgcatatatagatggcaagataggtttctgttctcaaggagtagcccataagctcatgccaacataagtactggctttagtaactcttcaaaaccccgttgtgttaaggagacttatcaggcccagaaattctgtttctagatatatatccaaaagaactgaaaataggtattatgtgttcatgaatatgaatagcaatattatttatgatagctcgaaggtagaaacaatccaaatattcatcaactgatgaatgaataaacaaaatgtggcatgtacatgcagtgaacattagtcattaaaaggaatgaaatactgatacatgctgcaatgaagttatctagaataggtaacttcatagcaacaaaagcagattgttagtttacaggggttagaggaagaggggaaaagagaatgactgcctaatggattctgggttttcttttgggctgataaaatgtcttagaattagatatatgtcgtagttgcacaacattgtaaatgtactaaatcacagaattgtacaatttattttttaaattttaaataggtttgaaaattttcatcctaccccaaatgtcaaagttcctctctatgtacaacttgaaatgcttaattttatatgatgtgaatttcatctaaactaatgacaagaaaagtaaatgcctgtgacactgcatttttcattgacagggttcctcagtgaggggggaaaaaagcatttaatgattttcaaatgacacatgtaacctaaacactataggacagtgatatttgcctaatctagaaccttctaccaggttgtccaagatgtgcccctagagaatatagcactcaattaatagtgttggatgagtttatttacaggtaaagataattgccttgtgtttagagggtgccatctggcactcagcagccaggatgattccatccaactgcctatatctggtgatttcagggttaatttccttttctgcttcctgatcatatatgagctcatacatattcaaaagtactgtcaagtgtctaggattagcaaagtgggggtaaaagcaatgaaaattttagaaatctattgctgaaaagcttacaatttggataaagatcatcacttttgaagatatgtttacaccttgtaatgagccttttagctttgctctctggcttgattcccaaattcccagcattgattcccaaatctaacaagttatttggtaattgtgaatcactgatcaacaaaaatctaccatcactcctgagaaaggaactgaaaaatgcaggccatagcgagaatcagttgcttctttcttatggttacaagatgccatatcatatgctataaaatgtctatcggtaatttttaaaactgtgattattatgagtcaatagtagtcatttaattatgtgctcttagagtttatttaaaatttattttcatgcactaaaatgatttggagatacaaatagtgaaaagtatatttcttgtaatgttttgtagtaatttttatttggtttcaacagtcaatgaaaataggttaataaaatgtctagtatttcataataacctactgtgtgttacatattataccaagaagtttatattcatttccttttaaatcaagctcatggtgtatggactattatattatctccattgtatagaagaaaaaattgaggcctagaaagaataagttattttcttctaggccacaaggctggtaaatatcagagacaggatataaatcttggtctatttgactcacaaaactgtattcttaataattaagcttttaagatgtccttttacacaaaaataggaaaagcaagtaagataccaataacatttatttaaaatgtgaatgcatagtaagaaaagaaatatgtgtgtgacagcatttttttccaattttccatttggccaaaccagcttttctctaaaataatgagttatgccaaatcactctgctaaaatcaccagattgtacaaaagtaccaataaaatgaaggccatagatacagagaacaatggatttaatttaggccaaaaacaaattccagagatcattctaagtcagtcaactgagcactttgagaaagtttagcttataccaactacaaacaagcagatttatctctaagaaaaagaaaacaaaattgtttccatcttttatttcaatttaaaagctaagatggaatattaatattgcctacttctgctttccttgtttaagcactaaaagaaatcaagcagtcattggaatgttttcttttttaaaagaccctttaactatatgattttaaaaatgtctgtctccaaaaaatgaaaatcaaaacacatagccaagagccaagagacgaggaagaacattctcatatcttttcagcatttggaggtggtggtgattgtgagcactttagactgagccaacttgacctaatatgacaaaggaccagagcttttggttatggtattcatcagcttcctttctcagcatgcataattggcttatatttatgtcattgttgctgtacgattcctacagctgtataatacctaagaactttacttattcaccatctcttttttcctctgccataggttgagctctgttaaccttgaatccgctgtctcctatcctactgatggaagcattgcagcagctgtagaagtgtgtcagtgcccaccagggtatactggctcctcttgtgaagtaagcttgcaagaatgtatccttagtgctttcaaagttccctcaacattgctttcaataacctattctaataagagctgttttttttctatcaataattacacaaataatgtgtatcacttaaaaacaaaacttgaatatctaccaaaagctgtggctttcaattagagtattaaccacataatttcattttgtaactctttctctctgagatattttgcctataactgaaaatctgatgtttctgtctttgctacatatttgatctattgtatgctggatggtagcagaatagcacttcaaaatattttctcttcattttcatcataatgttatccaaaatttagcactctattttttttttacttttctctcattttttaattctgtatcacacttttcctctacttcatttctaagaatacaaccaaatcacaatcatctgaagcatataatcttcagaatgtcaagaatataatatatggaaaaaataccttgatatagaaaactgcctacaggtctttgatttgtttagcacctaatgtttgagatatttattgttgtctcaatatcctagatttataataagattaatggttcttacttaataccgcagtgtgtcatcctaaggtaacaatttttatttgcttctgtgtattttcttttacacagaaaactggtgtgaaactggttttacttgaaacctggtcaaaaaatgtgaacactatttccttgacagagcgcatggctagcagataaataggagcttagtttctttaaaatggtgcctttaaggaatcatttgagtgtactgagatgttccacttcagaacactacctcattatgccatttatagaaatactctaggcattgctttgtcagttctctcgtacttttaaaataatgcatacatctagagatacgcattatagtcatattcatgacagctgtgtttcctttaactgagctcagattcacctttctagaaataaaactagatataacttatagaagtacttgcttttccaaaattcatgtagatgagagaaaaataattatggatatcaattagctatgtcaacccaaatttgattttacatataaaatacacaatgtatttgatgaaacaagagccttttgctcttgattccaaactatttgaacttttaagatcctctctcaattggcataataaataacttaattctactcttgttttaaggcttgtttccacatactttgttctcatcctttgcattatcttttatacaaattctaagtgcccactgaatataaaattacttgaatattacaattgcttaattggctatgcttttagtctcttccttctctccttcaaaaatattttcaatacattctagatatgtttgataaattctgtaaatttacctgtataaattattaataagtacatacaacataatccctgtcctatctgtttagggagacaataaatatctatgaaaaatgggatctcagcactgtataattaagggagaggtatgtgctacagaacatacatgcaataatcattcaaagggatgagctactgcagtggagagagatgcaaagtgtcctggagtggagaaatcttaaattggatgctaaataatggtaacagatagatagaagcatttgagtgtgaaaaaaaaaggagagataataaaagcttcctgtatctgtcacacaataattgtttgataaataaaattactttgtaatccataaaagaacttaattgaatcaagagacaatgaattttggaactttggattttctctctgacttcttcatttcttctactctctaaaattcattttttccttatcaaaactttctgtccctaaattcactattattcagtcctatcctttcattatttcatttgcttttcaattaagtgtagtttgtaaggccagtcattctagccttgttatcactaatatcctgggatcccttaaaagctgagtaaacgccaaagaccattaatgtcttaattccagcttgctgagaacctctggccaaaaaaggatcaaatgactccattgtagacattctcttttacttcatttggggccatagtgttgattcaggatcttttttctcatttctacttgacttcttgtgaagtgttctgcagttaaatctttcaaaaattttcttactttcatagtgctgtcatcatagatttcacttgacagatgagacaggggatatactattaaaaagagtgttatgcaatctcagtttcttcttccatgaaatgaaaataatattaaccacctcatagaattgtttgtttgttcgtactttcatttagctgactagtatttgatgagcgtgtattttgagacaaacaagaccctacacagggaaaatagtgccattaacaatacagatattgtccctgtccccaaggacgttgcactgagtggtggcattaacgatatgccagaaagcaaatagaaataaacgtgacaaattctatgaaggaaataaacagggtgaaataaacagggttctatgataaagttactgcaagtggttgtatgaaggttagaaagtctactttgtaaaagtttgtcaggaaaggcttcctgaggtggtgacagctaaatcgagtgttgaagaatgagagggacaacgatgtaaaaccagctgctaaggaagcagcatagatcgtggagtctgtaaggactggaaagaaggagcgtggctggagccttgtaagcaaggggaaaagtgggacaagaagtgattggaaaagcaaggccatgaggagatttgcacatatgataagaaatgagcattttattctcatggcatggaacatcattacaagcctttcagcagagtagtggagtagtgtaatctgatttacatttttgggttttggggtgttttttgttgtttgagacagggtcttgctctgtcacctaggctggagtgcagtgatgctgtcatagcttgctgcagcctcaaactcctgagctcaagtgatcctcctgcctcagcctcctgagtagctgggactacaggtgtataccaccatgcccagctatttttttttgtttgttttaatagagacaagatctcaatatgttgcacaggctgatctcgaactcctgagctcaagcaatcctcccacctcagcctcccaaagttctggggttacaggcatgggccaacgcacccagcctgagttacatttttttgaagaaggcattatggctacagtaggaagaatgtgtcttaggagggcatgaataataggaaggagaagggttaatatgtagttgcagtggaacacagcaatgacagtagttgctgttaggatcatggcagggaatataaaaagagttagcatattctatatatattttgatagtagaacaaataggacttactgattcgagactgtatgtcaggggagagattaaagaaataaagagtttaagaatgagtcatagatgaccagtttgaatgattgatcagttggttgtggtgtcatttactgagctgaggaatagttggtgtgtgtgggggggtgggggcatggaatccatagtccagtttagaaattttcgatttgaaaacgctgtgaagtgtaaatgtcaatgtgtatttataatattcaggtcttaaattcagcatgtctgtctggtctagagatatgtttttggaaggcgtcataaactatggaactgaataaaattacccaggagaaagtgcaattgatttaaaaaagagagaaaaatagcccagcccaagccctgaggagctcctgacgttaagaagcagggtcaaagcagaggagacagcaaagaaatatgctagaaatttgggaagtgtgatgtcatgaagttgagaaaagaaattgtgggaggaaaaggagtcagctaggcccaaggctgatgaaaggttggataaaatgcaattgcagaattgtccatcgaatttggctgcatggaatttggtgacaaggacaagagcagttttaattgagaggtggtgacacaaaacagattagaatggaatgaagtgtgaaaaagaggtgaggaatataatacttgttaagagtagtgttactgaaaagaaaaacatagatgactagaaaagttatatgaggctaagaggacagttttgtcatttgtgttttgtttatttttgatggagacactagatcatatttttttgtgctgatagtaatgacccagtagaagggaaagttattactaatccatcagagagagtgaatattgagaagataacagatgctggaatcagatgacaagtggagtaatatttctttaggaggaaggaccccacattccccacatcacttgtttggaatgggaatatggcaacaaggtttggagatatatgcttagatctctggacttgttagtgcaaaggcagctttaatttttttctgtgagtaataagttaaaatcactggctaaaagagaggtgtaaggagttgggaagtttgaagaaagaagacgtggtatgagtactgcatttgcagagtattaaaacaaaacaaaaaaacttattaaggaaaacttcatgaatatctgtctgaaaacagtagattagttctctcccttttctcaacatccttaatttctacccccttatgaatatgtagcttcaccagcttttaaaaatgtatattacagaaggaaatcacttctataatgaatctagggaggcaaaaaatgtaatggggagaaatgggaagggatttaattgggagaaatggaaacggaacaggatagaaatttgacaattttgggttggttgtgggggttgaaaaatgagaacacatggacacagggaggggaacattatacactggggcctgtcggagggtggggggctaggggaaggatagcattaggagaaatatctaatgtagatgatgggttgatgggttcaggaaaccaccatggcacgtgtatacctatgtaacaaacctgcacgttctgcacatgtatcccagaacttaaagtataataataattttgaaaacaaatttgacactttttttggtactgttcaaattaaggggaaagttcattttattttattttcagatataaagtatcagtacataaatttttttatgtgttcattattgatgttcaaatttgagagtcctcatatcctgaggcagaaggaacatttccacggagcataacacaattctatatcctttattacttcagtggtttctcttctgttttctttttcaactggaaaagaagggcttttcatgatatatgatgttgtactcgaccatccagaaatatagtaaataacccacaagatgcaatttcactggagggtgatcataagctcttagagggcagcagtatttgcctcatgcttattttgcatctcatccattttgtagtaatccccacagatggaaaacttaattaaggatgatggggaacttagagcaggcactgacacagggaatctaagactaaaataccctgttttaatcagaattcagtttttatataataaagtgtttcacattttaaacaaggaatgaaaaatacaagcaaagttacagaagaatgccataaaataagctatcaagaatgtgagaaataaatcataaactttttgtgtaaatttgagaaagcataataggatggaggaaatttagcatgaaatacatgaattatatatgtgtagaaattagctgtgtatgtggtcaaatataagtgtgggtgctgcctttcttccaaatcatgtcaaagattttctggaaatgatgacgttaagggcaattagtatatgggcaagtgaacacattccagagaatcaaaattgcttgggatgacatcgggtactctcttaggctaagactatatgatgagtccttttatatcagctgccttttttacagtactttttcttctactttcctgtctgtgcttttttctttgagactgtcacatttcaattctttatatctctgctttattttaccatttcagaagaaacaccaagctaatgcttcctctaatctcatacctgccaataacactaaggtcagtgcaaagccccagtgtcaggaggaatagctctgttgcaatgtttcaataatggcaatgctttgacaagcacatttgatgagtttcctacctgttattttctgttatcagaaaacaaacacaaacaaacaaaaacacctttttgttttaatctccaagactgactaaagccttatctttctctcagtcttgttggcctaggcacaggcgagttaacggcactatttttggtggcatctgtgagccatgtcagtgctttggtcatgcggagtcctgtgatgacgtcactggagaatgcctggtaagtgctctcttctttggggatgctgattgacaaggctgaaatcacctcgacagatgctacaattcagctactaccctggggaccttaaacacttgagtcaagaagtgctttgacaaagatctttgtattgaactgaattggaactgagaatgctctttcatatgtgatctccctaatgaatatgaggaagtgtttattcatattaaatcaagaattaaattagaatcagatatatttttataaggcataacttctgattggaagtataactaccatgaatatatatggtttcactttcttccataaatctatgaaaagtacagtgtacttttaaaatagaaaataatttatatccccataatatgaaaagtgtaaaatataacctttatagtaaacataattaagttttcttcatgttgaaaatgaaaacatactacatatttttatttaaaatgttcataatttaactaaatgcatagtgtcatttgtagattaaaaataaaaacaatatgtaatacatattcaccagagctgcttctcctttgcaattaagtctaagctttaaccagaaaataggctttacaaagtgcaaagcactttccatcctgctaagaaaccttaggattggagaattacactgaatagaccattctgattaactcaagggcacattagttttatattgtctgacatggcatgaagcttgaaacaacacttctcctttcattagtcttgcagaaacacaatttaaaatggtgccaattaaggaggatattatactctcatttccctgaagaatttaaggcggattctgttacctgtaattcttaatgttctatctttctcttgctcattttcccccatttctcttctacttaaaagcttctgggaaaaatccaaaatgaaaattcagggcttttgtttcagtgtaatttggcatttaggtttgttgatgctctttcccttttctctatataagattttgtttaattgcattgcattatgaagcatgagagccttaatttgtggatcagtggatttttgaaatgacatttttatgaatagaaagactaagtgattttcattttaattatgccataagtcttttaaaatgtactttgggaaaaatattgggttacctttaaacacttcactaacatgcagtaggaaataatactcagcccaaaactgacatggaattgttttacttaccctaagaagacaaaaataagtatgtcataataccaaactcatgatgttccatatagtcatatttcatgaattcattaggataaaatcaaatcaaattttcatgctgaattcattaggatgaaagcaaattagtccatttgttgatgtgatatttctaaaactagaagccttttttaactaataaaacagtgtcattcagcataattttgagagaaggaagggagagaacagaccctactaatgatgcctagtttactgattttgtttcatgaacagggagataggaggtctccttcaaataacagagcgatcttgaggaaacagtggacatcttgatgataaagacagaatctggtgtttcctgaattttccatcatagctagtaaataggtgatcatgtaggatatactgactttcaagtgccctttctccaaaattgtattgataactaagtgctgatattccattttgagtatatgggttctgatacaatacacaaagaggagaatatttgaatgttgctcatcaagggcattcttactgttcagctgaccctgcattttagcttcttgtttatttttcatggttttaacccagcattaagtagcatggtttttagcatgaaaaataaatttataaatttataaagcttaacttgctttaaaatttgattataaattatctgaaaaatatttttggcaccagaacaaaatctaaacttctgcaatagtgtaggtctatatttaaaagacattttaactcaaagtccatttgaagtaagccaggaagtattcaatgtcacatgggaagatttcatgcttgcttcttctcatagttcttgtggtatgtaatgtgagcaaaattttgtaaagcactttcgtaacaggacacctgtaaaaataaccaatccatcagagtgaagcttccatcttttttttttttttatttccattatataggttgtctgatgcagttttctggtttccactacaaaaatacttgagttttaagatgatttttatttgatgaaacgtgacattagaaaatgtaagaactacatgttatttgtcttttaaatcaataattggaaataaaaaaccctctcaattatgcaagattttcagttgaatgttagaaataccattttcaacatgtttaaggcaaaattaatttttgattcaattttttaaaacccttaagtatttgaagacataattttagttgtatcagtgagataacatgcaaataattttacaaaaaaacaagcaattcttcagtaatagcttagtttagctaaacttaaaaattgaaaggaagtaaaacaaaaatcaaatcggggaaaaaatctttcttcaaatggatccatgttttgcacattaaatcccaatatactgcattattaaggcaactattcatagtgaagctgaccttaatgctatcttttaaaaagttttgttaaaaataaatttgagaaagaattttaaataacttagagaaaagcctgttttcaaatatcaccagttactacagaaatacatatccacatttagttgatgaaattggcacgtgatgtttaaaatttttcaattttctccatgtttaattatgagtcaagcaagcttctcacagatgtaatacagtagtgcattgtccaaaccatcagagtccactgaggccaaaattcatgtctgagctaagaggccatagccccggaggatttctatgattagccacagttcccattaaatcagcaatttcaagctgaacaattgatttttacctagaatcagctacaatttccattaaacatatgttattagtgctctatgactacacacacacacacacacacacacacacacacacacacacacacacacacgcaatatcatgtattttcttaaggaaaataaagaaaaaatgaagtaagatttgcataatgaaaaacattaaaatgaatttcaatcatctttttgtaagtatgcatatgctgaaactactgtgttgtttataagctagatattaaattaactttcaatgctatttctctgctgtaaaattgaccatttaacatggaaaaattattcttgctggcagggagcagactaatgacttcgtagacctatttttggcaacatgttgatccctgacaccaaaataataaactctgatgctcatttctttctcagaactgtaaggatcacacaggtggcccatattgtgataaatgtcttcctggtttctatggcgagcctactaaaggaacctctgaagactgtcaaccctgtgcctgtccactcaatatcccatccaataagtaagtaacaaacttaccccatgaataagctcagcatccatttctgcaagtacacttttcatagcaaatatacacttccttttatcccatgtaaataaataataaacacagacatgaattttttcaggaaaattatatgaattttttcaaacctaagatatttaaaactatgaggatttctaagaatttgtaatttttttagctctagttttggtgatttaatttctaagagtagaactcaaatagaatttctacaccaattccaaagaacataaatattttatacaaacacatacatgtgcatgcatgtacacacctacacacagacacatacccatcttcataccttaataaaaggatataaatacagctaatttgggttctacccatacactatttttttgtgaatcttgggcaagtcgtaaacctctcaaaaagtaaaatgaagggactgatttaactgacttttaagtacccattctatcccttctttttagaaaaattcgttgttcacctagaacaaccacctcttagagcagatttaaaaaaacaaacaacaacaagaaagaacacttgacttcctcatttccttaccttttagaggaatgctatatccagctgcttgaattcacattccctcagggcagcctctctcagtaaacagctaagcacaccccaaccaaaaatgttgttttgtttttaaattgggatactttttttttttttttttttttttgagacagagtctcgctctgttgcccaggctagagtgcagtggtgcaatcttggctcactgcaagctctgcctcccgggttcaagccattctcctgcctcagctggactacaggctgtgttgaataaaaatcaacaatttttactcaaaagtgattataaataactatacttttaaataaaaggaaattattttctgaagaactctcttaaaggtgagcttagtgcttaataaggttcatatcgtattgtacactttccagctatctctaggcactgtgacaacactgacagagcaaaaattttcaatgatctttaagggaaatctgtcagctatagtcttttaatgtgtagatgtgatcaagtaggtcatacttcaaactcttacccagaatgcgcctaattaaaatggtcttttgttagattcaatgaatactataagctaaagactttgagataattctaacattaagtttaaatgttctccttgaaactgtgcttcctactgttaatccacatgaaatgcttatcctcccaatgaccttctttactcagaattttttaccttactcattgtttggaaaagaagagaaagcactactatttaataaaagcagactactatattctaggccaaacactgtatttggtattatttcaccttcaactataactcagtaaggtagatattattatcctcattgtatagattaagaaatgaaggccattagtagaaaaatggcattatgatgccaattctggagccagactctttggtttaaatgctgggttccatactttccagctgtgccactttaggcaagtcactgaaactctctgtgcctcaattttgtcatcattagttataataggactctcatagggttgatgtgggaaagacataattaaaatgtgtaaaccacctaaactgtgactggatatgatgaacccaatctaagagctgattgttattaacctgctcagagtcataaagtattaaagtatcagagttggaattttagttttaaaatccatgtgctttccaaatctctacggtctacaatgaagacttctttaaaaaaaaatacacactgcattttaagtgataacactaaaagcagtaattaattcattggataagtcaatttatctagcaaggttttgagaaaataagacattggtttaatgcaggggtcctcaaccatctatagcctgttaggaaccgggctgcctagcaggaagtgagtggttggcattaccacctgagctcagcctcctaacagatcaggcaggcattagattctcatagaagctcaaaccctattgcgaactgcacctgcgagggatctagcttgtatgctccttatgagagtctaactgatgcctgatgatctgacgtggaacagttttatcccaaactcctcccctgcatctgtggaaaaattgtctccaacaaaagaagtacctggtgccaaaaattttggggaccactggttaatgtatgttagtgatcagaacatttccagggcctaaggcatgagcctgaatgggctcaaaactgaagattctttaacaaccaaggatgttagagaagaggaagaaggcaagagagaaacctgttggaaaataattactataggagaacaaatgaaatatattccttcataattaaaggctactcaagcctatgatagtcataacatgacacaaaacctgcactttggtatatatgcgaagggttagatcacccaatggaagacctacttgtttgccatggctgaatggcattctcttaaccatcttcatttacatgaaactcattgttcacgactaacttgcatttgaggaaagcagaagtattgcatctggccactcgtattgcatctccttctcagccaagatgtcatgagcattagcaccactatcaatccagcagagctggctgcccattgcatcatgtgaattccagctgaatacatattagaattatataattgattgagtatgcaaaccctatggatttaccctcaagtctgaccaacattactataaatgcagaggaaacattagggagataattttgcttggataattataggcattcatgacccattgttgtctctttatttgttgtgcatttacttggataatgggttctaattgttgttcctgaaaaagaaagaaagtctgcaagcattaaaacacaatccatcagtgccaaagggattgggtttccagtgtccaataatattatttcctaaaagatgtatattctaatttggtataattacgttgatcctgatttttaaaaatgcatataacacagtgataacaataccagtaacaccaagtatttaatgattctttcattttcaaaatgttttcacttagagtaagcaattaataattattagtaaatattaataattaccaaattatcaaatattaatataaaatattaaaattagcaaattactaaataataattttacttctagcagtagaattgggactagaatagcaatttattttaaattccagctttcaatgtggtattttaacaagtagaaagagagggcagtgataattcacttagtttataaatcctagaagttttgtgagagggttataatgtcttttacatttaaaacaattttacatttaaaacaattttacatttaaaacaactagaaaattatcatggtttagttgcacaactgtgatgagaaaaatccattttcatctaacaacctgaaatgtttaaaaaaaaaatcactaaacaagacacttaatgacctagggaaactatcctttttaaaaatattttataaaaaacattactgttataatgtgagctagaaactctgagatatgaattgaatatttgcatacaatcctgaagacgagattttaatttccacaggttattcagagaaaaaaaaaaagggagctaaaggttgacgcaaccttcatgggaagtctaaagcttagtgatagttttaccttggtgatttatctatttaatccctggtcataaatcttatagatcacaagcattttggctccaaatttcttagataatattgctaaataaatcaaatatgtaagaagatagagatagattggtataattattatgatgtatgaatacagagaagcatataatatttaaattatacatatatatcaacttcatcaactatttatggtgatcactatgcttggccttctcatcttgttgatgtatatattctagctataggttgtaactaggcagtaaaagttatctggagagaagcaaataacaatgtaactatttcgaatgtttatattctttaatttctggcatcacatagcttataggttaaataaaatatgaaagagacatgtgaatctctgcctttgaatacttaggatgtgtttgaatatataatattattgaagttgttatagattttcatcagttatataataaaatatattattggcacaaggctggacagagataggacctcaataagttctatctactaatatcactgtaaatactactggtttgtgtgggtcaggaatgctgaaatttaagtttttgaaagaatgaaactcaaatttgagttgacctttgggctcactcaagagatcatattgaatgcacgttgttaaaattaatatagagaaatgtattccaagacaataggtaaatttaaggaaacaatcaattcagccatattctctagaaaattgagaatgctctagatgttttagtgctctttcctacacattgttttatgtgcacatgggagattatgatgggtcttcctggttccatatgccaaaggaaaaaactaaagttcagagaaattaagtgccttgatagtgattatacagcttgcttgtggcagaaccaatattggaactcatatattttgactcacctctctgtgcttcttccaatggggctacagtaatagaaacaattacagaaacattgaaaagaagcaaaaaaaaatcaatagaatttaatgtcagacaaactgtaaatgttcactgtaaaaatcagtaaatcttcactgtttggcaagagttatgttaattatgctacatagttacagttatattaacagctatgttaatataagggactagagcaggatgagaaaactgcagatttaattctttaactattaactaaatacctttcacgttaaatcaacatatcttattttgtttaaaaatttgtaaaaaaaaaaaaaaaggcaaagttttttaaaaaattaataagtcgtatctataatttattatggcaatatgctttcatactttttcagtataaaagggtttatcaaatcaatcatattattccattttgcagaatgggaaacaggtttagagaaatatatcgttcaaagacatacttagaaaataaatcaagtctaattaagaaatgcaattgtggagattaaatcagatttcatagtacttaaaggtaattaaagaaataagtgtttgcttaatgattctcctgagaataagtaggagagatcattgaactgaagaagaaaatacttagaaacttcagaaatttatgacgctaacaccaaaatcatgaagtaaatgaattttttctttttctcctcttcctctcagtccctgccccttttcagttatgtgtgaatattctcattaccctcatctccagcttctccactgacattgtgtagccactcaaaatggtttctcttatcctacccaactgttcaagataataattagttgaaaggagtcctgatcccctgttgtgtatgcaaatacagaacatgccctgattttctaaccctaatgatggaagttttaattttatacccatgattaaaggagtgcttgttttatatcacatacaatcccaagaagcaattcattatattttatttcaaatgcatgacagttaaagacacacaaaatattctcacacattgacttaatatgtgtttaattttattttagagtattggattaactctctgtgggagcatttaacgttagaactgaatttcaggacccacagaaggacccacagaagaagtttccctaatgtctgataatcaggaattgttgagcttctattgagcaattgttttgcttttggcttctggctgctctgaatcatttacctgttgattgttcccttttgcattagctgtgaaaaacctcaaagccaaatgttgatccacccttatcaaatgaacatatgttataacatgcattttgaattctaaatacacccttaagtttatcttttttttagtatttttttctctttaaccttgctttattcttaatgcacatattttgacagatagaattaaattctttttagaacaaggttaattgtttctctatgtatgcattcacatacataaacatatatagattgttgacatagtcacatgtatacacatgtatgtacacatatatatgcatacatatatacatgcttataagtagattataaaaataaaagtatatattcagccattaagagggattattttcatgtccagctttttattggttatcccaataacagcttcccctcctcccctatttgtggaaaatgcccgctgctcttggctttcttgtgtttcctgtggcgtggtttggataatccgggatgaagaacattttctgctggtgtggagctagccaaatagagttaaatgacataatcttggaatcacttgaggtcaatgatgatctcacaatttcctctttgtgtcacggaacaattagcttcatgtcttggccaaaattagtgctaagtgactgcatttgccaaggcaaattctgtagatgttttttattgtgcatgtttatttctcactctaattttatttttgttgttgaatgccatcttctgccatagctgtaactgcaattacagcaataagagagtgaatcttcagtttatgttgttgaaagaatatcaaagcacaaatacagatatattttatgagaaagttttatttggatgcgttatgtcgagtatctatattactagaaacttaaacttacttaattcttaccagtaggtttcaatgacaattggttataggaagaagagaatatcacattaagaatctaaagtcctagatcccatactaaattctcctggaaattttgtatatgaccttggttaagaaaaactgtgcctgccctaaccagctcataggattttgtgaaaatgtgataaaattgtaaaagtattctgaactgtaaggagctagtcaaatttaacatatttttattgcctaatttttttctcgaaaaagtgttgatttttgtcagtgagcaccttttacttatgttggttttaactgacatgtgagtgtatttaagaatctgaaatctattttatgaatagctttaaagtgtcaaggccaggtgcaatggctcatgcctgtaatcctagcactttgggaggccaaggcaggtggatcacttgaggtcaggagttcaagaccagcccggccaatatggtgagaccccatttctactaaaaatacaaaaatgggccaggcctggtagcacctgcctgcaatcccagctactcaggaggctgagacactagaatcgcttgaacccagtaggcaggggtttcagtgagccaagattgcaccactgcactccagtctgggcaacagagcaagactctgtctcaaataaaataaaataaaatatttttaaaaatgtcagaagccttgtcaaccaccattgacaagagttatgataaactgatttaggattataaaaaacaattggtatggttttctttcaatcagtgtagtcccacagaggtgggaaacccagtgcttctggttggagtcagtttctcagtagatgatgagatagttacagaatgccaattttcaaagaagacatatatatgctacagagatgcagttctcacttttatgtctgaaaacagtaacagcaaatcaccggatgtggatgagaggaaatcctttttttttattttattttaacctgtgcatcttcagtgcaatcacaatcccgtcaagaaaatcacccatagtgaactgtctttgggtcatgcgtagcaaagtacaggatgctttataaaaggagattctttactcgcagtgcacacgctgggtatgtcttgtctgctgttcatcacagctaccagaactccttaatgtggaatctttgatccagataatatttataaattcaaagcatcccagaccagcctttatctccttgacccagcagattcatttagactttccactgagttgaaatgtttaaaatgatagacttacctggtcctaataccttgctagtatcccaaaaataggaagaactattaaatctttacagaactaccctgagttaagccagagaaatactattcagaaatagtgttcatgatctgatctgcaccaaagttaagaaagtatttcaaagtaattcaagtgtcaggagcaggatcaaatcaggacttggaatgtttaatttgttgttatgtctttaattcatttagccatcaagcaagtctctattgaattgccctgtcatatataatagaaaacaaatctacttagggaaaacataataagagaaagattaattgagggcatttccctttaaaacggtagcgcaacagaccttacagaattcaaaatggttgatggcccttcagagagccagtcgagaacgcattaccgtgtgtcaatcttggggtaggggttcatgtatgagaggtgcctctcacaaggcaaagaagcatggctggagtgaaacatgttgctgaaagctaaagctagcacctgagttctctgttggttcttcatctggtgttcagctctattgcttcagacccaaattagaaatatgtgcaaagagagaagtgaattttgaaacatgccagagggtatgagatggcaaggttgcttttgtttggttaggtttatgataagtttaggtagaatatgcacacttgatctcttctgaaagctttcctgaggattccatcagtgtgagggcatacctgcaaggaagcacatgccgcagcctgcacacaggcacgccccactatggcagtagctgaagaaggaagcactgccaccaccactaccacatactgagatttccaaaatcactaacaaatttctccaggctgcttcaaattcagagggatttggctacagaagaaagtatgtgaggctgcatatgtgccaggcctggaggaatttctaaaaagcagctatacatttccacttgttactgatgatcactactcagagcagtcgaaagtcagttaataacatgtcacagggatactgctctccactgggctatattcacgtctgcagaaatagcaatgtcatttcatcctccattggccagaccctaatctctgtctctggggtgagaatgaccagcctgtactcttttgtcagagcagtagtggagagagagaaatgagaaaatgctaatgactttgtgtatgtccttcttccttgtccctgttttccgcaacaacatcaacatagctttagcccaacgtgccatttagaccggagtcttggattgatctgtgatggatgccctgtcgggtacacaggaccacgctgtgagaggtaagagtatactacactgtcttgcaaaatgatttctaccttgggagttataaaaccgcagatacaatcatcctttgcatcatcctttggagaaaaaaggccacactcaatgaggtgaaataaagtttctcaacgcacttgtcaaacaaatgcattatatttttgtaatttatttatttttcagaaattgcttcataaatcttcattcactcagagaatatctgattaatgttttaatcttaaaggttaagtattaacctacaatctttgtagaaagcattgctcaagtggaaagtcatgcactttaagatttatcttactgtctgtgtaggcaccatttatttttcataattagctttttgtccttaaaatgtagcttaaatgcatagttcatagttcagcaagtggttcataatttactttaaatatacttgaaaatagaaacaaaatgtaatttattatcatgatttatatcctcttctaattgctcctaaaccagtattttaattcctgttgattttactgggttgctttgcagcagaaacaagagtattattttatgtaatttgtgtgattatatttccttctgaaatgtttttgaagaaataattcttctatatattcagcctcagcataaaagtgatacaaacttcccccttgacatcattgccaaaaacaaaaacctccctctggtttcagcactggaaatagtccctgctgccacccttcctgggagggaggggtgcaaaggaagtgacctactttcactcatcatcactgaggctaaccctgaagagggctgtttctgcccgtcttttcctgtcatcttggcagctatcacccctgtttcaaccaggatgcataaaattaatgaagcaggagcctatcacccagagagaatttagctagcaactagcagtctgtggacaaagtgccaatgacagttcctagcagcaacaagtactatttgtgagtatggaagcatctgtaaattaggaatgaaagaaaaaaaaatgaaacaagcagcatttatttgcaatcaagaaactagatatctttaattgtgtgtgtgtgtctgtgtgtgtgtttaaagaaaggcatgtgcatattacttactataataggagaacatatcattgccaagacagatttacatcaagtgcctaaaccccccagttcactacaggcaacctttttttagcaactggaaaatgacagctgctctgtcatacaaggctattaaatccacttatctaggtgagcataatctctgatgtacttatattgctttgctttatgtactatactccctatacatgttagacaatagtttctgaaccatctataatttaaaaccctacattttatttaacaaacatctgtttagcaactaccatgtgctgggtacaaggctagacattggatataaatagatgcattttcccatccttgccctcagcacctcacatctttctttaatgcaagtgaggatggttgcttgtattcttgggagaattccatttgaatagtaaaaatcaccaaggagagaaatacctgacagaaagtatgatttcctgtctaaaatctgtattaatctgattcagaagatggcaacatgcatatgcagtgtaatgaatggcatattttatctccagctcaagtttttccacagttgataccatatttttctagccagaatttagattagggttttccaggaatatttaagatttataatttcattgtatttatgtaagccaaaagaacaccttagatagatctaaaatatgagggaaacattttttgtttgagatgtgcctgttgaagtagaagagagggaagataagggtcagggtaaggaggagatactggttgcattaaaaatcttgtaatcaaaaccattctgtaagtgatttgtgtgatcagcttatgcacatcatctaaataagaccagaatttaaaaactaaatcaacatttcccaaattgtagatgttcctggaataaagaattctgtgatcacatgagtttgggaagcatccatttgcatgttaaaagttctggcatgtcctacagtgtgtaattaagaaatctgttcaatttgtttagctcagcatttcctaaacttatgtggccataaaccctctgctttaactatatagcaagaatatatctcagactacagctcaggtgggacaagagttataactttatagtctttatcacaatttaatttctattttgagacccctttctctatatgtgggaactgtgaggtcttagaaacataatctgagcccatttcaagttgttttcttctcctctctcccagctagaatcaaagttctattaagcttacctagtaccaaaggccttatatgcaagggtagaggggagggtataatgtctgtgtgtatatgttgagcaaggggacatgtgatagggccagccagtactgagtatttcacccaagcatgtttctgctgacctatccctttttctccgtcctcctaattacctttcctttcaggtctagaaagtctctcaactactttcattccattcttagaggcacaggaatcattcagcttctttcattccatgctaagacccaccaacatctctaccatcatcatttttccatctgcctttccaaatccatcccattttctatttgaaaaaggatgagctacatttgtggaactggtggctttcagagctcggggtctggcagattcctatgtctctgccttttgccctgtcaaatcccttcattcaaacatgtagcacaagatggccttgcttcttgaatcgagggggtgaagagaaacagtgaacaggggaatggccaaacaagatacaacaaaacatggattggtattctgtcacaagttgaacactagttacagcttggaaaacattcacttagggccaaaacaccactatttttgaggtatcactgctttgctggggaatgatttaaacaaaggaaaaaaaagagtcagagagtgaggggagaaggtattcatgatgatacctttgctaagattctagacttttatcatctggacaagaggagaacaaaaataacaaagagacagaatcttgaagggctaaaagagattaagtaagcaattggaatatcaagagcaattaaaaagactgttgagctaaaagtgagtcaaatgctgaggatacctgcctgatcggacactaagttactttcagaataagtttgtaacctcagcaacatgtcatacattatggagaaggcatttcaaaaaggcaggcaagttcatctggtggattctataggacaacatgaaacttaatgggatacatagacttcttaagccctccccgctccccagctggcaaatttttaacaacttctccttaagtgatgagagaggggtcaaaagccaggactaatctcacaattgccactgaaaatgtggaaggtgtttgaatctaattgcttaatattttgaaaattcatctacagttttatcctcaagattcatactagatatcaaagaaattcctttttgtatcttaaatttcagttccaaaatcccatttagattttgtctgcttcagaatgtctgaattcgaatcaagtctaatcacccctctgcttactatgctcatgggaccttctattcacttgtgagtctccttgtgcctttgggtcctgaatgcagagcatgggctacagaaataacagaggaggggcagttatacctacctgtagtactgttagcaaaattgtgactccagttgaggtgtcaagaggccactcatatgtggttgtgcagtttgtacactgcacaaaggcactcagggaaggggaagattgagggcttgaatccagtttaccctcttcttttccatgaagtccctgggtgtctagtctgtttactttttctgcatatgtctagaaaggacaatttcttccaacttgtaaaaggcaccatgtgagcagggaaacaccctcagtcttttgctgattatgtcaaatgggaggaagtaagaacacagcattacagccacgcctctttatacagcagccaccctcttctgtgcctttgccaatactgttccctctgcctggaagattgcagccctttcactcctccatccgagactaactaatccctgttcagctcccaaaagtcagcactatcatcctgaaaatgtccttgattgggcctaatctgagttggttgcccttttgtgtgctgccataatagcatttgcatatctccagttgttctactgctacgttttaaaatgtgtgttcattctccatggactgtagtgtgaagactgtaccttatttgtattagtaccgtgtaaaagtgctcagctgattttttttaatgggttgggagaaaccagagcttttctaatttgcttggctagattaagccagcattatattgtttcattgttttcagtgtatagataatagaaatgtaggccgtgattttagccaaaagttgctgaaaaaatgatggggcagaatgagacaaaagtctcatcagtgtggttgctttcttctcattgttgcttgtctgcacgtccgctctttttctacctctccctctctctcttcctctctccctccctccctctaacattgttcctaaattatcaatagcagcaagtgtaacaaataactgcatgtgttatctggagtcttatttacatttaaacggccctttttcaaaatattgcaatttgatttgaaaaagttaacagatgtggaaaggaacaatgcctttgttatgtcaagatatccgtttctagcaaggcattcattcgataaactatttttaaaaatgcactcattctgccttgcatatgaaaatgagagggcttgacatttcacattacaattatttttggtggagtgaaaaaccaaaggactgtgatttaaactaattttaattaggtgaatccaacttgatcagactctaacacactatttttattaataaaagttatatgattagcagtattatattctctgaccctcaaattactttttaattcctaacggaacaccttcagaaatctctaatactgttctctgtatagaaacacacacccatacaccagtaatgtgctgaagtgttgcagaaaatagtcccactttcagtaacatggcatatgaattttctatcacgtatattcacaaattttccttacacgtcctgcaagaaaaaataaataaaagacagatgcttctttagttattctatttaattatagttattttcctcctgaaatgagtttttttattatggagaatttcagtcttattaattgctatctaagttaagaaaaattcccagatctcgttatataaagctatctctccaaagggcagtaactcatcttgaggaaagtgagctgaaaataataggttttcgtttgctgtgataatgatcattgtatatccttattccagtggcacaaagtcactctcttagtggtaaacaaaatgagatgtgaatatatgtggatgtgatcataagctctgaatattaaataagacaagaagaatcaggttaaaattcaaaagaatctccttcttatctttatcaaatgcctctcttgaagggattttgggggaattttgtgcactcaaattttattgcatattttataatacagaattaacaaacaattatatctgtggttggcaatattcttctaagcagtatttatacaactcataagtgtataaaatcttttgtgaatataagtaatttcattttaaaaattatgataaaacatcaaatctatgaattatagtacctaagtacctatacattttctagaaaacttagaatcatcaatgtatctgcaccaaattaatggctctgccccagaattgggatttgttaaagtactctcaatataatgtactggatttaaaccatttttatttcaaatggtagagagcctttctctaaataatgactgcatatctgtgagtagatgagcataaaagtggtgtactactgaggaaattatattctcccacattgtttttgatccccttcaattttgacacttgctgcaaaagactttatcttggtaagatggcaaagataacagagctagcctgaccataagattcagatgccctgttctgtttctcctttggcaaatgtggcttagtataaagtgtgagcaaatgtcattgaaagagaagacagagcagaatataaataggcgctgcctataaggacgtttctgcacacctgtagcagtaagttgcattttaaaacataacatttaggtcagagaaaatttgctgctatcgtttttaaaaatcttctttgccatgccctataaacaaacttttgtttttccaataatataatatattatataaatagttttatattatattatatttatataatatatataataatatataatatattatatttatataatatatataataatatataatatattatatttatataatatatataataatatataatatattatatttatataatatatataataatatataatatattatataatatattatataatatataataatatataatatattatataatatataataatatataatatattatataatatataataatatataatatattatataatatataataatatataatatattatataatatataataatatataatatattatataatatataataatatataatatattatataatatataatataaatagtttttggtaagaaagaaagagcaggagacaaagaaagaaagaaacagagaggaaggaaggaaggaagggaggaaagagggaaggagggagagagggagggagggagggaggaaggaaggaagcaaggaaggaaggaagggaggaaagagggagggagggaaggagggaaggagggaggaaggaaggaagagagagagagaaagaaaggaagaaagggagaaagacctggagtttgctaatagagttggcaggcacagttcagtatcaccttatggcatattcctataatatgcaggcatgctttctcagacttccctttagtaaagccttcaatgaaaatttgcctctgaattcatatgcaaatacatacaaatagattattaattcagatatacccacagctcccatccaattaataagaatcttctgagtcacagtttctagttaataaattctgaactcttattactgaatttccttgcgagcctgtttcctcataacaagttctggctgcaacaacaacaaaaaatgtgaaccttacatatttgtagagaaaataaccaattggagtagagacatatgatgtgttgtactacaaaggctttccaacatggacctggattcctccagagtgccagcagcagattcttattatgctttggtctcattttcagtgccagtgacaagattatatatttttttcgggctgaaatctaattactagtgggctggcaggatatcatcttgtatctacactgcagttgtagaaaaacatttttttaatcacgttgcgtttgagaaaaggaacacttaaaaggaaaatccatcatcctgggagaaggggagaatgaaaaatatgtaaacattgccccaactgaggtccccccaaaggctcactgatgaaatttcttgccttaggtgtgcagaaggctattttggacaaccctctgtacctggaggatcatgtcagccatgccaatgcaatgacaaccttgacttctccatccctggcagctgtgacagcttgtctggctcctgtctgatatgtaaaccaggtacaacaggccggtactgtgagctctgtgctgatggatattttggagatgcagttgatgcgaagaactgtcagcgtaagtcctgaactattgatgcccctgacagaattgatgtattgtacctcaaagtagctgatgagttcttgagtgtggattgaagagtaggaaattatgtggaatacatggttgatagatgcatagaatatacagagtctgcatattccagaacatttccttgtactaactaatagagtaaatacctttaaaattgctgtggtattgaagcatcactgttttccaaatgataaacatgtttttatttacatgcggaaggaagatttttttaatgaacttatgtccacagcaggaaagaagaatttgcatattagatagacaccatgtatccatttttttatctcaattctaatcacttgctttaaataattttttctgcccatgatatttcagtagtagccatcagaaggtgttaatcagttatgctttcatatgttaactttacagtgtcgtattttgtaataggtataaaattctgccaatattttcgcacacaggcatttgtcattgttgaatgattaacctcattttagtttcataatagtcatttaaggactatttctagaatgctctttcagtgttttccttccacaaaattagctactctagggcttcatccatattagtataatacatttctcccctctttaccttttttgctgtattaatactacatagaatttccaaatccttaatgtcagtgggattagaatatgaaggcggatcttgttgcagaagatcaaatggaaagtgaatccaatgttagcatttggccatcatcagcttcatttactatcataatgtttaagcagagtaggttatgagaccagcctatccattcatttctgtcaaatttatgtgagagactcttccaattattcaggtgggtcccaggacatgcagaattatagaaaccactgtaaatgtagcctattatcaactctactgtaagcaccaaagacccagtagggtaccctatttcattaagaaatgtgtctctctcatcacaggtttagaagatgagttctagctttttgttatttaataatgataattcattgaatcaaaaccaaatcactttctggaccaactggcagctgttaatataacctgtaaattgatctttttttaaagcaaaatttccaacagctcagtgcctttaaacactggattcctgacaaatgtataaaatcatagaaagcctaagaaattcttcctttcccacagatcatctaggatctacattttctagctgtgtgctcctgagcaagatatttgacctccttgagacacagttttctagtctacaaagagagtcatgaattttctgtggggactaaaggatttggcacatagagggtatccagtgagttcccaagtcctggagatgctcacacatggtagctgtctttggtagcagtgctcatagtagctgtgcatatcagttgttcaccagtgaattctaaggctaagttagtcatttactgacattttatcctgtcttccaataacccccacccccataaagttagggatattattccactaattttattatggtaatttattgtgggattattttattatggtaattaattattattttattatggtaattaattattgtagaaaattattatgggattattttattatggtaatttattatgggatccatggcatgaagtcttaagaacataaaaaagaatgtgagaataaaaacattttgaccattaccagttttcatactacttgccgtgagtatagatgtgattataatttttaatgctctttgccatataatcacaattaaaagtataagaagcacatttattacttatttttataatttttcatggatacaatatcacttctatgcataagtggtaaaacctcaaggaaagaaagttcctggaaatacattattttggttacctatagatttgttcaagaaaagtacaccactacaaagaaatatattttgcattttaaatttgtgtatatcgttggtgtcatatttttccattaaaatgacactttagcaaaactttatactgctttgttgtttttacgataacattaattaattaccatcatatttatggtaaatttaattttgtagtttacactccaagaaaaagtgactcctaaagtctaaataatttgatattttaaaaatgtatgatatgcataagaaactttcataaaataataaaagtatatacaaattcgataaatcagatgaaaatggatatttaaaggaaaaattttcagcctttccttgtatttcagctatagactatccgtaggctctttcagtttctcaatggcccttactctagtatccccttggcagacactgaagacaaactttgctggaagataaattaagcagtttttagaaaagcagttcttttgtttgtttatttgtttgttttttaaaaggagaacctagagccaggagaataaaatattagcataggctgatagagtacctgtttatagcttaattttaggttgtgttcaaatcaaaatattcagaaatttaacaaaatcatctatgagtagcctaaattcccatgtcatctcctccttgtatttttattctgatataaatgcaattatatgtaccattaaaaatatagggtacatagtaaacaattaattactattctatttgtgaaaaggtcacttaagctttagactgatttactctacgttttagaataacctcagacagctttataacaaagcaaaaaagacaaaagattacttaaatgaaatatgttttgtatgtttggagatagcatataaactgtaaaataaaagtgattcttaaatgttataatgctatagtcttaagatacttgaaatgatgtttttgttgtcttttaaacttctgaatcttaaaaaaggcataaatatttcacctcaaaccattttttaaacttaacacaaaaccggcacacagtaaatcattaaatcaaaaaaactaactaaatttttctagattaatagtaacattaaaattttgccaggggtgctattaattttgaaaattcctcaaaattattttagttctaaagtcagtatgcattacttacaatgggataatagtattttaagtgttaccctgatgtatctgtaaagaactaaaacagcgttacaccttgagtcaagaactccaagttcctgtcacgttctggactcacctatatgacacagcaggcatgtggacttgtataagctatggcttctttgaatttcagtgtcttcatgctcaaaattggaatgatgatgatgacattaatattttaatggcatatgatgggccagacatgatgctaaagcctttatgtgaattatccctacagcttgtagagttgttatagggattaaatgatagaatgcctaacagggcacttaacaaatcagaaaacattctgttactgaacttaggcgtccatgttaccatgtggggtatattattatttaacaagcctattaagactattagaaagttttcctgatcacaggtctctcttctctttgcagcctgtcgctgtaatgccggtggctctttctctgaggtttgccacagtcaaactggacagtgtgagtgcagagccaacgttcagggtcagagatgtgacaaatgcaaggtaaggagtagaggctgacccataaattactttctccttacagattttcactggcttttcatgacatgttttgtataccttcgtatattaaaaggaaggtttgggattatctaattctacaattgaaatgactgtgatcagtgaaaagtttttttcaaactagaacaaaattcattgtacattaccatttgaccttaaacatttttttttggcagtgaatgtgtattatattcgctttaattcagacatttctgaaacaaatagcaggcgaatttaatcttaatctgtggagatactctttcctttgcctttacatttttggcagaataaaatgttactcttggggctgggcgcggtggctcatgcctgtaatcccagcactttgggaggccaaggcaggtggatcacgaggtcaggagttcaagaacagcctggccaagatggtgaaacaccatctctgctaaaaactacaaaaatcagccaggcacggtggcaggtgcctgtaatcccagctactcaggaggctgaggcgggagaatcgcttgaacctgggtggcagaggttgcagtgagccgagatagtgccactgcactccagcctgggcgaccgagtgagactccatctcaaaaaacaaaacaaaccaaaatgttactccctttgctttttagcaaacaccttcttctagttccatcatttaaaagctacttcctgtgagcagtctacctaatggaagtttcagtagagaagttaatcaagatatttttaaagatgcattattttgctaaaacaaaatattcaattaaaatacagcatgttgttctcagtccctgaacataccgattgccctgctttcagtatggcaagcaacttcagattcctccatgagggtggacagatttgctctagcgctttcacaaaaatacattgtatttgtgataaagacagctaagcagaagcaagcatttctccgatgtcaaactggccttactgtaggaagtttgaaaatatcatctgcttctgtctcttgaataatatcattgctctgttttgtttttattttattttatggttggtttttaaagcccaatatgtggcgggatccagagaagcgattctgtgtgctatgtgactgcgatcccgttggctctgtgtcaccgcaatgtgatattacaggaagatgtgtctgtaaatcaggcttcgtagggaaacagtgcaacctcggcaggcaggtgcaccaacaggaggagcagccgcggagagcgcaacgggtgctgggttctcctcagaggtgggctatcggcagctccagcgggtgccctcggggagcctatcgggccccagctccggtaatcccagaggcgctgcatggctcatgcctctgcatgttgtgttctgtgtgctgtggctgaagttccctggtggcattttaccaaataacagttgctaagtgtgcaaattgcaaatgcaaagattagacaattcctaattgaacccttgcccttttaaaaataaccatccgtatgctttaaaaagcatattcaagttcatagggtcataaaactttcaattaaccaaactttcaattaaccatgaatatgtggaaatcaaataaaaatctacttgagagaacctataatcttagaaatggaagagacttcaggcaacctttggggaaagctaactttaataaatgaacaaatgaaggaaaatctagcagagaaattgatttgtccaagaaaactcagcccatttatcaggcatttcatcataattaagaattttgttaatttccacatcaattgtgcttatgtgtacaacaaatgcaagaaacacattttcacacactataaatggacaaatacccaaaacggggaaagttgtttctaattacaaaagtgtggttctcatatcacaggacaaaacaaaacaaatgctggggaagaaggaagagagggagggagggaagaagaggtcccaggctgagctgcagaagagtaggagacaagacttaccagtatagagtcaggacctgtagagaattgaggatagggcatagaagaaggagagatggaaataaaaagtaaagaagaagaagtaaaaaacaattcatggttttatttcttggctcattatcacacattttttaaaaaacaaattttgatgtcagactgccttagatcaaatcctggcctcattacttcctagctataaattccttgaatctttctgtaattcagcttcttcatctgtagtaagatccacttcagagggtttatgtctgcttacgtactccaagaagcaaatgccaagaggtttcctgggggaaaggccaacgaagcatgaagtgggagacagcatagccttctgctgcaatggggttctgactcccgggaaaacacagaaagaaagactgggtaggaaaagccttgtttggtgcattttgtcaaatcttaaattcttggccaagccaatgggatatacccaagcaaattttacccactaaaggaatcctgaattggtcagggaggttctagtatcttacagtaatcagcctgagagaaggatactcttgtggaagctcatcttaattcattcagagtgctataagagcataacatagactaagtggcatgtaaacaatggaaattcatttctcacgattctagaggctgggaagtacaagatccaggtgctggcagatttcctatctagtgagggccctctttctctagacagtcatttacccactggaacctcacttgggggaggaaactctctgaggcctcttttataagtgcagtgatcccattcatgagagctccattctcatgacctaatcacctcccaaaggccccacctcctgtctataccaccaccttgagggttaagatttctacatatgaattttgggggacataaacattcagtccattacagagcacctctgatgggtccaaaagacaagaaactggaggctttcagtcagtaaaattccacactgtaggttgtcttgcaggtagatcggatgaggcgcctccaaggctgtctcagggtagcagtgagaacagtgcatcaggcaggagcatagagagtttttagtaaatgttaggcctgattactattattattaccaatgttgttaaatgaagaaatgtttaaaataattttttttcaaaaacaaatgcatacatttacaataaaagaaaaagataataactgattaaaatgtctcctaaatataaatttagcagaaagtcaacgttcattcaagccctacatatcttacagtactattgtatgaagcagggttttgtcccgagactattttttcctctgcagcagtatgtgtgagagctgagagctcagactctggagccaacctagctgatctggaatcttgactccacaattggttagctcatgaccttaggcaacttacttaacctttctgtgcctcagtttcaccactcaataaaaaagtggtgagaatgacaactctctgccagggttgtcctgaggagtaaatgagtacatatttgtaaagagtttagatttgtaaagggtttagaattgtgctttgcaaaaaggaagcacaatatatgaatgctagttcttattaccccgagagagacacatttatgggaacctatacagtttctcactgggtctggatagccactctctcccatatttattttacctcattaatctcaattactgaccatgaatgtctgctccttaagtttgtttactagtggggttttctttagcctttgaaacaaatttttgaacaaatttgtaaacattttattactgaaatttggtagtatttattttgctacaacttagcctttaaagctacattatttaaatatttgaaaagtgaggtagaaccgtttcttcttgtatatttccttacataatcgactttggaatttttaaaatgatagctataatttggaatctcatttgatatttgattgatttaaaggggtgtacacacacccctttaatgagtaaatcaatatgagagtgtggatatatagatgtaaatatatatgagtaaatgtatatatatatgagtgtgtatatatatgtgtttatacatatatcggcatagatatatgagtgaagacaatttctgaaataaagatgaatacaaagtattatttctatgactcagatatttttcaataccgttttaatatattatgtttagtctttttgtctatgtatttctgtttctgtttgtgtgtctggtggtatgggtatgtaattgaaatttacatagtatttatatagtttcatatttttgtttaatttctatttcatgctatatcctaagcatatttatatcattaaaactgcttcaaaacaggattttaattcttgcatattatttcataatgtggatgtcatcatttaatttattcaacaatttttataacattgtacagttaagtgcctgcatagttattcaccatgataaataatattgtaataggcatgcttttgctttaataatattccaatttctgattatttctctaagccaggtatctaaaattttacatgaatttcttttactaataatgatattatatggttagttttttttatataggtgaatttaatttcaaagtcatgtcatctgttggaactgttacatgcttttttctttaatcatataccacaatctgaattagaactagaaataaaaataaaaccaacagtaaatgtaaagatgagaatgatcgtcaaactcagtcaacccattttacattttaaaaataaaactattcttagctacggtcattttaaaaatctaattttcagtgtgatttcacttttataacttatttttaaaactactaacaataatatctaaaatatataatgaggcttattaatttctctttgggtggctcacgttaagtggcaagatttttttttaccaagaagcaattattaagtctaattttccaaaataagaattatttttacaaagaagtaattaccgagaataattttccagattaaaatatcataataatgtgacatgctttatatttttaaaaaataaccctgaagtattttaagcaggatagatgattttcatttttctgctcggagtgattttttaatccatcagcattttctaacgtttcattttaagcctgataacatgcatttcaagaaagtcagccgaagctggtaatgcaaacttgaccgtaaaagatgatttgttatagatagataagagatatgcatatgaataactcatcagagaatgaaagtttacttacctgatctggtgctttaatacgtgttctcactaatcaatttcaattgttagaatgaaacctaagaaatcaaatgtttgttgaaccaattatttgatcagtgtaagcataacctgaaaattatatttataatgtgaacactatagcaatgattaaaagtatttatggatatgtgacaaaattctatcaaatattagggcaaaaaggattattttaactttaggctgctggtcaataatgttgaaagtatttttaccaagtaggagtccatagatctgaaagtaatcaattcagattactaaaaatgaagaagtaaaattttaaattaagactagaaataccacctataggtcctttccatattgctattgaaatcttgagaagtactgggacaggctggtgaaaatacaacagacagtaaaggaagcgcctaattctgcagttaattttgataaaatttcagaataattgaacttttctctttggatatcatagaaaaggtccatttgattgaatgaaaacccaattgtcataacatcagtgaggaatcctgataactcctaagttcctctgttcccacctgatctttggtattgtgcatcttgcttcacttcgagttaactgatttaaatttaatttttctctcctcttccattgccaggctgggacctttggcctacaatcagcaaggggctgtgttccctgcaactgcaattcttttgggtctaagtcattcgactgtgaagagagtggacaatgttggtgccaacctggagtcacagggaagaaatgtgaccgctgtgcccacggctatttcaacttccaagaaggaggctgcacaggtctgtaaatatgacttaagtcctacatattcactctgatagttttagggtctgacttctgtaacagtttgttcttttaaaggaagcacagattgatacaacgtatttaacataatgagtaatgtctacttatttttacgttacttaaaaaatgaaatacatgtcagtttgaaacactgccttaataactgtgtgcaagtactcagtaaaaatcagcagatgctcgtttggttgtgtccctccctgtctgtgactttgattcagccagtcactcaaacactgctacggcttgaaagttaaatgttcgatttttctggtaccagtcttatcttagtttaagctcaaaccccacgccaatgcatttcaactttccctttttcctattgcaaaattggtatccggatcaagaaaagtcaaggtgttttttttttcctggtaccccaaaaacatcttttcatctacttttggctgccttgaaaactatgatgttctaagagagaaataggttggctctagatatttagttcatcaaaaaatgcaggcagaggtttctaaccatgattccctcaagcagtattcttatacatccagccacagccttcacccaaatcatgagctaagaaaatatcacttagcattctgcagatgaaagtaaagagtgaacattagccttgatttatatgctgctaatttcgaactgacccttattccaacaatcactagtttgaatattacctttgtttactaatgtcatggattcaacctggataatgctcacatactctcagcaccatggtaagattttaaaacattgttattcactgttgtggcaaatttaagtaggaagcagtaggaataatatttaaaactatttaaagaaccaatatctttcagacattctccagcactttagatatgtggattttaccataaattaagccatgataagttattctaattgataagttattctaattgataagttattctaaatgataagtttataattgtagatcctctaagaatctgtatatctctaagccaatatctgtataacttaaaaattataaagctgtattttaaaatatactctgttctttaaatccaaagctcactgacatttttacttaatatgaattaatgaggtagtattatacatttaaatacatatagtaacaaattataaatgagaccaagaatattattttaaattatagaaagatgacagcatttaataaatgcagacctactagcattctggcccaaagaaacaccatagaaaaaaaaaagcacaaaacaggaagaatagtaatatgactgaggacatgacttgcacaaaatagcctggatttgtctaaatggctccttcagtaactagttctgggaccttgactgagtaattttgtttcattttccatctgcaaaattcatctattaaattaagataataatagtatctaccacacatggtttttgttacaattagttgagttagcggctataaaatatttagagtaatgcctagcatgtaagtgctatggaagcatttatcattattattattatctttattagttttattaattgtgttatacattgtgctttggcacaggaaaactagctaattactcaggttttctttctatttagtgttatgattccgctgaagaactacttaagataatttctatttgcaagtaatgatttgcactgtcccatgacattttttagcatataaatttaaacataatggtaactatttttcttcttaatgaaggacacatctaaaataaatcatttggcttaaaattagcaacaacagtaataaccaaaacagcaatgactaacatttatttagtgtttactcggtgtaaagtatttttctaaacaccttccacagctggtgtgtaatgctgtgagcaatgaatattgtcatttcataaaaagtgaatttagtcaaatattctaaatatattcagtgaaaatgatttagtcatcatataaccaattaaaagtttactcataacattagtcttccatttgaattcaagtatttgggtttcttccctcacttacatttctttgacatgaaacgctgcactagaaatattcttagtagctgggtcaactgccgctatgtggcatgcattccttgtcttggatggctttgaagatattctcaaacattatttttgcaatctttgaaaaagtacaaaaggtagataactttgtaccctttgaatattgcatgatagcaacaaaaatgaaaaatctatagaaaaaagtcaggtggtaaataaaaatcgaaagtatctttatatataaacagtgtccataattcaaccattttaaagtatttgcaaaattggattattctgttgtgtgcgtttctaactatatacatgatgtaccgaatttaagaagcttattaagcttattggtttttactgcagatcgggctcatcaaggaaaaactaatccgtacagcataaacaaattagaaatgaacttaaaataaatatacaaacaaaatagtaaactttgtagtacccgaatataaggtgttacagttaacatggaatctgataacaccaattctttcctttcttaaacttcataggaaagctaaaaatactttaacttttgaaattaataaatgaaatacatcttatatttattgaacagctcctttctgaaatacattgtactataatataaaagatgaatgaagtaagtttttatttccaaatatccttaagtgtagaactgaaaagaaaataagacaaaccaacacaatataaaactcaacactttgtgtcaaatttttactatttttccccttctttgttttccctcttataccggtgaagcttgtgaatgttctcatctgggtaataattgtgacccaaagactgggcgatgcatttgccctcccaataccattggagagaaatgttctaaatgtgcacccaatacctggggccacagcattaccactggttgtaaggtgagtgaaccacttttttgctctgataattttttggagagatttttgttttgtagagctctgtaattgggcatttcaaaattcaatattacatcacaaaataatgtagaagtattactataatgtgattacagatattaatcaatatcttacagtttacttgtaggaaagatgatgaagtaaatatacatttatgcagctgaacacttgaaatctacaagaggggtaaaaagaacaaaaattctgtaataataccagaaaagagctataacctcatacctaggcacaaggacatacatgtgcaaagtatgaggatatgaggaactaattaattttccaaaaatctatagaaattgcccctgaattatgactaggttttaggtttcaggaagtagttgagatcattctgaagagtcattttaacaacatttagcttggaaaataatcattttttcccattggtagaccatagaaattgacatggccagagtcatgttcagagagatctatctagcatcagcagggatggtaacaatttataaggctgttgaagaaatattaataagagatgccaaaagcctggacccagtcaatgagcgtcagtgaagatatatagggcgcgagttacattttagaactcaggctgatacagcctggtgaattcattgatttggggaataagaaagagaagacttaggatgactcctaggttttgctttgcaatggagtagatgataataagtaccatgtgcagctataggaattataggaggaggagcaagttcaggaaggaaagataatcactttgcatttttatcagctttttgtgaggtattaataaaataaaattcacccatttatagtaatgaattttaaccaatgattacagtggtgtaatcatcccttgtgccccattgcagtgaagtccccatcaccccccatgtgcctactgttttgccttctagcattataattttccaatttctacaacttctgaaaaatagaatcgtagtctgtttttttgagggggggtttgtttgtttctttgtttggcttccttcacttggtgttacgtttttgtaattcatccatattgttgcatgtatcagcagtttgttctaaaaattgcttaataatattccatttgtgtaatgtacagtgacttgcttacctgtttaccatttaatgggtgtttgggtcatttctagtttggggttacaattttgctgtgaacattagcatacaagtcaaaagcatatttatggacaaatgttttctcttttttttcttaagaacactccacatctttgccaactcttggacttttaacccttttttaattttaagaattctgatgcatgtgtatttctcttgtttgcatttatttaatgcccagtaatgttgggaatcctttcatttatttatttgtcatttatacatcttttttgaagtgtttacaaagcttatgcccatttctattttgagttgtttgtttccttagtaatgcattgcaaggattatttatatattctggatacatgttctttaacgtatgttaaagcttgcttttcatatagattgctttttacctagtttcatcatctaatctttataaacactagcttattatctttttcttctatagtccatactttttatgttctacccaagaaagacaaggtccaaagatttctctcccatgttttcttcaagaagttttagagttttagctcttaaatgtaggtttggattccattttgaatattaatttttctatatatcaggtaatggtcagagctcactttttatggatacccaatttttcaaacattatttgttgaaaagactatcctttttcccattgaattactttgactcctttgtcaaaatctatcaactatatatatgtttatgcatttctggactcttttctgcttcaccgatctattcttatgttaatactagttaatatgttaattattgtagctttccagcaagtcataaaatcaggtattgtaaattcctcaacctcattcatcgtttccaataccttttgagtactttagctcctttacatttccacataacttttaaatttagcatgtcaattctttaccaaaaagcctgctaggatttggctgaaattatattgaattgatagatcaatttgggaagaattgacagcttaaaagtattagatatcccagtgtatgaacatggcataactctgcatttttttaggttgttataattttttctcagaaatgtttgtagtttttgatgtgcaagctttgcatatatattgttaaatgtatccgtttcatattttttatcaaaagcaaatgctgtgttccatttcagttttaaattgcttgttactagaatagaaaaatacaattatttttataccttatccttctatactgtaatcttgctaaacttattagttctagtttctttttggtccatttagtgagattttcttgtagataatcatgtcatctgcaaagagagatttacttcctttctaatctgtgtaacttctgtggcattttcttgtcctattgtagtaaactattgactagaagtggtggaagcaaatatccttgccttgttccttagtttaagtggaaagcattgtcttttataattgaaaatgatgttggctatattttacctgtaggtgctttttattgttttgaggatgccccctcgtgtttttagtttgctaagagcttttatcaagaatatgtgttcaattttgttaaatgacttttctgcatctattgagatgaccatatgatatttctttttaagctgttaatatgacagattatactgattgattttcaacatatcaatccagtcttacaatcctcagattaatcctgcttggccatggggattatccttttaaaattatgttgaatcctgtttgctagcattttcttaatgattttggatctacgtttataagaaatattggtatgaacttatttttcttgtagcgttgtcgtcgggatgaggtactgcaagcttcatgaaatggattcagaagtattccctcctcataatttataaaagcgttttcacaatcaatgaggtagaaaacagaaatactttagaggaacccaaaagctcactatttgaaaagatcagtaaagttggtaatattctagaaaggttaatcaagaaaaaagagagaagaaacaagcaatcaaaatcacaaataaaagggggacatcactatagatcctatagacattaagataataatatggtagtaataggaacaagttttgcctaataaatgtgataacttgcatgaaaagaacattccttcttttgcttactttgagtttaattttctcttgtgttccaagtttttttgttttttgttttttgtttttgagacggagtcttgctctgacccccaggctcgagtgcagtggcagatcttggctcactgccagctccgcctcccgggttcacgccattctcctgcctcagcctcctgagtagctgggactacaggtgcccgccactacgcccggctaattttttgtatttttagtagagacggggtttcaccgcgttagccaggatggtctcgatctcctgacctcgtgatccgccagcctcagcctcccaaaatgctaggattacaggcgtgagccaccgtgcccggccaattgtgttccaagtttcttaaggtgaaaccttagatcattgatttgtaatcctttttctctaatatgggcatttgatacatttttttccagaaactactttgtttgcactccacatattttgatatgctgtgttttaattttcacttggtttaatataatctttaatttattttggggataatgtttagtttctaaatatttggggaattttcaaggtatcgttactgttactagtatctagtttaattctaaattgttctgagaacataatctgcattatttcagaccttttgaaaattattgagatttgttttatggcccggaatagtgttcagtttgtttattataacatgtgcacttgaaaataatgtgtattctggagttgttggatgaaaacttctatataggtcaattatccttaacggtttttagatctacatgttctctcagttactgagagtgttggactataactttgtccgtttcttctttcacttctctcaggttttattcacatgtatttttgagcagtgatactaggtgcatgaacatttaggattgctatgtctttttgaaaagttggtgccttttgacattgtgaaatgtctctctttattcctagtaacattccttgttcagaagtgtactttttctgatatttatatagctattgcaactttctttttaatggtgtttgtgtggtatatatttttcacaccatcatctatttcatctccctttttagtattttaatgtgtgccttttttttttttattctgagacagggtcttactccattgcccaggctagagtgcagtggtgtgatctcagctcactgcaccctccaccttctgggctcaagaaatcctctcacctcagcctccagagtagctgggactacaggcgcatgccaccatgcttggctaatttttaagttttttgtagaaatgagatctcactatattgcccatgcttgtctcaaagtcctgtgctcaagtgatcctgcaaaattctgggattacaggtgtataccaccatgcctagcttaatgtgtgtgtgtgtgagagagagacagagagagagagtgtgtgtgtgtgtaaataacatatattcagatctttatttttcaacgaatcttaataatttggccttttaatttgaggagttaaatcatttccacttaatgtaaatattggtatgattggattaagcctgcactttgctatttgcttttgcttgccttatctgctcttgccttttttttttccttattgtcctgccttcttttgcattaatttgtataacatcttctcttgacttttggattattaaatatacctattcattttatttctttggttttgtctaggaatatacatctttaactttccagaatgtacattaaaataatattataccactttacatttagcgtaagaaccttacaacaggaaacctccagtcccctttcctatcctttgtactatattgtcatatatttttacttctatatattatacatctgacaatataagcttacgattttgatttcaatagtcaattatctttttaaacaagaaaatttctcctataactctttttccttgtgtatatcaattttaatgctttaaattcctttgtgtacattaaaattttcatttcatatcatttttcttcttccattaactacttcctaatctttatcattttattcctgttgtttcaggtctgctgacaataattttttccttttttttttttttttttttgttccagaaaggtgttttttttttttccgaagatgtttttgcagagtatgtaatcctaaatactggtttgcagcaatttaattatgctttttgttttctttttgtgtgtttaataattattttttcatgggattagttagatctgttggccctgtaggattatagttttcatcaaatttggaaatgaaagttgtcagccattatatctttaaatatttttttgttcttcattcttattgtctctttctggaaatcattttttgtatgttgggccaattgatattttcccccatctcactgaggttcttatttttttaattatttttgtatctgtattttttatttctgatagtttctattgttaagtgtccaaagtcactgattttttaatgcagcctaacctgtttttaatccaattgagtctattttttattttaaacattgtatttttttatcttttaaatttccttttggacattgtatatcttttatttctctactatactcacattttttcatttattcttgaaaatataatgtttataaacattagcatttttaaaatggtcatctgcaaattccatcttttttattgcaggactattcctactgactgacttttctcctgtttctgagtcatattttcttgattctttacatgcctgataatttttatttggatgccagacattatatacttttcattgttgtgtattggattttattgtatttctttaaagaatgttgaactttatgctggcaaacagtttaggtagtcacgggtcacttggattcttttgaagcttgcttttgagttttgttagggaaggtgcagcagaacagtctgaaagcccttctactaagctgtgaaacttctgagaatactacctagttggttactatgtctctttactctggctgttgaaaatatggcttattccaagctttctctgggctgtaagaatttttgcagcctagggttttccaatgccattttccttcatcccatgcatgcacctatcagcattcagtcaatgactcaagagaacgcttctgcacatctctggaattacctttctatctaacttctttctttttgaacacgtattctatttgccatcataagtttcagcagcctcggcttcctcaaactccactctttgtctctcaactcagctataatgcgggctttgggtttaccctctctgtgttgcagcctagaaattgcctctgtacactgcttcatgtttttttccttctctcagaaatcacagtcctgtgcttcctataattcaatatctaaaaacaattgtttcttggtttgtatttttattttagttggttgtgtactttaacagcttaacaaagaagaataaatactgtaaaaactaagaagaggctgttcaaaagaagaatattcttcagtgcctaatgcaacacaaaggtcaagtaggattagtgctgaagttgttcattaaattgaagagcaataataagggcatttttttatgttagtgggagtcgttccaattgattccactgggttgtgaaatattggaacgtgatgaccaagtgtggtcctgtttgaccctatagcagtaccctatagagatgtaaactttttttcctgctgagttagcacagatgaaataatagactctaaccaccttcacatgtatgataaaacatttgaacctggtctagaatatgctgacctagaggaaaacaagcatattgatgattcttcaaggaagttcagatgtctgacttcaattagacatgtgattagaaaaaataaaaactggacaggacattcatttttctattgtcaatagcattattaagtttaaaatgcaagagagctacatttttagaaagaaatcaaaaactcctcagaatttcaaagtgttcttatgaatatgaacaatgctataagtgtctatgactgacttttgcattttcagcttcaaatccaagcatccaccatatcacttggactcaggagtaagccctagggaaacttacaagagttccgttttatccacagaatgctatgatatagccaaactctaattaaactcttgaaattgaagttgatacctcatgttcaagatataaatcaggataaaatacattccaagtttctatgaaaacgtagttatatgtttagtactatcatttttactgatcattagataattactctgttgactaaagttgactgaattttttgattactttaaaatcaccatcaaaagtctagacttctgaatcgagaaatacttcaccattatgaagaattacaaaaaaaaacaaaactcatagagcctgtatcagacaattcttgcattgctataaagaaatacctgagactgattataagaaaactggtttaatgggctcacagttctggagggtgtacaggaagcatagcggcatctgtttctggtgaaggcctcaggaagcttccagtcatgatggaaggccaagcaaggacagacttccacatggcaggatcaggagaaaagcagggatgccatgcatttaaacaaccagatcttgccggtaggaactcatggtcacaaggacagcaccaagccctgagggatcagcccccatgatccaaacacctcccaccaggctccacctccaacactggggattatattttaacacgagaattagtggggacatatccaactgtatcagagacctctcaagtaatttatttatgagcatgtgttttactgtttttaaaactgggatgactttaatttaaatgaacagtgatttgagatttatagcttccctttctttgtgtcatggataatttctctgtgctaaggtgtgagcatacacatcatttgggctgttattgaagtagaatacgaagcctgccttctttcactagcaggggaatagtgagtaaattctctattgctaaacaaatattacctctatttatgatttaaatttgatgatggccatagtgctatctaaacacatggttaatggtctggtttattctccactataacttcctgaataaacttcctgatttggaaaggtcccaatgtctatttgtactgtcaacaattttgtaaaaattcatgctttggttttatacaattatttggataacttcatattttagttaaagataaagatgcctcacaggataatttaaatttattatttgattatagttttgataacatgattttctattaatacccgattatggcctattttgtttaagtgagttaatacatactcaaagcagttggcaaagaaaaactatgtaagtgaatatgtaagacatcctaattttgaaatttgattctacatctgatgttctttaagttacttggcggtgaggttagtgggttattctatgccttggaagctttgtccatatttataatatacaaataatcacattttagatctttgggtttaaaatatcttctagaagccgcccttattgcagcctttctactgattagcaataattagatagaaaaatacttacctataaagacaagaaataaagctaatcctgataatcatttttttttttttttgagacggagtctcgctctgtcacccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgataatcattttaataacagaatctgggaagatttttaaccaaatatttgggcatgaaagacaatagaggaggaactggtgatcttggaaatgataatctcataagcaaactactgttagcaggaacagaaacataatactcctggtaatggtggatataagaattaagctgaggagggaaagtgtgagatacacagtgagatgcagccagacttggatctaggagtttggccaggtgctatgcatatgactttaccactgggctgtagatctgagaaggataatagaacagcaccaaaaagagttaagtcacaaagtgcatacaccatatggtggcaaactcagacagagagaggtgataccctttgtaatgccaagtcatgctctgcttgggagacagaaactacactggttttttaaacagtgaaatggaattgttaactggtaaaaggtggttggttactaaaaaaggataaaagaaagctataaggtgtcccgagtacaggtacagaagagcagctactccctctaggctgagggaggaaagacagtgaaggagttaagggctaagagagggcatgctccttctccccacttgcagcaaagctgaggttcagaaatctttcaagagggcgttgctgtcataggaatgtacagcctatggatggtcaaacaaaaccaaaaacaaacacgtcggagtttgtaggcaaatgcatgtctgtagaagctgcccaccgttcttggaggataggagcacgctgggctactgagaagccgacttcaaggtcagagcgtgtgtgcagaccaaagctagtcagaagggtgcctatggagagacaatgtgccctcccaactaaaggcacacctgggattctttctgggccactgggctcccgtgctaaataatacaaaaataatgatgaagattctttttttttttttagacagagccttgctctgtcgcctaggctggagtgcagtggcgcgatctcggctcactgcaagctgcacctcctgggttcacgccattctcctgcctcagcctcaggagtagctgggactacaggcgtccgccaccacgcccggctaattttttgtgtttttaatagagacagggtttcaccatgttagccaggacggtctcaatctcctgaccttgtgatccgccctcctcggcctcccaaagtgctgggattacaggcatgagccaccgcgcccggcctaatgaagaaccagaactcagcttggaagtgtggtgggccgccattatggacttattgggtccttccaaggcctctattgactaagcctatcattctgccaccggatacggagaaatgtctacggggtctacctactgtatcacaaagcagggtgaatttggagctcagaaacagtagatgtataattggcacagctggtccctgaaatgacttattccaagatcctaaatgacattttagaaattcacttggcatttttattaaattgcaagaagatatgagctctgtaaatcaagagcagaaacctttaaaaggataatgtaagacaaaaagacaaatggataagcagaaattaaagatgagagaaataaaattattcaaaagaagttaagattgcaatagggtaatgaaaataagcattggtggtatgtgtatacaataaaacttttcctgtaaaacaggagctgtgaaagtaggataccaatttgagaggtaaatacagcaagaaatgtaaaacaaaggaaaatgattgcagaagacattaggatattatagatttggcagagagaacagagtgatgtactttaagaattatagatgatcctgaaaaagaaaattgattaattagaacagatgtaaaaatcaaaaacaaatctgaagaagaaacagtactgaatcaaaacacaattatgttcccaaactgaaagaactatgttccagtaagttgatggaaaaaaaaaaaacaaacccaagcttcagaaaattctagcaaaaatatgaattatgtaaataaagagaaaatcgtgtatacatcttgggcgaagaaaaacgttactaacagagacctcaaatcagaattgtatgcaagaataaatgccaaaaaacaatatactagatgttacttctcttcaagctctccttggattccccaagtctagtctgatgccctttgtatgttcacatagcattttggacttctcctattatataatgcttattctatcatgttatgctaacatatttacttgtctccctctactagaccgtaaggtatgtctccaaataaatgtttaaatgctacaattatgagataataaggtaaaataactttgtctaaaatttaatctttgagacaaagcagttggaaaaaacccatacccagcccctctctacctcagaaagagagaagacacattttctttctaattcacatagcattatggtttctggacgatcatatatttccataaatgcaggaagcaattttaatgtttatgttcactgatgtttcccaagtgactaaactagaatagtacaaagcctataacagatacatgattaatatgtgtttaatggaagcatagaaacattagaattaaaattttaagatatttcccataaagttgtgttaatggttgctgtttttatctcctctataggcttgtaactgcagcacagtgggatccttggatttccaatgcaatgtaaatacaggccaatgcaactgtcatccaaaattctctggtgcaaaatgtacagagtgcagtcgaggtcactggaactaccctcgctgcaatctctgtgactgcttcctccctgggacagatgccacaacctgtgattcagagactaaaaaatgctcctgtagtgatcaaactgggcagtgcacttgtaaggtatgtgctgctgacatgcagctagggaaaacctccctcaattctgtttccattgctcagttttaacttcattcagtgtttgttatacctgcttcattaagctaaacaaacagatggacaaaatctcattgccagacatggagttttcattgatatgcatttgttggcataccgataaacactgcttttctagagcttattttcaacccaaacccacctttttttctagttggtggagatgatctattttcaatggtatagtgattttttaaaaaatatattagatttgcttcgataaggacaatctgggaggggtggcagggaagacagttcttttaagcatcatcagagaaaatcacagctaaataataaggcttataaaaaccatttctccaaaaattaatctgcaatcgctgtatactagaaaatatatttactgctgtggaagtttagtaaaatttcaacacatataaacgctgtcattacaaacagtgactatgtgcaaatttcagccctcattaatatggttaaatgatgtagaaaaagagccaattaaaaaggtaaaaaggatttttcccctcagatagttctgaaaaatcaattccaggataaatgcagtttaaactgtgtcagaggtatcttttcaagataaaatctatgcaaaaagggacagaggaaacaggaagataaaatctgggtagtggttgttaaaatggccttgagaattgaggaaaatggcagtttctaccatcaagggcttcggccaataccgagtacaatgctgcattcttatatctcgcaattatgatcatatatttaatacatgttatgtgtgtatatatattacaataattatataaattgatattttaacctgctgcctatttcttacagcttacaatagcaccactgtttaagactcaatgtttttatgttgcttttgaaattttcatgagtctttcatattgctcagagcagaactgtagaaaatgtaccacttacatttaagaaacaatgtacaggccgggcgtggtggctcacgcctgtaatcccaccactttgggaggccgaggcgggcggatcacgaggtcaggagatcgagacaatcctggctaacacggtgaaaccccgtctctactaaaaatacaaaaattagctgggcgcggtggcgggcgcctgtagtcccatctactcggaaggctgaggccggagaatggtgtgaacctgggaggcggagcttgcagtgagcagagatagcgccactgcactctggcctgggcgaaagagcgagactccgtctcaaaaaaaaaaaaaaaaaaaaagtacaatacctttagtcttatatctatttaaaaataaagcatttttaaaagatccatgaactcctaacaatgaggttaactacatgtgccatttgagatgtgagtctaatactcagtgttcttctgttttgttttaaattttttaaaaagagtatgctcccgttatgcattctcagggtgatttctcccctaactttgccgttataaactctgagggtctcttgtctttcctcaggtgaatgtggaaggcatccactgtgacagatgccggcctggcaaattcggactcgatgccaagaatccacttggctgcagcagctgctattgcttcggcactactacccagtgctctgaagcaaaaggactgatccggacgtgggtgagtagggaactgctgagccatgtaatggtataatgttagttcctgctggtgtcttttagtcaggcactgaggggtagtagaaaatggcaaaacatttaagtaaccttttcctctgtgaacatttaggaacagcaaaggggtcacgtgccattagagagttggagtaaatgcctttcttatttgttcttaaaagtagttcacttattgataaggaaatagatgccaagtgaaaaagaggaaccttgtccgggaagcattatgttttgagatgggaagagtgagggcaccagagcatgaatgttgatatgagctaacacaccaatgagaaccaggacttgtcacacattcattccaaccaaccttaggcaatcatgatttttggagtgaaaacatgttcatttttcattttcctttaactctttctacatttagattcaatttgtgttagtgtgaaaggctccagtgtccacagatattgtggctttcactatgtgaattagtcaaaaagatttacgtcctgccatgcttgcccactgcgtgtgagttctgttgcttgtgagaacatcatcagaatgggtataggaactgcagatagacatgcagttcgtaacttagttttaaagaaatgtccaaagcgtaaattcagccttctgctgtattttgaccccttgcaggtgactctgaaggctgagcagaccattctacccctggtagatgaggctctgcagcacacgaccaccaagggcattgtttttcaacatccagagattgttgcccacatggacctgatgagagaagatctccatttggaacctttttattggaaacttccagaacaatttgaaggaaagaaggtaagcacaagaactttaatgtcaagtgagaacaagataaaatctttttagaatcacaccatttggagatttatccaattcctcattcttctttttattttgtcagttgatggcctatgggggcaaactcaagtatgcaatctatttcgaggctcgggaagaaacaggtttctctacatataatcctcaagtgatcattcgaggtgggacacctactcatgctagaattatcgtcaggcatatggctgctcctctgattggccaattgacaaggcatgaaattgaaatgacagaggtaaagttagtcattgtttggtgcaaagataccaatcaatggttttgcattcagttttgtcatagtgatttctcttcttgttaacagaaagaatggaaatattatggggatgatcctcgagtccatagaactgtgacccgagaagacttcttggatatactatatgatattcattacattcttatcaaagctacttatggaaatttcatgcgacaaagcaggtaaactctaatagaaaatattcaagctcttattttagagtctgtaaggaaggttattgacctacagatatcagataagaaagattggaaagtgattggttttgcagtataatgatagaagataaaccatggaggcttccctgtgacctggaagaagctactaccattcatcagaaaagaaaaatagcatgagaaacacgttaaagggaaaaaaaaatatggaattcactgcagacatagtgagtttaagatgccagtcataaattcaagagatcatatactgtagatcaggtaaaattaactgttgtggtataaatggattataaaagtgctgagaaagtgacctcttcacccatcaggggaaccaggcagggccaagttggtccagtctcctccaactgtgagcattctaatctgttcaccccagtgtgccatacaatgttgtcattttccctatgcatcatgttgagaaatgattctgaatcactttgaaaaaaatcacacagaacagcaagaatgaatgcaatgttgtcgaacctacatgatgggaatacttcaagggagtattccgtgttttcttatgaccaaaattggccaactgaaatgaggcttgttgggtctgacacttaggaccacactggtaacattcatgataccggtctcagtgtcctggggcagaattaatctcaagcttttaaagaaagaatgtgacacatgagcccaatattatgagtgtaaactattattttccatgaatataattgtaaaaagaaggaataacatattgtcaaaagtaaaaagatgattgtttaatttgaaagagtatgtttacagaacatgggaatggattagtaatgaggaaaatattgaaatataaaataaagagagaataactaatagaggaaccaggagacttccacatcatggaccctcatggtcatattctttgagtagacggttcaccttatccaatgggataaaatgagaaatcatacagatttaggtaagtttcataccatggaggcagaaagttgaactgagttcatataggagacctcaatttctctttcatgtcagtctctgttacattctatgagaatatagaatcgatatatgtttgtaaatagtcttatataataaattattagacctgcctaggaaagcaaaacagaaaaattatgaagtctctcaatggccaactaatgaatataaaaatactatttttcaaatgtttatactggaataagcacacaagacagcagaaaaccttttatttcatgcagaagatccataatgcttttctgattgatgtagagacttttagtaaaagagtaaattaaggaccaaaattcacttttatatatgtattccttgggtttccttttgatatttctcactataacaggagattatttttatatgaaataataaaaaaaatatacttaaaaaacgctgttatctatactgttaattattttagaatatcacatgtaaattaggtggcagaagccatagcagatttgcatgtcttagaaaatagcaggtaatttcgtgagtttgcaaatagattattttgcaaatggttctgtactgcagtaaaagagtttggtagtaaacagaacatcttgttagtggaactgatagaaacaatattgtcattcatctttaattatactttctttgcttctctcacaccaatttcaccttcctacactgtgacactttgtcttttttttttttcccgccctatgtctttttcttttgtcacactgttttacatacctcaccaaatgagatcttttggtttaagtgaccgtttttttgaaactttagaatacatttttcctaatctcagtaaaaactggggtcatagtctcacaatgctaagaacaaataaagctgtcatcagcatttgattttgtaaggcagtggaattgtggcaaaggtttttaaaaggtttgaatagtccccctaaagtaattaaaataaccttgtatctttatttattcaattataaatttaaatctcaaaagcagagagtttaagagtttatattctgtttgaggtttgaactttgtacattgtatcagtgctggcattatcttttttctttgcttttgtttccttttataaagtttaatttaaggaaatagcaacttttgcatttcagtagttatttaaatggaagctggagtttggccaaatccctgatgcaatcaaagccattgctctctaatcccctgaaaaaaaaaatggtgtattgcagaaatatttgttgttgctgccattcaagcttcacttgatttgtaaacacttgcgggtctgttatgtgcattcatgtgcaagagaaaggagaatgaagccagtagctcctcgggctataaaattccatggagatgccaatgcaaagttaccttcttactcccacagagagcccagagaacataagggagaagtttttcttgcagaaggggagtggtttgcttacagctcaccaccactgtgtgtacttacagggagcagagagtgaaacctgaattttaattgaatgtgtgtttcatcaagaccaatcttcagagtgcagattacaatgctagcaaagaacatgcattcataattcagtttcaataaaacctacctatgcttgttataaagtttatgactcaaactccttaaactcctggaggtaacttttatttgaagcaaaactattcattgtcacattttaaagtttatttcccaaacatgtttgtgttaccagttagtccatcataaaatagtcccagtttatggactacatttattttttaatgaaaagggtattaatatgttattttcaattatgattttcttttcaattataatgactatttcaccatcagaaaaggtgagttaagttacttgaaggaattatttaataaagttaagaaaatattattttgaaacattatcctcagaaagaaatcaatattattagattatgcgtgatcattattttctaggtggttttctaaagttcctgaaaggtcattcagagcattgggaagaagaaatttgggatagtagtaaattcaaagcaatttcaccagtgcctgtacgaaataattgaatggggaatgaccttgggttgtctgtttgcaagaatataaatgtctaattaattggccgtgtctacctgaagccactcacattttaaaaagtggggggaatatctttataataacttttcaacaggatatcagacatccaatatactaaacttcttatgatttatgtgaatattttgctaatatgtactcttaacatttgaggaagcaaaaatgcaatattaggatttggtacatgagccccagaaatttaaacagcttcaaaacaatgttaattatcttgatttaatcatcccacaacttatctatgtatcaaaatatcacattgtttaaataaatatagttgacccttgaacaacatggtggttaggagcatcaaccccacctcatgcagtcagaaatccacatataacttttgataccttcaaaacttaactactaatagcctcctgttgaacagaagccatactgataacatagtagattaacatatatttgtgtgggtattatatattgtattcttataataaagtgagctagagaaaagaaaatgttattaagaaagtaataagggctgggctcagtggctcatgcctgtaatcccagcacttcgggaggccaaagcaggcagatcacttgaggtcaacagttcaagaccagcctggccaacatgatgaaacccagtttctactaaaaatacaataattagctgggcgtggtgttgcacacctgtaatcccagctactcaggaggctgaggcaggagaatcacttgaacctggtaggcggaggttgtagtgagccaagattatgccactacactccagcctgggtgacagagtgagactctgtctcaaataaataaataaataaataaataaaaagaaaaaaaaaaagaaaagaataggaagagcaaatatattaagtggaagtggatcattgtaaaggtcttcatcctcgttgtcttcattttgagcagactaaagaggaggaggaagaagaggagggattggtcctgctatctctgggtagcagacgtggaagaaaatccccgtacaagtgaacccatgcagttcaagcccatattgttcaagggtcaacttatgtacaattattatttgtcaattaaaaacaaaaagacaatagaacatacttgaggttgacaaaaacgtgagaaggatattgctgtaggattgattgtttactaggtgatcttaactgactgtcatagtaatctaagtacattctcgctgtttctaggatttctgaaatctcaatggaggtagctgaacaaggacgtggaacaacaatgactcctccagctgacttgattgaaaaatgtgattgtcccctgggctattctggcctgtcctgtgaggtaagctacctcctactaacctgcttaatctcaagtcacttcaggagctaaatggaaatactcccagaagtacctttactgcatacatattcttaatctattttatttaatcttccactcacagtgtgagacacagtggcaagaggataatgttattgatatttagtacaaatcatacctgaagggaaatagttgatcaaaaatttaaagatttgtgaaaatatttaacaatcaggaattaagaatgttttaataagcctatttattatagctgatctattttcttggaccacttctgaagagttagagacatttaaactgcaatgattaggagataggattatactgggttttgaaaatatttttatatagaacacgacaaaacttgtacactaaatagcaggctgttccctttaacataagcttctcagggaaacatatctttgttccaacagtgctgctatgagtcattacagttataaaactatcttttttttttacattttaaaagtaattttaaaactgcttttcaataaacttgctgagatattctcttgtctgccttcaagattgtcaaatttcttaggatctaatttctataattgtgaaatattaataggaacagtacgacttaagggaggtggaatgaatagatgagaaactggcctgggtttgaatctcgacttcaccatacagtaagcctgagaccctgcactgggtgctacacctctttaggctttagcaggtaaacaccaagtccctgagtaactaccactacactttcacctctcccgcagaccccacagtctgaagcctggcatgcatggggcctccaggactgctccagccctacagctgggattctttctcattagtcaggctggctggtgctcacagcataccagttagatattattaaatctccctcacctacagcctgagtcttatgaagactaaatgagctgttaatgttaaggattcatcacagcacctggtgtgtagatgatgtaagttttgatggttaatattattattaatgtaatcactagttatatacccatgtattgattcagttataaataattttatacatcttattttgtaaataggatttgagaagttgtattaagtatggtacatgagacagatgattccactaggtcaaaactgaagtgcaacttaaaaataatgagtatacatttcttgagagggacatggcatcatgaaaagaaaaaggaatttggtttcagtgaatcctacctagctgcactacttggacaggttacttgctctgtttttgctaaatcttgggtttttacctatacatcctaaggattgatttaaatggaaacgtatgtgtgaaaatccctttacaaactgacatgccattcagcttagttaccatcacatggattccatatagttcaaggaaaaagtttataaaataactgcaactgttttgtgacacatgcttaaaatgattttctactctttcctgtgacttctctgaagggcaatatttatttacatgtgtccattttgagctaataaataatcaagtaatccatctccttattaaattgtatttcctacatctatttatacacacactagtaaacttatactggtaagcactgcttatacagtaagcactgctctttccaatatacatatgtacacatagtgtatgggtgaaaactgagactgtgtggcacatatgaaatgagtgacctttccagtgagcattgaagattttaaaatggaggacagaaagaatgtgagatttttctagacaagagatggaatttcctttatcccaggtagcgtttggttttacttttaactgtgtgcacttgatcaatgctcttaattgctgtagaccttcgttattatatagctatccaatctataaaatgacagattgagttgaagttctaaaattctctgattctgcaatattattttgctatagaaaatattctgtaagtagtcaaggttgacctttagatatcttgaagagaaggttattacagctatatttttctgcatttatttgaaataatactgttcacttgtgaacaaaaatgttagtagaatagcaaattattttcatgcaaccaaccttccattctggatttaaaatgttaaaaacctttcttcatatgattgatagactttttgaatagtacattcaaatacatgctttcccattaatttgagtcattttccatcattatatgaaaatgtaaatgagcacaaataaaacaaatgataaatgaaaatcaagaaaaactaagaatatgtacaaattgtcatctgcattagtggcttcaccgtcccatgactttcacttaagcatctatttacagacagtaattgcagtaatatcttagtagagagattacagagataaagacctatctctcataataatgtacctgaagtgttttccacaacccatggcctctaatccattatacctcttatttataattcatcttgattcctaagtgtaattacccaggcataaaatcttatcatcaaagcaagagctaagggcagttttgaaataatacatcccattccagtaacatatgctttgggtcatgaatacacaaagcagttcctctacaatatttttacaaaatgtatagtattctagagacatctgcatctacaggctattttatttcatgtttttatccacaatatggttgcaagtaaacaaaattaagtatcagttactgctaaaatatagccagttgtaaagactcttagcctttgcttgttacctgcactgttatgacagtgcaggcctggtcattaaaaatgttagttttagaaatgcctaattattataatttactatttgcagaaggggccagattaccttcaggagtcaaacaaaggacaccatttcctcaccagatttcttggtgttggagccattgagtttgttatactttatttaacctgtctttgagtgacattaaatataggttattgcccaaactgacctaaactgagctttatgcagttgaaaggttatatgcaggtaccattcttacttatgactttctttcttaaatatggaaaatattcagccttgcgtgtgcagctctctgcagtaatacggaaatcagaaatttgtcaatgatctctaggtcatgttttgatagtttcagcttctatcctgtcttcccatattttaaaagggctttaggcttgcagttgaatggccggtgtctattggatcgccactcagaagctgtcccttgtggctattaaaactgatttttttaaatctccaaataatttatacctatcgtcaacacataaagcccaaaaggcaaaatgtgaaaatagtcttagctacttacatatgcacacatctatcctttatcacttctgttgcacaccagagacccaaagtctctgttttcatgtacagacaagtgttgaggaacatggcatgggtaagttatgttataattttgtttacaaatataacctaaaacaatcatggtatctttatttttagtttatttccagcaaacatagaaaaaactatttgagatagagaaacctattgatttatgtatgacaattattaaacatgctttatctcaagtaatcctcagatccaccctatgaaaagcagaacctaccattgattgagtgcttactatctcctgtacacttcctaatacagttacaccaacatcatcgactataatttatgatccccattttacgggtgagagaattgaggcccatgatcacacacctacacagcaattcaaacctcaatgaatctgtttccaaaacctaggtaaacttgtactcaactattatattatgcagtcatgtgctgcttaacgacagggatacgttctgagaaatgtgtcgttaggtgatctcctcattgtgcaaacatcatagagtgtacatacacaaacctaaatggtgtagcctactacacacctaggctacatgggatagcctgttgctcctaggctacagacctgcacagcatgttattggtactgaatacagtaggcaattgtaacataatggtaagtatttgcatatctaaacatatttaaacatagcaaaggtacattaaaaatatagttttataatcttatgggaccactgtcgtacacatggtcctatcattgaccaaaatgtcattatgcagcagcacatgactgtacaatattcctacattccaggtgaggaaaccaaggcacacagtattcagaaccttactacatacaaagtggtgaaacaggaattaaactcgggtctgcctgattgcaaaatccatgcaaagatacaagatagagtgtttttatgagctccagcacaagcatctatttttattactaaactctgaagaaagaaaggagcgcagtgtgcagccctgagcctaggataggataggtctctacagtctgcttcattctctcctctctaccctcccacatttttgtgtaaatttaatctaattttttgatgaaacaatatattatgaaaataaattaaagatagacgagagcagaagaaaattgagccatgaataatttcaacagtggggaagagaactttggaaaagtttaaattagagtagaaatgggtaagaggagctcaggaaagtatttatttgcttttctttaattccccattgtgttccagaaaggattttagatgggactcaaaaagtaacttttttgcttccaattccaacataatcattctcacaaacttttgtctcagttcaccaagaggaaaaacattcaatattgacaaacaccctaaaaattatttaaattgaaagaatagtgcaaaataatcaaggaaaagagagaatttctgtttttttttttaaaaaaaacagcacgttttaagtttctaatctttgcgttgtcaaatactctctctctctcttttgctacctcatagaaatttaatccatcaggatacgaaataaatcaaaactaatctaaaatgttaaaactgaaagacactttagaagtcatctgagttaacctactcatttgtgggatgaggaaactgggtctcaaagtaacttgcccatatctctcagacaaaactaacataaaatcaaggcttccctattcattccttttatagtaccaaggagtggtatgcactttttatgtatttatttatttttttgagatggagtctcgctttgtcactcaggctggagtgcagtggccagatctcagcttactgcaacctccacttcccaggttcaagcgatgctcgtgcctcagcctccagagtagttgggactacagacacgcatcaccacgcctggctaatttttgtatttttagtcaagacatggtttcaccatgttggccaggctggtctggaactcctgacctcaagtaatccagccacctcagcctcccaaaatgctgggattacaggcgtgagccaccatgtctcgccttttccatgtgcccttttaaatgcacacatacacaacagagaataaggagcttgccagtgacgctgcgctctaattgtctgttagacttttctaagagttttaaaacaaactcgggcctcaactctcccccagaggaattgactccacctcctctagggctggaccggaccacagactcccactatgggcgcttgtctattgtgtcaggctgcctgtcggggaaaaccacagtaataggaaaaatgtgttgtgcgttagagtagacttcaccttagggctcgccttcacatttggacctacaacgctaaactgtacaattcctcgatgaggagtattacttcttgtgtttctttttcttctaagatttattttaaacttttgtttgagcttcaaggaaacttcctctcaatttgtgtgattttttacacaaatttttacagacagtaattacagtaataacttagtagagagattacagagataaagtcctatctctcatagtaacacacatgcatgcacctagcaagtatgtcaataacacaacaattttatatatatataattttatatacatatttatatattatatatattttatatattatatatataatttatatatataatatataatttatatattatatatatataattaatatatatattcaaggatgaaatccatgcacagaaaatccagttttattcagtggtcagcttgctaaagaattggaataacccacactatgaaccacttttaaatagatcttggtttatttcttcagttatgcttaaactaattcttcaaccatcatttccaggacttattcaataataatggcaaaaatgaaccttgctttttaaataatatgtataaactttattaaattatatgattatgtccaccataagacaaataagactcaaaatagtttgaatactattctcagttttatcagcttgctcaaagttgggacattattaaatctcattagaatttattttaggctgtgataaaagcagagagtctcttgattaagtgcttaattgaagtacttttgcattatccaaatcaaaataaacaaggagggtgctagctattaagctagatctttttaaggagcttctttgtatatttgtctctggactgtctaggccagaaccaaagggatgtggaggtactagaaagttcttaatctgatattttttctggcttagtcagcaatcacttttctttcatcaatgggcataagatttttaagtgaaaaaaaaaaattctacttaaccaaggtggtaaaatagtccccttgtaattctccatgggatttgaaaaactgactcctaccttttattcataaatcaagcaatgtctgcagctatgcatgaggagaggactgagcctgaaacacaagacggttttcatcttcgtgccagagctgtggactaccttccagaaagccagagatgtttgttgatacattttcataataaacccaaatgaagatggaagtcttgattttgcatatgtcagcttcactagaagttttctgtttgctttcagatttttattgcaaaaagaaaaaaattatatcagggaaagataaattttattggtggtctaatagtcgcaagacatgtacagcttttattattttggatttcttacttttatagtctttaaattatatcagtataaataatgcatccataacactttttatttagttttttgctgtgtttcattggacatttgctagttatccatcaagcacagtaaaagcagattttaggtgttaaagacattggaattatctttattccatatgacaatgttatttaaaaacaaacatctttttcaagaaaaatactctttggagctttttcaggctgaattgtatctacaaataaaagctttccttggttaaaatctgattacacatggatgccgcccgaacaccttggagaccaggaagaaatacacattaagtatcaaaatcggcacttgcgtttgtaagtgatgttgcccctgccgcaggtgggggaaggccagtctgtctttgcagccactgaagagctcaagcgttgctaatgcagtatttctaactttgctgtcctaattggcttccttttctttcaggcatgcttgccgggattttatcgactgcgttctcaaccaggtggccgcacccctggaccaaccctgggcacctgtgttccatgtcaatgtaatggacacagcagcctgtgtgaccctgaaacatcgatatgccaggtagtcctctgagccttccttgaacaaggtccatgtgctcattcctctttacacatgctcagcatctgcatgcagaggccagctaaactgtaagggaatgcaactgtgtgtgtgaaataaaatatgtaagggaaaaagatattcacagattctgcattttaaaaagtaaggaaaaaataactgggagaaccactgagcatgtcaagaaatagaattttagcagcatcttagaagagcaccagaagacatacctatttaaaaattatgtgtgcctttttttctgattattttcttataaataaactttctataaaatttggaaattacagaaaagaattaagaagaaaaaattcacccaaaatgcaacataacattttaatgttttaagtatttcccaccaatttttacatgtgtttatgaataagatttatataacaccatggatgcagttttatgtcttgtcctttacatttttacctatcatgaggttgtattatgttgttagatattatttaaaatctttacgatctttgtttggatgtcccataatttacccatttcccttagaattgaggtagctcttatttttttatgtttctgctggcaccctgcactctctaccaccatctgcattagaacaatcagaacaatcatgtgttccaccctttttatcgtagtcactgtaagaaattcaggttgcccctgtcaccacttgtccctcaagctgtaatctgcccacagctcatctttgttaagcccatctcccacctctgctcaccttctgaaaccattctactgagccttgtggaactcatggtcaaaacaggcaaaataccccgcagaatcctcctcttccctcagtgttctcttcatcatgctctgactgaaacccaactctcactttgcatgctgctaccccggcagccctcttaaggagtagccatcacctttttgttttttttttcccctgagatgctgactcactctgtcgtgcaggctggagggcagtggcgatcctggctcactgcaacctccgactcccgggttcaagtgattctcatgcctcagcctcctgagtagctgggactacaggctcacgccaccacacctggatattttttttatttttagtagagacggggtttcaccatgttgtctaggctggtctcgaactcctaacctcaggtaatccacccaccttggcctcccaaagtgctgggattacaggcatgagccaccatgcccagctgcagtcgccatcactttctttcactcccttcattcccctgagtctgaaggtgggggcaggttttcctgctcctcgctgccagtttcatattatccatcctcctctacatcagggtccacaacccctgggccacaggaggatattggtccgtggccttttagaaaccagaccacacagcaggaggcaagcagcaggcaaaggagcaagcgcagcttcattagcatttacagctgctcctcattcctggtattactgtactgcctgagctccacctcctgtcagatcagagacagcattagattctcataggagcacaaaccctattgtgaactgcacatgtgagggatctaggttgtgcgctcctgagaatctaatgcctgatgatcaatgatctgtcactgtctcccatcaccccaagatgggactatctagttgcaggaaaacaagcttagggcttccactgattctatgttatggtgagttgtataattatttcattatatattacaatgtaataataatagatagtaataataataatagataataaagtgcacagtaaatataacatgcttgcatcatcacaaaaccatcccccaatcctagtccatggaaaaattgccttccatgaaaccagtccctggtgccaaaaacattggagacgctgctctacagcacccagctttgactctcatgcttccctctatgtgccccctctccatctgcttgtcgaagtcacctactaacctttaaataccccacatcattccttgctgattttccctgtctaattgtcattttccctagcactactcctgtcatcattcttagtgattttaatgtccatgaacttaactcttccatactcttcactttcagtttcttgtgcctctctggtctccatttgaagcgtttttttgttgttgtttggtttttgtttttttttttttttttcccactgtgtcgtttctctctagttcacttcttctaaatacttccacttcaatgtgtgtaatctcacaattgatgcacacacttttttcttgttccttatctcatgctttcactgtagtaaccagcttaatagtcatgatctttcattggtattactgctttgcaacgctcatttccctggctactcctttacttattttttactcaagtgaactccaacactgtgagaatcctaccatctcctccatacctgcaccttctttttttttttgagacggagtcttgctctgtcacccaggctggagtgcagtgacgcgatctcagctcactgcaagctccgcctctcaggttcaagccattctcctgcctcagcctcctgagtagctggaactacaggtgcccaccaccatgcccggcttctttttttgtatttttaatagagacggggtttcactgtgttagccaggatggactcgatctcctgacctcatgatccatgattcgcctccttcggcctcccaaagtgctgggactacaggcgtaagccactgcgcccggccacctgcaccttctaagctgaacgtggctgtagaaaaagacaattgtgccatctaatctcaccttaaattcatgatccctctcttcaaatggaccctttgtgctgctctgcaatcatgccacttttctctcatcctttttcttttccacattcctaggtgattatttcatacctccccctccatcctcaagcctaaacctctcctctcaccccctcccatccttaccctcagttgatggtgttgcctcttatttcattgagaatttagaagctgtcagaagagaggtaacaagctcccactactgcatgcacccacttttctgcatctgtgcccaattattatgactcttttctattactttggatgaattattcttgtttccagaaaagatcacatcttccccctatgttctcaattctacccctctcccgcttgatgacatcactctggctaatctctcctccttcttatattgtcactttttttttccatcttaaaagcaaaaacaaactctcctgactcatttcctttctaagtaaccacttcattcttctccttccatacaatggagagctgtctatcccgtctataatttctcttcatccattctcctttgaattactaaaaacaggctatcacctcctcttctatactggattcaatggctaatctacagccaccagtgttcaccttactatatctaacagccatgtttgccactgtgaatcaccccattcttcttgaaaccctttgctcaatttgctttccagcccatggcattctggagatgttcaaattccatagtggctccttctcagctttcttcattactctgaaatctacatagtggtattcctgggactcaatccttggagcaatttgtttctctaactacattcattcagatggtgatcttacccaggcatgtggctttctgtactgagatattttgatattgacatcccacagtatttactattaagtttatgatttaattttatatccactcattactatggtgtggggaggtaatttttctgcagatatgtattaccactgtaaagaaacatttactgattaatatttccttttccccttgatacattattgtatctgaacatacacaaatttatttcatccatattaagatatgtttcagtataatccattttgttttacttaccttttagctcttattacaatgttctgcttaccttcattttatgttaacatatctgtaaagcaaggtcctttatttctcttctcttctaattaactagatgctcttacatattcttccagctgacacttttatgcactattttaatctcttccacaaattttaattacaatcaaaattactggaattttgattgtaattaaattagcctatttgtaaagaattgctatatttacactagtcactcttctctcttcagatattttatgtcttacagtaaactgttttaaggttgtctatatcaagcacgcatttctcatataaaaattctttctatgtatcttacattttcattttaatggtagtaaacattacctgttttgtttcaacatagtaaatgtactaactggtcattattggtaaaccttaactattagaataggtgtttttacatgtatttgatatccaataacttttattttagttctagaagtttatcagttgattcagttattgttaagtttaccatttttttttttttttttttttttttttgagagggagtcttgctctgtcacccaggctagagggcagtggtgctatcatggctcactgcaacctccacctcccaggttcaagcgattttcctgcctcagcctcctgagtagctgggattacaggcacctgccaccataactggctaatttttgcattttagtagagatggggtttcaccattttagccaggctgatttcaaactcctgacctcaagtgatctgcctgcctcggcctcccaaagttcagggattacaggcatgaaccaccaaacctggcctataatactattatttgcaaatattataattgtgctttcacttgtcaaaagctatatctgttataataataatttcatgtttttaaattgtctcccaaaataataagctttctattttattactgattttaatatgattgccttaagtctttcaccattaagtatgatgctgatggttagtataagaaaaacatttcttgtcatgttacgaaaactgctttctattcctagcttcttaaagatatcctctttcaatcaggataagatatttaaattactcatatgcttaattgtggagagtggagtgggaatgtagatgcatttaagaggtgatcatatataggtttttcaccttaaacagaaccataaatgatattattgactaaataaataacttaatattagccatccatgaattccagaaataattactatcttgctttagtatgctattttttcatcaactgcttgcctgacaaattcaataggcaatttgagaggaaggggttaatctatacacattcttaagcaagaattaaatgtatatgtcttatgcaatcttcactggcatttttagcacagttatatttgctttatatgattaatttagaagcatttataaataatgcagtttaatttcaattttgttaggattaaaattaccgtctttatactgtcctcttttgaccaattgactattatgactatttttgttctctaagaattctaaaagcatgtctattttctgaggaatccctagatgaagtaaaaaataaatacttccattaaacaaacacagctggtataaaccgttatgctccaaatttttatattttctttcatggaactcacaacttttgaatttaggcaactctgttcatctttgaaatggcctcatgaggcaaataagaaatagctgttattactcccacacagtaagtgaggaaactgaagcatactgatttctcttttatgtgcaatatggctctcagtttcatatcatatccattatacagtgcaatgccctctaccttggtatagtggcaagcatgaactctgcagtcagagtgccttgattcaaatcctggcttcaccccttactggtagtgtgagcctactcaatttatttaacctgaatgaggtcttagtttcttcatttatataatgaaaacaataatagtggctactcacagagtttttgtaaggatttgatgaaatactcaataaaaggcttagaacattacttagtgcatggtacgcttcataaaagcaattatgataatgatgatcataaagatgataattaccatacacattatctaccatttatagtcgaagaaccaatcagttgataattaatcaaaaaataagtaaaaaaaattcatgtctagcgctatgctagattttcttactgtctcagtccatttcggatgttgtaacaaaatatcataaactgggtagcttataaataacagaaacttatttcccacagttctgaaggctgggaagtccaagatcaagtctccagcaaagtcagtgtctggggaaggcttctttcctggtcatagctgaccccttctttctttgtcttcacgtgttggaaggcactagatagctctctggggtctcttttgtaaaggccctaatcccactcatgaggctccagcctcatgatgtaatcacctcccaaaggccccatctcctattactatcacactgggagacaggatttcaacatacaaatttttggagaacacagttgttcaggccatagcaagccttaacccccaacatgatgatatttggagatgggcactcacttatcttgtttttctttatcttcacacctttccctgaaaatataaagtgcataggaaagaaaactgtagaaagctttatagactaaatattttaaagaaacccagatcaccttgtaactatgctcttcatcatacctaatgatacttgcaagataattgttgcttcatcctaggcattaataaatcctgtacataggcatgttattatgaatagctcagtgacattgctccttaagaaaaaaaatttttttgaagactaaaacctatgtaatactgagtccaaggggatagcgggaggtaagtgaactaacagtaactagtacacacacataggtagtaagtaggtagatagatagatagatagatagatagatagatagatagatacagaaggaagatattttcatttaatcattgctacaccctgtagtcagattatttctcctattttttttttcacatgggaatattgaagacttagctagctcaaacaactttttaaagataaaataatttgtggaaatattattttcactctatcataattcttattttaaaaagaaaataataaaaataaatctctataactgatcattgctgttgcctgaaacatttaaccaattacctctatcttcagtaaatagacagatttgtaactagaattcactattttttgttttgtaaaccttatttaatctacctaacaaccttgccagaatagagattgttagcattatactaagttctggaaattaatgctaagaaaatgtaagcaacctataaagccttgaacaaaaagtattagaagcaggtttcaaatccaccacaaactgcgttctccagacggcaagagagtgtaaacactctctgctgattaaatgagtttgattttacaagctcaagtgaattatatcttagagtcgggacagaatctgcaaaagtgactaggggtcatgtatggaaaacacttgagaaattgtgagaacataaaatttgtcgcaggatagtaagcaataaaacatctttccaggttttataaaggaaaataaaatgtaggaaactgattgtcatctccagtgaaacttaagtattgcttacttaacaaatatctgtcaactgtggaaaaaataaacagtgctcattaggaatcagaataggttcactttgtcagaggcaatggctcatgcctgtaatcctagcacttttggaggccaagagcggaggatccaggagttcgagaccagcatggtcaacaaaggccctgtgtctacaaaaaattaaaaattaaaaaaaagaataggttcattcaaaataacacatatcaaactaagtgctaggtttactgtatatataatatctgaaaacctagttttctaaatcccagtaaaatatcaagtttatcagacaatgtgatacatcatatctcaaattcagcaaaaaataataactgctattatgtgtccaaaactgtgtatgtaccaggaccaaaacaggtcactgtacagagattttctcatttattgttacaataaacttatgagatagacaagattatttcttcttttattgttgatgaactgatgctagagaaattaaataacttgcttaagtcataaaacagcagaggccatatccatgtttcaaatgctggtttgtttaaatagatgtttgatgagctatttcatagtatccttgtgcacaagattgaaaatatgagccagatgttagccagctgataggttgatgggcatatacgttgctaaaaaaatgtgacccagagtacactctagtgatatctccaatgatgaggcgtaagctttgtatttgaccttgttgtgttcaaaatatctgtaaatgctttggatgatatctatcaaatattcagataatataaagctgaaagtattatctaatgtgttggatggtgggaaaatatcctgacagatgatactatgaattacagttaacaagatgagattaatagaaaagatttgaactcaggtaagctcacttgtttgttcattcctgtggcatctgttaattatgtttccaacatgcaggtctatggcctatggtagatagtaagaatatgaagactgcatgggtcttgccctctaggagcttattctctagtttaggggaaagaacagaggaaatgacacatattagcaattcatgtgaagtaagagtccttacttgattgcagattcactaggtgccaacacagggcattgctatttgtataagatccaaatcaagggaggaagtacatttaatatatttgcaagtcacagctagagacttataatctactatattttgaaagaaaccctgagtaagattgctaaatgtttagcttgaaacaaagatttaggaagtaatagtattcttagatatttgaggaccttccctaggaaaagggaattagacttaattttcatagcttcagaaggcagaacttggatcactcactgaaaattagaatgcatcaaatttttattcaccgtaaggaaaaacttcacagcttatgcaagacgaaaaaagctgtcttataagaattcatgcatttaatgatatctcaaggaaagtatagaaggcattcctgtatggcaagaaggttagattaagtaatttctcaccttaggcctgagatactataatattaatgttatagtcatttgattttgtagaaggaatatataccaacagttttccagtgtgcaaaaaaaaacttaacaaatctaatatattctgatgtattattgaagagatactagcacataccactcttgagaatataattaaacttctcattaggcatccaaaatataggaatttcccctaatggctaatttttatataagaaaaaatactatgtacactatttcaaagcagacagaaaagtcatatgaaaagggtatgtcaaaaaagtttcaaaaagaggctcctgatttatgtgttgtgtgtttgtggacctaaccaggacatttgattcaattaaccaagtttagtatgtcagcaaccctctgaaagattgagaagattgactgtccagagaatattacaatatttgctttctctgttgaagaaattatgtagacttacaggtataagagaaacaaaatcatatttttgaatctcttatttttagtaatgattattggctttaaggattttaattcagttactaatgttatatttaggttacataaaataattcattatgcaattattttactgcaaaagcaaaaggctgaaaattattgttgaagatcccatgtatttttggcacattcatctctataaaataagttcttaaaacactccccagttaacacttattcatcagcatgacaccttgctgaatgacttgaaattataattcatagataattattttatcttggagccattatctctcataatgctactgttaaatatggaatggctcttttattgcttaaaaatggtggttcctttggatggttgaataaaagaggattatggcacttaaatcaatggcaaaatatgacaaatcattttgccctgctaaccacttttctgcaatgacacttgaaatttgggctttttcatctgaaaaagcctgaccagtttcatctatacttcctggaacatgcattcattcattcagtcattcaaaatagtcatcgaatgcctcccatgtttgatgaactaaaaggagcatttaagccagttttaggtcatcggggaatgtttctcagagaaagtgacatttaaaatgagagctgaaatgaataagtgctagcctgatatacactgtagagctaaggatttgcaaatgaaaagtcccagcagtgataaagagtatccgcataatttgagaatttcagatggccccatgtggctacggcattatatgcaaagaaagcagtggctacagctacatatggaggggtaagcacagtggtggtgaaggcgggggtgggggtggcaggtaatgaagctcttccttgccatgctaatgatttgttattcatcctgactgcatttgggagctagtgtaggctttcaagcaagagaaggtcatggtttgatatgttcataggatgatcactctgcagtgtggagaaatcaccagataagaaaatatggagacaggatctttagctaaaaggctattctaataatccaaataaaatatgacagtggccagatgaaaatagtagcaacaagaaagtcaagaaacagagagtaatagactcatggaactgatgatctaatggatacctcggataagagaggcctctaggttgctgaccttggcaattgagtgaatgacagtgacctcagatgaaacgagaaatacaggagtattacaaggtttagcaagagatgaacttcattgttgtcatttcaaatttaagacgcttctgtgttatacaatatttattcaagaagcaattagaagcagaagtctggaacccattagagatatccaggctgaatacataaaatacagagttttgggcacaccattaactgaagtcatagtaatggatgaaatcaccaaggtaaatgtggaggagaaaaaagagatgaggaccaaagttagaattaagggcgtcaattatattgaacagaaagggaaggaagagtcgataaaggagaattcgagtagccgcagaagtaggagaaacatcaactggcttactcttaaagaagccatgggggctgggcacggcagctcccgcctgtaatcccaacactttgggaggccagggcaggcagatcacggggtcaagagatggagacgatcctggccagcatggtgaaaccccgtctttactgaaaatacgaaaattaactgggcatggttacgcatgcctgtaatctcagctactcaggaggctgaggcaggagaatcgcttgaacctgggaggcagaggttgcagtgagctgagatggtgccactgcactccagcctgactacagagcgagactgtctcaaaaaaaaaaaaaagaaagaaagaaaaagaaagaaagaaaccatgggaagagagtatccagaaatatctatcaatggctacagaaaacctacatatgaggcctgatgattgtaagttttgctttagcaacaaagatcttatgggtcatcctggtattatgtttaatggtgaaaccagaagcctgtttaaagggagaatgggagatgaagaagtagagaccaggaatgtaaacaatgtctttttaaaagcttatcgaaaataggatagaaattgtcaagcaatttgagacctcacagattttttttttaagacaggaaaggcttgaccaatttcaaatattaatgagaatgagcctgcaaaggagggaataaagatggtggagaaaatggggaggcaggaggaaaggaaaccaatttaggagtggagtagcttcagacaaaggacggaaacaaatgtcaaagggatggaaaataatgtggcaatatactgaattgtttgccaggaaaccaagggagcatccaaattagagctttcttatctcttaaagtagggtaaggtgtagaagtagaagatttgagattggctgggcacgttgggaggctgaggtgggtggatcacctgaggtcaggagttcaagaccagcctggccaacatggtgaaaccccatctctactaaaaatacaaaaaattagcctggcgtggtggtatgtgcctgtagtaccagctactcgggaaggtgaggcaggagaatccctttattcaggaggcagaggttgcagtgagccaagatggtgccactgcactccagcctgggcgacagagctctgtctcaaaaaaaaaaaaaaaaaaaaaagagaaaaagaaaagaaaagaaaagaaaagacttgtaccttgtcatattggaaaaccagattcatttcacattgttataaaatctgtaaatgtcacaatataatttcaaatataacaccaaaaatgtaaaaaataaatgatctaaaattcactgtggcaatgtcatagtttcactgcaagaaatagcataaactctcaaaaagagttaatagaagttttaaacaaacattaattccatggcaatatctgtggtggaaatgacgtcagctattgtttgttgtgaattgccacacattccctaccaacaattgtctggccattagaagacacatgaaacataaatacattcttcttgattgactaaatgaagcagagcccagtctatgggatatcatccaagttcaagctggcggcttcgtggctccagctgagattatcaggaagtcaattcactaacatgtccatctagtttgtaactgacttttttgtttctcaacttttctttcgatattgtttataagatgtaagtcactattttgaccactccaaatcctgtcttataaaatccagctaaaattcaattccaaattcccttcttcctttttctcaactctcaaatgcaaggatcgcattcccacaagataacattcaatgttgcattcttgctgccatgtttattttttgtcaggtggtttttttaaattattattttcccaaagtctaagtaaatttctagaaggtaggatgttctttcattgcctgtttcagtgcattccatgtagctcttcctaactccttattgcataattgattattgtgttaaatataattctgcttcatgaaaattttaatttgaagctatttgcacactattctgaagctattctcatttctttgtggaaaggtgttaaagggtatcaccccaatgtctcttattatgcaagcataagaaagaagatatcgatctgagattgctagttttagattgactcctctgtatttatgaagaaccacctacatctatgctttccaccttgaggtggtttcagaaagcccactagtgggcatgtgccaaggccacagtatttgtagcacctttttctaacatctcatagagctaaaacctgggatatgaagaaacataaatgcctagaagaaataataaattttagagactcgaagtctattccccaatttagagtaggagaaaaatttacatagagattgattcagggaaaagagaatagcaactcttattgtcagtgtagctacgatagcacagtattagtttctcaaatcaaagagttcctttaaaaatatttatatcaaagactgagttctctgtcagtgataaagtgtgtgtgtgagtgtgtgtgtgtaagaaagtatatgtgttcatagacacacattcatagctagggactgtatgataaattacattctaactatcactaaattaaaaacaaacttcttctcccttttcctttacagaattgtcaacatcacactgctggtgacttctgtgaacgatgtgctcttggatactatggaattgtcaagggattgccaaatgactgtcagcaatgtgcctgccctctgatttcttccagtaacaagtaagattgagaaatataaccatatttcccaatcagaaacgccatctgtctagcacatgggctgtctatgatttggctattttttccatgtagacaaaaatctcaatttaagatagagatatttttaataatatagaaacatgacaaaagtgagtatataatgctctatggttcatttttcctttgaaactctgtcccaagtaaataatacttattaattaaaattgaagtaccaatattaatgtaagacatatttataaaacaaatgatatatatatacaaatatgcatggtttcataaatataccagtctaatgcttgcatatagctctgcccataatatcatctatgaaggattgttcgggtgcatattatataatttttgtggctgtttccatttattttatgtgtttaattcaagattgggaaataattatcaagaaaacattgaaaaattgtacaattaaagcaggtgacttattgttatgctccaaaaaatgtcatctcccggaatcacagcctcctttttcttaagatggtctgagcttggtaccatggaaacacagccctaagaagaaacaaaagctggaatatcttatttcagtgctgtctgaacattctgcactggtttatacattgatgaaaaccctaggtgttttcatttacctttttgcccacactacctgcactttctgttaagtgatttatagacttcagtaaggcagggtagttttactctaagaatttgcttttgaaaataatgtatggcagtttgttcagaattagaattctggacactttatcttgagtgttaaacagccacagagcaatttggacaatgtgatctttgcacctgtgcctactcactttcttcttaatcttcggctttgtgtgcattctgaaaacatttcctgtaaatcatctccttttcctctgaaagctcctcttttttgttggctggaatcacaagccttttacagggtgtcaaatgtcaatttttaggtaagctggatattgaagaggataatatacatggtcttattgttcatccagggaccaagtagtatgtgtatgaaaaataacattatttttgtctctctttccctaatttctccttgatgccccgatttatttaattgttttaaaaagtaagccatttggattagaaaaatttaataattaattgataattccctggtgagtacactataataaaagctacaggagatatacaagagaagcatgccattttttggaggagctcactgtaaaacctgtgtgttaaggggtatcaacttaaatgtaaagaaaattcaaaggcacaaaacaccacacttaatactggaagcttcaagaacatatgaaaagaaatagtagcatgtataatgggtcttaaacaattaatttcaggattttcactggtgggaatagtaggaaattatatgggcaaatgcttacaaaatacaaggcatgtgcaaaacctaataagtaacagaatttggaacatggcgttcagacacaatttcatgatcacagatgaaaatgaatgggagaataaagaccatattgtagaaatccttaaataccagtctaagaaatagttatttaattttctatgtaataaggaaacactacaagtttttattttgaaaaaaaggttaatatgattatggccacattttaggaaaactattatcatagaattgagtataatgaattgaaacaggcaaatgagaaaagcatagagaccaattaaaaggctagtatactagcatgggcaaaagataattagaaccagaagtaggtaatagtaataagaatggagacaaaggaatgaatgtgagaaaatggtttaatacagctttacagattcggaaactaattagatgtgaggggtgagggtccgggcagaagttgaagacaggtttttaggcaggttacccccaaaaatggtggtgctattaactgaaatggagaaaccaggagagagccgttagagaagaaagataatttatgtttcaaataggttcagattgatagaacatatctgtctgaatggaaatatgcaaatagctgcaggaaatggaaatctgaaaattgcaggagcagatgaaggaagagatatgttaataagtgaattaaagttggataagatttcccaggctaatgttatccaaggcgagtatatagaaagaatgaaagacaggactttatgttgggaaaggagaaaaagaagagccaaggcaggagcagtcagaagagagggaacccaggcggcactgccattgacaccaagggagagaagagcagtgaacagcatcagttgctgctctcacaagggagacccaatgaatatggtggcaattgactattgtaattgagcaaataaatgggcttgccgcctgaagcacatagaagccaataacgttggcactggcttcggagaaaagaaaggctttactgcaaaattgttcagcaaggagacaagagtcaggttcaaatctgtctccctaatttgggatatggggaaggttgcaaggggtcagaaggcaaggcaaaggatttagaaatgctggcttggcagagtctgattggagggcttcaaatttgatcacttacagtaaggtatattgaggcagattttagccctggatcttctgggccaatggacccctcatttctgaaggagttccaatgtccaggttttgattttgtccctgtcttgttggttcaaggggaggaatagttggttcctggtgttgttagaggtcaaaatttttctattgaacatgcctgggctacatgacttgcagcttttggctctgttatacctaaaaggtaacttgacattttgttatcaacagggtaggcccggttttggttggtcctgtagttacactctcagagtcattgatgaattttgaccatcaataatgaaagcagaatttgaatttacagttttaagaaatttcaagaataaaatgatagaatactaccctgattggttagcaggatcaataacagggtgtgttttcatttttgtttcattgttgttttatatgatttgtataatttgagtaaatttttatgcaaaagaccctgaaagaatcaaaatatcaaattaaaatggcaagttcagtggctttcaaactttattgattgcatccactgtaagatacacttttttatatcataagccagaaacacacaaaaacttgtgtgtgtagatatctaaatatatgtattatacaccatgccatttatttaattttgttattttacatttttagaaaaaaaattttagccaaaacctactcaatggatttcatgagtcacttatatcaccatctaaagcttgggacgtattaggctaattaacaaagtgaagacctataaattgtgagaagagaagaattaaaatgtgaagcaaagaaaccagccagggcaaagaaaagaggcacttctccccaagacataaaaacagattctgaggaatagatggaggaggctgagatatctcaatttatgacttcaatctgtgcagtcagtgagaaatatggaggcatgatgagtgattactgactcatttccacggcattagttcaagtcctcattatctcttaccaaaacaaatatggtagaaatttaactcttatgacggagtggcagtgctcacacacccttagaagtttccagtgccttcccaaggaaagatcagactctttgagcattagaaaccctctgtaatctgactacctttccaggctccaagccctcaactccattctatataatgccaagtttggcatttcttgcacttatctagacatcattagcagtctgctcttgctattccctcagacaatccctgtgaaatctaatttatttttaaaggcatttttcaaaccctacctctgccacaaaacctatccatagcacagaatgtattttgtacattttatatacaacgaacacattttactatacagaattatttcaatcattctttcaggagatgaacatttactaagcatatacttcatcccaacactatgaataaaagataaaagatatgtgtcctgtcctgtatgtgtacatatctgtgtctcacacagaattgtaaattctttgaaggtaaacataatgtcttatttctttctttattcaagaaaaagttaatgagggcccaactcaatgctaggcatggctcttcgtactgggaatatataagtgaacaaaacggcctgtgtttcctagccttctggagcttgtattttttataagagagtaagataaagaaatagatatataatgtaatatcaggtaatgacaagtactaccaggagaaataaaggagactcaaggaacttagagtgatgaaggtatgattttagatgaggtggtccatgatcttcacaaacagatgagacttgtgcagaaatgtgaatggtgtgagccatgtgaatacctgcaggaagaacagtcccctcagagaaaaaagtcactgcactggccctgagacagacccatgcttggcagataacaggaggccagggtggttggaacagagtgaatgagaagagggggctaggagatgaagtcagcaaagctctaatgaatatctaactctcctgagggctaaaaatcttccagtggcaagaggtggcttggtacaggataatccagtggtgttattgatggaagcaccagcagcatttgcagataggagataagtggagtgtgagagaggagacacggttgacaccatggtttttggcagagcaaatggaaacatggagtggctgttgactgggatggggaaaattagggaaaggtctggtgtatttttggagggggagaaacttacttttagatctgcgaaggtaggcacaatatttaaatcccttaggactaagtgagatcattcagaggagagaggagaagggaacagaaatcagaaaactgaattgtgaagcacgttaagagatcaaggacatgccatagatccaacaaaggaaactgaaaaggaacaaccaatgaactgggataaaaaccagaaggaaatggtttccaggaagcccatttatctctgcagtgtccataggagatgacacagagagcaagctctgtaaattttaaaaattctgttgaggggagtttggaattagcagccatagggaaatgtaaaagatggtcaccatgagaaaagcacaaggatttctgagtagccctgcagacaaaatgataattgagagaagattagggagttgtgaacagaaagaataaactcaagcttcaagtgagatggaatccctactccctccagaagaccttttatgtgatataaggaaacagtgcaatccaccataatatcataatttgaaaaaaattgtatcaactattcaagaattactacattcctatacagtaaacactttattatttttttattgacatttcattattttactataacgaaatgtaatttaatcatactggctctttagagtttctcttgaaatgtctaaaatctgtttcttagagcccatatatgtataagagtgtgtgtgtgtgttcgcgtatgcgtgcatgtgcgtgagtgtgcatgcacagatgcagtcagtatcaggctttaaatgaatgagctaaaaatttggcagagtgtgtcagttataagtttattttttgtgaaggcaaaaataaatttgttggataatgcgtttgtgagtagtagatcaatttgttcacatattttgcaaaagttagagcttattactcattcatgtactattgatgtaacgcattagaagacagttaacattaggtcctaatggcacctgaccaaaaggagctgtgggcctggcctatacaccttattgcctgttttcagcatcaactgatttagtgaagcagcaaaaagaaaaatggtgtgtgcagcattatctttctgccacagatacatgtttttaatttccaagtttccaatgcatcattcagttttatctaacgggaatgcagctgagagaagtttgtaacaacccaaaactacatgctaatatagtttagttttcaagtcttgtggagtctttttttttttaatggaataagatcatcagaaatccaggagcaagacagactggctgtggtctaccagcattgtagtaaaaacattggggaagttttataagacctaattattagaaaataccataaaatagtcattttcatagaaaaagctttccctttcctcacactgaatcacattactttgtgttcaaggtaaaatgtagtttgaaatctggatgtaaattagaaaagatattattttattccaagtgaaacatgtattcacacttcacgtcttgaagcaccagtggccatttgggctgagttttcaagaaaaaaaatttatatagattttatgccctttttttaacctaagagatattaagtaatagctattccactatcagacaatgtgcataaattctagtcagatttttcttttgattagtgaacaataggacaattttgctggatgtttagtatattcatggctgtcacatcattattaaattccagaatattaacatgctttgtgtgatgcatttttaatccatcataaaccaaacaatatatatttgtttactgttattaatggtttttcattgtgacgtcctagccttaaataagaacttcagcaataattataaagatggcatttattactacctaaaagtatgtcccaataaccttgatcatggataggaatactattttataaaataaatggattaaactttttttgcaatccttttctttctgattcagtttcagcccctcttgtgtcgcagaaggacttgacgactaccgctgcacggcttgtccacggggatatgaaggccagtactgtgaaaggtaccaacagccatgaaacgtacagagtaatgatatgtagggactatatggtaaagggtcacaataggaaaacattcattatttgaagaacttcaatatttgcatatcctttagaagtttaaattacaatgctttcaaaaccacttgtgtatcttagaatttgtccaaagaaagttgtttatttccaccgtatgtttagactttatcaaagattccaaactatttacaattatctaacttatgctttagtatatatatatatataattttatatgtaaatataacatttcataagaataaatcaattttcaaaagcttagcagtagttactactaataagaaactggctacacttttcttattttaatgcactggaaaatattgtctggaagtaactgaattcacgtcattgttctgaacactatgactacaccagcaagtgtatacataactcaaaatataaatagtatcaagaatttttaattagtacccagacaataaagtatttgttattcagttttccttttcaataggcaaacaatattatttaaatgttttctcttaccatattgcttatgaaatctcataatgcatgtatacagctgttaaattgaattctcagtgtaatccaaatggtaaattaaggagtacagttccaaactgattgtctagaaaagttgcaattaatatcttccagatatatattttctgtaagatcagtatcctggatattcaaacttgtcaccaccacttttggtatattttagatattatctttaatgtaacagagagttactaatgttaactactaacattatacacacatgatagttttagcataattgatagcagtataaaagttttagaaagatccatagacttcgctcaattccaacagttcagctacattccattttcctcatctataatctcaggaatcattgataggccacctactttacactaatattgtgacaataagtgtgtaaaggacactgttggtgccctgcctaggcacctacactgaagccttctctccaacagaagaggcagaaaggcctgaatgtttacccgcccttcctgcagtggcccatgactaaccagcgtgagagtacaaaagtccagctctttggcccctaagtggaacaagttttgagatcttattttatgctccagagcactccatggaatcaggctaagactgggacatcacctgaaatcatacccttgattagagcttttcttttccatgtcctgcttcacccactcctttgctagattctcctaggaacacttaaatggtaagcttctttgtaaatataaactaatactaattatcagcatccacttaagagtcttgttttatataaccagcaacagctgtattaatcatggcaataagtaactaaataattagggttaagctttataaatcccaatgcaatttttatacatttgtaaaatatatttctaaataaatccgtatgtggtaactctaaacacagtatccaatatttgcatatatataaaacagtggattcacaatttccataccaacagaaattagcagcaattaaataactcatagcaacaccaaatctaaaaatatttccatttgttctgaagatatatacatcttttggatatagatataggtgatacaagtacatacttgttaatacccaccagtgagctttggtattcatggttagactaatatttatttcctgtacctttaaacaccagtaggatggtgactaaaagcatcgctggacaccaaaaagattatctacagtaattcatgaaaaaaaaattatgatatagctacatttatacactgtagttaccattttctacaaaagcatgtgtatagaataggctagaagggtacactaaaataacaattattgtgttaaagcagaatgattacagaaaatttatttgttaatatccagtagtatttaatcgataaaagctgtcagtttgtgtagcatagagatgagcagggccatacagtatcaaatgtgagtgacttaaagtgtttttccagtcctcaaacattgttatagctttgcattcatcatctctaacatataaatgatcaggttatatttctctgaaaaattgctttattcagctatattaaaccaaagttcttggttaaatttttattgtaaccttccaaataaatttgttccagtgctgagagcttcttaaatcatttaaatcatctttcgacctgctcagactgatcaggttaggtctaaaactgcttaaatttcttgagtatccctgtaatatagaaacctctcctcatactttattttcaatactcttgtaataaactctttgaacatttaatcaatctgaatctgcttagaatacaattattttacctataaatgttaagaagccatttaagtggacttacttaaatgctactttcagtatttgtactctttcattgaaaaaaataatcaaaaacatgaatgtataaaagcctaatgtcacaaatcgttttcttcatgttttgccttttctaaccagcacagggtgaattaactttcacagtcagccatgcagatttcacagtctcaggcagctaaagatggtctatgattatcttgccagtatttatagcttttggctccaatcccctactgtctctcaacttcctcacatacttgcctgttgaacaaaaattctaactgtttgttatatttacactgaccatatataaaacttgttgtccaatctgggacactatattaaaaacaggcagtgtttttagcaattaagccaaaacaacaggtaataggaaattgtcctgggcaaaccagaatgtatggccctgctagcattgtgtaaagttaccaaacttccagtgtcataacacggagtgaaatacacttaggtgaatggatgcatagatacgtggaagagtcaattaatggactgcatttagggttcatccagttggattctctttctacttttccaaatcagtgttatatattttgtttgcatatcattaacccacttccacagatacacatgaaaaatccatcttgaggaagatatggcaaaaagaaaagatgaataaaagtaaacagaaaatctgagtagcctattgccacttaacttgcctcttttgcctcattggtaaaattaatgggttgtattatttggttattttgagatctgaaattcatgagtatagggaagcccagaagtcaatatagaattgcactcatctctaattatacaagaggacttaacaaaaaagtttatgatctagagcagtcacagacaaactatgacccacaggccaaatttggcccatttctgattctgtatggcactcaattaagaactgttgttacaggtcagcatttacaatcaatttgatgacaggaggcactaagttataacccaaatgaaggataatttcaaacctcaggaagaatccaattcttctcattagtagcctgatattacaaagtaatttaacattattattattattattattaatgttttcaattccatcaacaacagcagaatgctttagaattttatttctttttcacggcataatcttgatttttcctatgtcctgcaaagcctactgtttactatctgaccctttacaggaaaagttaactaatgtatggactcttgctatcagttttgttgcatcaaaacaaaagaccacacacaacaatgtggagacatgacttgctattaacctcttttgctttgtcactgtttcaattcaggtgtgcccctggctatactggcagtccaggcaaccctggaggctcctgccaagaatgtgagtgtgatccctatggctcactgcctgtgccctgtgaccctgtcacaggattctgcacgtgccgacctggagccacgggaaggaagtgtgacggctgcaagcactggcatgcacgcgagggctgggagtgtgtttgtacgtatactaactttgctgttagttttggaggccttgattccagttctgtctcatttccaatgagaaagagtgactctccccgcccgcctttttttttttttttgcaatagttatactcttcattctttctgacactatctatccaccttctgctgttcacctgctgattgcgtgtccatcctgctgagccaagaacagctgagaaaatcctcagtgtgctttagtcagttcattgaaagacctacaatgaagctcctggaggcattttatttgatttgtccatctcagggtttacagttttgcctcaagttggcattgcctttgtgacagattaaagatgtgagtgtattaaaaaatttagaatcctcctgaatttgtaatcgactggacagatactttaagccttgaatgacaactgatgtttcttttcccagcttttatgaaaatccatgggcatactgcttcataattttctcttgaactacaaaacccgtaagcagtaacaatgaagtcaagtatttttactcacgtacagtaagtggagagcagtttgctctcttgctgtctctcttttttcttactgattctggattcgctagtgccatattgaaagtacattgaaatcagtagctaaatataattcttggatcttgcatacattcaaatccaaaataggttatttataaatttaaggaaggagtgctcttctatagtattcttttcctcaaggaaatttattttagcaccttttatttcaacatttacctattgtaatagtatttgtgcatgtcaacatttcttgttttagcatattgtttgagtctaaatcttaatagtatcttaaatagaagaatttttgtttatgttctagttttataagagttaacctcagaagctaaagctggattaaaaaatacaccaaaaagttaagactgggtgttatttgggaaaatagattttaaaatcattttttctttgtattttaaccatctttaatgaaaatgtattacactgaaaataaatgtgaaggtaggtgagaggggagagattaaatgtactgtcaaatacatttatattgtcatatttagttgatagtatatacacactaattcttcccaagtataatgatatattttaatgataattaaagaagtagactatcaaagtattttataatattgctttcaagtcaaataaattattaacatgcacataattaactagataatatatagatattcttaatgtaaacagtccttgaattattaatcatcacttttattaactatccagaagcaaacttgaaataaaaagatcatattaatgttaagcacaaaaattaaacaatagtacattaaaatctggggtagataatataatgggattatttggggaacatttcttttaaagagaattggcattctgcccatcaacaacaatggctttttcatttattgttgatgatcaatacttttttaacattttgaatacatttatcattagaaatcgtaattcatcttttccctatcacatatgtgggtttctaatctccacttgtcccatgtgatattaagaaaagggccaatcctccagttacaaagctacaccagttttataattcttatttgctttattcttgccccacaaggaaatgtatttacaggggttatacatggtatttagttcagttgctggactggaagtgtttatattctttttaaaagaatagcagtttttattccagaaaaaaatattaaattataggattgtttttgatatctagactcttttgctaaagcacagttaattatcttataattatgctgtatagattttccatatactgctcttaagcattagtgatttccacttacttctaggaatgttttctcttcacctttcactaaactaactctaagaattgttacacagagtatctttagacttttcatcttttctcttcttctaaaatttctcccgttatggaaaaatatgccatgattctatgatcttggcctttcccaggattcggtttctacttctactcctagttttgaaatcagataaaataagacacaagtgaggatgtaattctgacttattctcaattttccttttaatatatttctgtatccttaagctaaattagtgcaagagaccaaaaaatggattcacctggggtgtttgatctgcaggacctgttttagcacatgtaatcatggtggaattgcataaggcctgggggtgagagtaagggaggtagcttggctctagcaagagaatttagatgtagtaagagaaatgtctgcagtgcttgttgttagtatagtactgactacaggaaataaactttctcctattgcttagaataagtaaacactcagtttagtagcatgtattgtacaagagttaattttgcttcctttagttacttccctgggaaatataatttagactgatccacatcatggatttgtgtatttcaaaaacagaaaagaaaagaaagagagacagaaatgcatgataaatgacctaagcctgatcattgtgtgatctcaggtaatttgcatattggtgaaaggaatctatacactcactgtaaatttagtttaggctcttatttctcaaagtatataaaattctgctgaagagatcaggcaaaacaaagccaatgcaggaactgtgaaaggacttcccttggacaccttggtccctaaaagatacttatagcttccagggacagttgccagtgacccctggattttactggatccaaaatggaattttttgcagcacacaggccttttatatgtggattttcactactatcatgaagaatgtatacaaataatctgtgtccacgttaggaacctatttagacatcacagtctctcatagttagtgacctaaattcagccccaccatgcagagtcagttcctgagcataactaagcaatttattcaccttcaaattccaggcattctctaaagtcccttttaccacacagggttcatcataatagtaattttatttaaaggctcaccttgactgagaacttaccatttgccaggcactatattaagcattttacacgtggttctttcattcttgtaacattcccattccttatcatccccactgtgtgataagagaactgaatttaggtaggttaagtcattttctcagtgacttttcagtagatccgtgatttgagcatgggtcagtcttacaaatcttattttcttaacctctatgctggctactgataaacagagaaagcaaacgtggtttagccagtatattcaacattaatgaattcagccctttattcatttactgcttccatgtttagagcccattctacctcgattaaaaataaatataaaacgagctaaaattacaaaatgagaaattttaagtgtatgtaatctcagtaatgacatttattttctgctaatcattgagactcctctaagatttaaaacattatggcatttatggtagattccttttcatcagagattgtcaagtagagactgtcttctatgcagaagaaaagatactagctgggtgcccagattaacttcacagcctctttttttctaaaaggaattatttgggacagctttacaatgttatgtaagttggtgagttctgaagagatattttattaatttcccaaattaagatttcttcttgataagttaatacaaatccatcctcctctttcaactgtcattcatagttcacatgtcattttataaaatgagaacaactaacctgccttcaagaaacttaaaaatgaacaaagaagccattatttgcttaacagtaaagtttagtattttgaaacacaaaacttggatttgttcatatcctattttctgtaaactcatatcattaacacagaataacccatgtgatgtttaaaatagattatgagtggcatagtaaaatgtattactctcctagagaacagaaattaaaattagtatctgttggcaagatattacttcataaaaattgcctgaaatagcattttataaatatcaaattggtgttgcctatttttaatcactgcatagtggggtttttgggatatatcagcttttattatttatagtcacaatttacttaaattctaacatatatttatttaaaataaaacatacactttgcttgccaatttgcaaaagtgatcatgaactatgttttctacttgcaacctgagataagcctagctaaatgtggtaattttccttaactctgtaaaattggcaacttccaaccacttggtgaaaccggaagtctgaagttttatcctatcttgatctacagagatataatcaacattgtcgtttttaatagccagttgccaccaaagatctgatcacaataatgcagagacctttatatattatcactagaacactgttgtacatttataatcaaaaatgattaataatggcagtgattgccccctatatatgggagcagaaacaaaatagaatgtggttatcactgtaatgaaaacaggacttactattctgaaaaatgatgataaacatcagttgatctccagatgctgattactgatctaacactttgcttgttgtaccccctaaatgtcatcctctctctgctcgtactcactgctcaagtaagttcttatttgaaaggacagtaagtatgtcatagttttctgtagtctaagctgtgtcatgttgttcacatccaggtgttaggcaatctataaaacatcttctgttcaccttgtttgcaccttctactcatttgttttgttagtaaaagatatttgagtttcttgttgtcaaccttagcattggtccaggctaacaatgtgtggaatggcaactatcaccgtgattctagatgattttcctagttgttagagatcagtctcagtggtttgtatattattgaggaagctgttctgctagctgattaaggagttgcacagttgaattatcgtatagagacagctgatcactgttgcctttgttttcagcaagttttatttgaagagtaaactaaactctactttgattgcaatttctactctggcaaggctcaggaggttttattgaccttgaaagacaaactaaaatcacataatcttaaagttggaagaaataagtaaactagcctagccttctctttttctgtgacatccacaaaacagacagcatcctaatgcaaggaagcatggtgttatgaagtggctacagaaggtttgaaacctagcttgcaatttgtgtgacattatttaatttcctaaacctcattttcatcctctgtaaaatggatgtaaaatgctacatacatgtatgtgaagtatctaagcataataggtgctcaataaattctaggcattgttatcatcattgttattatgtgaccatttttttccccaaagacctgatgttttgtgcaacgcatcagtttctgatgaaatattttctttagtttaggctgactttcagtttcctgttactatctctaattctaggttcttcaagtcactgaaaaccacttttatggccaccttacatttctcctgtctttaagcccttcacatgcattatttatagattcataaacactctggttgtgactatttttctcatctgtaaaatgaggatatgaatggtacttacctcatagaattgctttaaatattaagtgagataatgatggcaaagtataatacattgccagtcatgtagtgactgttgtgtagataaaaactattatcccattattatttatagtactttcaaagtttccattagtgttttgaagagttacaccatctttgaaccacattgaacttgttttcccatgtattatatatagaattttatttaatatatataaaacacatatatcaatatttaatatataaaaatatataaaatatatacatataaaacacatatcataaaacatatatataaaacataaatatcgttacttggtatgtcgacaaattcatcagtctcagctgaggtctacagctttcctctctattcaaagaaatgacaggttaaaaggtcttcttaatgactctggaatcaaatttttatttgagaagatatttattttaaaatagaatgactaaatacatcttaataagccctaaatatatgctaatgtaaaagtttctttttgaaggggaaaaagggaagtgagaaatagaaaattcagatccagggaaccgtcaatggcattcatctaggagagttaatttaacatacacacattaacacataattttatcttttgttaaaaatgtgtatttactcattttattcctatttgattagagcagagaatttatgtatcgctacctaaaattggttaatagctttcgccctttcaaaaatactcagtgtcctcattttagcttcagcttctttggtttggatgcagtgtgtgattttttttgtgacagtaagccagtagttattatgcatggggaatcctggtagaaatgcagtattttgtgctaattgctaacagaaagatctgtaatactggctgcatgatttgccccttacatgtgcccagccataacaatctgaatttagtactgtgtttgttaatattagacacaaatttatcctgacacttttataggcaaagcctcggaaacatttagtcatgtaaaatataatcatggtcttgaaatatttgcttttgctcctgtgcattttaggcaggatttcactttgtaaccttattagtattgctgaatttggagaatggtttggaaaggttctttgaggtcctgattgtaagataggtgttcatttacactgagccattactgcactttatcaaagaacagttgtttacagaatgtgaatattccatgtctctacacactcttcagattttccctatgatagtaaattacatttggttttaatttgcattccatttccaatgtttgttgccagacactttggactttttgagggcaaataaaagtagcttctggtgtaagtgaaatattttgtgtcagaataaaatagcaaaccattatgtaaagggcactttccccatgtgtttaccttataacttcatgagctagacttgtacagaagctttgaaaaaatccccatggctgtcatattcataagtctctctgacccattcagacagatgttagtatattgcttggagcgtactataaaacttacctttcacttatggaaatgtgcttgtactttgttccccaaaaagcaaatacagataccataagacatgggataataataaacctttggacacagaaacataaaatggaatgtatgagcccttgaaagagcaattaaatacattttcatttcaacagctgaagatgaggaaccaaaacagatgggcaggggatagaataaatgagagaaaaatcagtattcatcatgcctcttggcattctagtacaccgtagcatattacagtacatcagctctagttctgcattctggtccctgatttattcttgtatgaagtaaaaactgagaaaacgataggtactttccttggaaatttctggaaccatctagtaaggagtatctagccatcctgttatcaacaaactgattcaattccttcttggaaataggtaggttatatattattaaataaattaaagaataatttaatgtttgctatcaaaggcacacactgccctaaaaagcatggtgaaacatcctattatcattaccaagtatctttaaagatcttggaggtgaaaaaagagcaaattgcttgcttgcatcctaggaacatctgcccaaaatacatcttcactagaggtcaaatggaacttttaaaacaatgatgaacttgggctcagtgagagaagaaccttcctattcttcataattcctaataaaattataattgttactactgctgtttttaacctatgaattgcagcttgaaagtctctgatctgaatcacatgtgcaaaacttgaaaaagtgtgtcagttatcgattgtatcagttatacattccaaagtttagtagcttaaaacaacaagtgcatacactctcatgattctgtaggttggcaatttgggctgagctcagttggacagatcttccactgtcacgcctaggggctcccagatggcctcaagcccaaattggggcctcaactgccctttcctctctcacgttgcctcccttcctcaaggaggctaacctgggattgttctgaaggcagcaggggtccaagagtgtgaaagcagaaagtgcaaatttcaatatgttgctctgccacattctgttggtcagagtatgttgcaaagctaacccagattcaaggggaagggaagtagacttcacatcttaatgtgaggtgtggcaaagaagtattaacagtaacctttttttttttttttttttgagatggagtctcactctgtttcccaggctgaagtgcagtggcatgatctaggctcactgcagcctctacctcctgggttcaagtgatactcctccctcagcctcccgagtagcgggactagaggcacatgccaccacacctggctaatttttgtatttttagtagagatggggtttcaccatgttggccaggctggtctcaaacttctcacctcaagtgatctgcccatctcaagcctcccatactgcttggattacaggcctgagccaccacacccagccagtagtaaccatttttaattgtccccagaaatgatcatcgctttgatctgtcagtcatggtgttctttcctcctaaagttttgtgctgattttcttcccgtccatctctccctttcctgagtcaaaactgaaatccttcaggcaggtatctgaatagtcattcttgttgatcggacagtctctgcctctgcaatcacaagatagttctctttctgtctctaaaccattgtttttaatgtattctcctgttcctcacacatctgtgaggttttctatcttgttctcacattcagaagttttcttccggccaaccccaacctcttccctcttcccctcttcccctctctcttctctcctaacattctacctccctgatcttctcactatttcatgtacttgggcacatgccatgctcaaacattaacccttgccattctctttgtccaaagtgttttgatacccttctctcacaaaaatattagcccacaaatatttactgaatattaactgtgtacaagaccctttcctaggcaccataaccaaggtgtttaaggtcccttctttaacgaggaagaaagaatatataaataaattaagtaataatgtagcccaaacaggcataagtgttaagaaagcaaaggaaatgcagtagtgactggcgcagggtatagggctgggggtggtggggagtttcaggtaacagtaattttagaatcatcagggacttgctctctgaaaaagtgacacttgagcacttgacctgaacacctaggaaccaggtgggagaagaccaagggagaagaattctaggtagagaagacagcaagcaaaaggacctcttccaaatccttgctcccttgaagattgagcatccctataatttatcacctggtccagtggttttatcctttggctacatggtttttcaattactggaatatttttaaaatacagtggttcacgcctatgatcccagcacttggggaagctgaggtgggaggatcacttgaggccaggagtctgacatcagccagggcaacacagcaagaccccatctctatgttaaaaaactagctggatgtggtggcatgtgcctgtagtctcaaccactcgggaggctgaggcaggaggatcactttagcccaggagtttgaggccgcagtgagtcatgatcacaccactgtactccagcatgggtggcagagcaagaccctgtctcagaaaaaaataaaaatagaaatactgatggttagaccttaccacagacccatcaaaaatcatattctgtggtggtgaggagggaaagagcccaggcatctgtattttataaatgttcatgtgattccaatgggcagccaaaggtgagaaccactgatccacaccaatgttgtcacattctaatgtgcagagataatgtgggacgcagattctgatttcctagatctggggtagagcccgattatacatttctaataagcttccaggtggtgccaaaactgttggtctgattgctactcaaagtgtggtgcacagaccaacagtagcaatatcacctgggagcttgttagaaaagcacattctcagtcagagactaagagaaaccaggtgatcaaatcacctcctgattcagaaatactagggggtgtggaccagccctctaggatttccgaaagtcctactggtggttctgaggcccactaaagcttgagaaccagactgtggatcttggtgtttagacacagtcaatttggcacttaactgagttctatgttgtgttttctctaattgtttaatgtggacaagtctgttgaagtttgcattgaacggggctatgaagccaaaataatcttttacttggtttccatgcagtgcaaatttggtttcattctggctaggagaagagtaagagatatagccctagttccagacttctgctctggcctccaaagcctctttgttcattcagcttgtgaagcatcaggagcttgcaaagcccctgcaggtgacgctctacagttgtcacctgcaagaagctgcaggtgtcacctgcaagaagctgatttattaaaagccctgccagggcagtttaatccctgtgaagtgatattgtaactcacctctagctgctgtcctatcaaaaaatcactctccgtcctccttctctttgtttacaagcaccagttaatggttttctctccattaagcagctcaggggactgctgtttagagacctaattgaattcttgccaagtttgggcatgatccagagctgctccaattctcggtattttccatgctatgtattttcccctattctaacatgtatatagcattgatacctctatctgcagaatgtaagaaattgtaactgtatacatgagagtatattataaatgcagtagttcctgctccttggcgtgcagatacacctcattactctgcaatgcaaaactaaaaatatacatgttttttaaatctgctaaaagattcaatatatgttaattttggaaattatacgactatttatgagatctattccataatgaagagtcaacaatccatttgtctctctaccaattctaccacctatcctggcccctaccaccaaatttgaatagcacctctttgatggccaaaaatattatggtgagtgtattagtccattttcgtattgctataaagaaatgcctgaagctcggcaatttgtaaagaaaagaggtataattggctcatggttccatcaggctgtacaggaagcatggctggggtggcctcagggaactttcactcatggcagaaggcaaagctggagcaggcatcttcacacaggcagagcaggaggaagtgggggctggaggtggcacacacttttaaataaccaggtcttatgagaactctgtcatgagaacatcactagggcggtggtgctaagccattaaaaccactccagtgattcaatacctcccacgaggccccatatccagtattggggatgacatttcaatatgagatttggatggggacacagatccaaaccatatctggtagaatattagcattcttggctacttaaagaatatagtttttctagcctttagcaattatttatctataagactgaaagaggttaatcatcaaagtagggatttgtgagactgcatctaatcatgggtggtaatagactgaagggataaagaggaacagttggcaaataaataagtcaataaatattatcataagaaaacactatagaaagaaaagttatttttattttgactttttattttattttttggggggtggagtctcagtctgtcgcccaggctggagtgcagtggtgcaatcttggctcactgcaacctccgcctcccagtttcaagtgattctcctgcctcagccttctgggtagctgagactacaggggcccgccaccacgcctggctaatttttgtatttttagtagagacagggtttcaccatgttggtcaggctggtcttgaactcctgacctcaggtgatccacccacctcggcctctcaaagtgttgggattacaggcatgagccaccacacccggccttctttagactttttttttttttaattattctactcaatagataccaagctaaaaatttatatactttttgaatgtgtaatacataaagcatgtggaggtcaaattactatgactttctccagtgcaatctaatggagcaccacacatttagactctggagcatgttttattccctgtggacaggttcctttcgattgctcatgtagggatttagggggtacttttaatgttatattctatgccttaaaggaaatcttcaatacttgtgcaatacactttttctccccaaatctatttgctcctcctctttggtccctcagtttatattatcgcctctatttcaggttctgggcgacatgcatatctgttcttttgttgttgttcttatctttcctcaaccatcatccatttgatagcattaatattctgagatgagtagtttcatcttccatggaattattcttggaccataaaatatttcatagctgaattctttgaacatctgcctgggatgtttagcagaagtaactactctttgtcacttctctttcacagtttgtggagatgagtgcactggccttcttctcggtgacttggctcgcctggagcagatggtcatgagcatcaacctcactggtccgctgcctgcgccatataaaatgctgtatggtcttgaaaatatgactcaggagctaaaggtaggttggtgcagtcacaagcaagggccagggacaaggtgacagaagcttcacaagcggtattggctgtaattggtaaatgttcttcccacagccccaaatcaagggacacaactgttagggaaattcagagactttcttaaccagtgtttttcaaactcaagaactataatatacagatttctattaagggaaaagagtctcatgtaccccccagtgtctggcctaaatcagttttattatgtcacttaaatatgtgcaaacataaaatcaggtataaactctttatacttatagctctataaaattaaaacaaattaatccttacaaaaccaataaaattcaaattaaaaacattaatataaagtaacatgattttggctgaatggaaattgctgcttgcaacaagaataggatattgactattttcacacagttcttccaccagagatgatgtggtaactcatttctcctaccttaccacatttgaaccagagagccccctacaaagggtcctgaaatgaatgtgagcatcacttgacaagtttatgtgactaacgtgctcagtctgccataggctcaaacacacaggcaaatgtaggcactgagatcaggtggccatattcatctctcaggtgcctagcctgggatccagaaatgcttacattaatatttaaggttatcatcaaaatgaaaacacatgattagaatcttgtactaaagagctagaactagtagacctttaaaagttcttcaacaagcaccagtttgataaacactgttctaaattgtggttaaagcttttggtagttaacgaggtaggagaaaacattaaagaaattggggttgtttcacctgatggaaaaagatgaaaggtgtcaacttactatcagtcaattatcagatatttattaagaaattatagaatacctcagcattgcacttggttccctggggatttcatgactcttttaatatcttcactacccttaggaaatgtagattctatgtgctttaaaaataatcattaaacaataatcaagcaattagcaagaatacataatgaccatgtgttttacaaacattcaaagtacattagcgcacagagactggagaaatcagtaagattcagggtaaccagagaatgtaccattactgagagtataatttctgttggaatttgaagtgtagacacaattttagtagagaagtatttgttgctttagaggaaggcatctaagatttattcactacacattggtagatattcttttaggaaatatattctttaattctgaccataacctttaaggtaagtattattatccctattttccagaagaagaaaccaataatgatgataacaagaataactaacatttattgaaaagctaggcaattgactgaagtcttaaatggattaccatacatagcttttacagaaactccaagaaataggaaagaagttgtcatggtctgaatatttacatctccccaaatttatatgttgaaagtctgtcacagtccattggagctgctgtgacaaataccataaactgattagcttataaacaatagaaatatatctctcacagttctgaggctgggaagcccaagatcaaggtaccagcaatgttcaatgtctagtgaaggcctgttcctcacagagggtgacttcttgctatgaccccacatttaattcatttaatatctggatactgaggaaaaggatagctagctctctggggtctctttaataagggcactaatcccaatcatgaaggctacattctcatgactcaatcacttcccaaaggctccacctcctaatatcatcacattgggaactaggatgtcaacacatggatattagaaggacacaaacattctgccttctgccgtgtgaggacacagggagaaggcagctgtgcttaacagagccatgtgagcagaggcagtggtgtgaattagatctgtctggcagatattaaaagtcagacctgctagtgaaagataaggctggagacttcagtgaggcagggtgatatgatggacaaccttgaaagccaggcagaggaacctgagtttaccttgtggtcctggtattcagggaagtgaagagttttaatgaaaagaatgccgatcagttattttccttgtatatggagagaatacagaaaaataaattaaactagaaaagcaaacattttagttgaacatgaaacattttaaaactaatacttaagcaatggatgatgaagtaaagaggatcctatagaagaggctccaatttgtgaacatcttctaagccaagggattcagtgacccatccacttctggctggatattgatccagatgacctggattatccttaaattctagtctttcttgattttttattttgttcttcttccatcattcacttgacatttgtatactgaggatcaccttctggtattataaaaacttaagttatttcacctctttgctcaatttctttaactatgtcagtgctccccaagcttcagccaaagaccatcaaggacacacatgtgatggaacaaagtgggatttattaacttgttgcaacaaggggcactgaacaccatgggggaattgtgggctgtctcaataagaaggtgttaggaataacttctagtatttgaggctgtgctagataacttaaggttagcactcaactgggtgctattcagaagtgggagtaattctgtgagtattttgtgaatcctatctagagggaaggaagaacagagggaggataaagctatgattaataaggaggcagtgttcattcatattagccaggaaatgggaggttggggtagttttgtggtctacacaaaacccgctatggttttgtctgcgcttagacattacagggtagtctctttttttctgtttcattcatcactggttcagagtgaccttgtctaatttagtgtcctatgagattatttatgttccataggaaaaaaatatggccctgctgttaggccagttcctagcaacaccgaggacaggccagttagttagcgcctagccaggtctctatgttaaggcctgccgttctcttttttacctgtgatctgtgtctctgttaattggaatgggagccttaaatgggccaggcaaggagtttatcttaactctaccccttactgactgtgtgatctcgtgcacatttttaactgtcttcaagacagtttgctctttcatgaaatggaataatgcttaccccccatagagctgttgtgaaaattaaatgaaaaaacaaaacataaaaagcctggcacatagtaatttctcaataagtcactgcaatttttattatttgcctgaatatttggcatgacactcaatgtgtaagtgcccagttgaaatagtttccttatcttttctttgaaggtgagaaggctaagttccttttatatacaaaaatgtgttctgtcgaacactatcactgcaaggccatttactaaaaatgtttatgggatggaatctttttcagcacttgctgtcacctcagcgggccccagagaggcttattcagctggcagagggcaatctgaatacactcgtgaccgaaatgaacgagctgctgaccagggtaaggtggcaaaattatgaatcttctgaaagcagatagattatgtcaatgaaggaaaattacttcaaagttctgaaatgcaaatcaccttcttcctaattcccaatttggtatataaaatagatgtattctgacttgctaattctgcttcaaatcaaatcatagaaatcagtagcacgcagaaaaattggggatacctggaaattgtcaatggctaaaaagtccagaatgacagtgtattttgagaactttattcagtagcctccgtggtaaagtttgtatctgttctgatttccaaaagcactatctttgattgtgtaaagagaaagaaaaacaaatgaaaatgcttgtggtctctttcatctcatcgtgggatttttgcattagtatagaaatacagtgtaaatcagtctttccacacaaaagaggaaatcttctctattgtgagactccaaagtgcttaagacactttttaaagtcagaatgtaaagtccatgttgcatttatcaggctttttaaagaattggaaattttaaattttcaaaactgcgatggtattaaaaactttttgcagttagagaatgaagaaaacaacataaagcccgccatcttgtggccagaaatatgcatgaagctagaaacggggctgcaaagtacggatttaatttgattatctaagagctttaaatgataaagagtattggagctagaaggttcctggggattatcgagtccactttgtattttaaagaagagctgcctcgggccatgacagtgaaacgaattaacaatggccatacaatttgctaaactcagggacttaagctggacccagtctcaagattcccactggcccagtactttttctacatagcctgctgtcggtttaggaaaatatccacaggaaaatcaaataggcttctgagcacataatgctaaacaacggccctgatgttacaatagcatactaaacactttttcagaatctcatagcaacaatatagaatgtacagatacaacacggagtttcttgccaaatgtatgtagacattagattaaattgagtgcatttatctcatattaatttaatatgaaataattcatatttgttataaataagaattttctaacaggtcatggtagaataaatcaatttaacaagcacacataaatgttcataacatacaaagcctaagttacgtgttggcagatgaaaaatatgaatgaggctcaatctgtcttcaaagaactttgagatgtgtgtgtgtgtgtgtgtgtgtgtgtgtgtgtacatcagcatttaagtgtatggaggaccatattagacaactgcatgcaggtatataataaaacatgaaataaaataaagtcggaagaaattctggagaaatatttaataatagaataatttcatctgcttaggggtaattagaaaaaatttcatgtaataaatggcatttcattcattcattcacttaactaatactttttgggagtctctcatgttctaggaattatgacactggggatagaagtgtgagcaaaactgcgcagtccttgccctcattggcttagtatagtctaatgatctgacgttagagacacaaaaagtatttctttttttttttttttttgagacagagtcttgctctgtcgccgaggctggagtgcagtggtgcgatcttggctcactgcaacctccgcctcccgggttcaagtgattttcctgcctcagcctcccaagtagctgggattacaggtgtgtgccaccacacctggctaattttttttgtatttttagtagagacgggtttcaccatgttcgtcaggctggtcttgaactcctgaccttgtgattcgcctgccttggcctcccaaaatgctgggattacaggcatgagccaccgcacctggccacaagaagtatttcattaagagtgtcagatctttattatgtctcaacctatactctttaccctttccagcagattgtctcatgctatgttttttaaacagactttattttttagaacagcttaaagttcaaagaaaaattgagtgtaaagttcagagtgttctcatatctactccctgcccccacaaccttccccaccagaatggtacatttattatagtcgataaacctaagttgacacctcctcatcacccaaagtccatagtttacattagggttccctcttggtattgtacattctatgggtttggaaaaatgcattatgacatgtgtccaccgttgttgtaaaatatagaaaagttttactgcccgaaaactcctctatgcttcacctattcatacctccctcttccttgacccctggcaaccactcatatttttactacatccatagttttgccttttttggaatatatagctggaatcatacagtgtggtactttttcatattagcttctttcccttggtaatatacacttaaggtttctccatattttttcatgactttatagctcatttctttgtagtgttgaataatatttcattgtttagacatatcactgtttacttattcattcccctactgaaggacatcttggttgcttccaaattttggcagcatgaatcaagttgctgtaaacatctttgtgcagacttttgtgtggacttaagttttcaacctatttgggtgaatataaaggagcatgattgctggatggtatggtaagagtatatttagttttgaaagaaattaccaaaatgtattccaaatggtcttttctattttgcattcccaccggcaataaatgagagtttctgttgctccacatcctcaatagcatttggtgtttttagtgtttggattttgtcattctaataagtgtgtatggtatctcattcttgttttagtttgcaattccttaatgacatatgatgtcgagcatcttttcatatgcttatttgccatctgtatatcttctttggtaaggtgtctatttaggtctttttccattttttcattgggttgttttcttgtcgaattcagagttttttgtatattttgggtaatagtcctttatcagatatgtcttttgccattatttgcttcccctctgtggcttgtcttgttctcttgagaagtgtctttcacagagcagaagtttttaattgtaacgaagcccagcttatcaattaggtttctccttgttgagcctttggtgttgtatctaaagactcattgccatatccacggtcatctagattttctcctatgctatcttctaggagcgttacagttttgcattttacacttaggtctataatccatttttagttaattccaatactattttaaaataaactttttactttacagtagttttagatttcaaaaaacttgcaaagagagtaccaagagccttcacatactccattcccagtctccccattgttaacatcttacattagcatggtacatgtgtcatatacatgttatatacatgtgtcatatacatattagctcatatacatgagctaataatattgaaatattaccattaacccaagactgtattcatattttttcagtgtttactgaatgtttttttactgtttcaggatcccatgcaggatactacattacatttagccattgtgtcttcttagggttcctctagactgtgacgacactgtcaaaaatactgtaacagtgtttctgatgactttgagagtttggacaggttcatgtgtttggtaagctgtccctcaattggggtttgcctcatatctttctcatgattagaatggaattatgagtttttgtgggaaaaacttcagaggtaaagtaccattttcatcacatcaagaacccatgtgaccaatatgacttattactgtggatattgaccctgatcacctgactaacatagtgtttgccagatttttccactgtaaagttactcttttatgcccttttcatactctaatactatttttatctgcccattcttcagattcagtaacataaaaggcgcagaaataggactactgaaagcaaagatcactttgatgggttgagaagggggaggaaatgtaaatactcattaattacttttttcctaccatatttataattacaaatatatcttccatgcagaccataaatactcaagtcaacatgaccaattctctctttccctgtggtcaagctgcatgacaatcaaaaggtgaattaatacagatggaattataattagagagttagatggtttcattatccaaaatcaggctaagcacgctaatgcctctatctcagagtcatgaatgatcctgcagttgtgaccagggtatgagaaatgcagtggccacaacttccaattacccatgactacattagaggagacagtgctctagactaggactgcacattggaattaccaggagccctatctcacacccataggttgtgatgcagttggtctggggtagagtcagaccactgggatattcaagaactccccagattatactgataaagaattactgtgatcctgtagttacctaatagctaagactctcttccctctggaaaatgccttaattggtactgccaatcttttttttttttttttaaacagagtttcacccttgttgtccaggctggagtacaatggtgtgaactcagctcactgcaacctccacctcctaggttcaagcaattctcctgcttcagcctcccaagtagctgggattgcaggcacctgctaccatgcccagctaatttttttttttttttttttaagtagagacagggtttcatcatgttggccaggctggtctcgaacccctgacctcgggtgatccacccgcctcagcctcccaaagtgctgggattacaggcgtgagccaccatgcccagcactactgccaatctttgttatgctcctttttctctgcttggttggctcaccagtcacttgatacagtctttagatttaagagcacatgtcaaggttgatcctgcatgactgctgtaggagctaccctctcttctttaagggcttttatattttatactcattgtttttaaatggagaaatctaattccctaatatccctgggtaaagaagacattattccacccaagaactcatatttaaaatgtattttgatatattttaattcatgtataaatataaagtaaaaaaattacataatcatatatctctttcaatgcattttgatttgttgccattttattttactcactggaagaacccaagttcctcacatatgagaatcatgtttaacatattcaaactgccctacagtatgtgtgaaatattaagatgctttttgatgatgactctacttacctctatagctattgtccttagctcctttcttttttcagagccaaaattttttaaagacttggagacaagtctgtatttatttctcactccactgctgcctggattttcactcccagcccactactgaaactgtttttataagataaccaatgacaatctggtaactaaatccactggatacttattaattttacttgaaatctctgcagctttgatctttccttccttcttaacatactgtcctctctctgtttttctcttaattctccaacctttcattctaaggctcttcctctcatcatcccttcaaagtcggtgttccttggggactaggcctcagtccatgttttccctcactgtataacactttctttggtcttcaattgccatgtacaagctgttaattcataaatctatattttcaaggctgacttcattctcatgctttggtcctatgtgccttactatggattggacatctcaaactaaactcatcatttcctcttaaagcccattatttctcctgtgtagaacatctcagtgttttatccgccagtatatgcccagtctcccaaagagaaattagcaggttgcccttcactctactccctctttcatccttcatcaaattcagtttccttctatggtgactctttgtaagccttatccaactctaacctgttgttatttatatggcagagtgaacattctaaattgcagatcctatcatgtcattctcttccttaaattgtactatggctttccacttttttcaggatgacatacagtgctctcccaccatgatctaatctctgcttctctctcatctctccccactactcatggtctggtcatctggacccctacggattgagggtataagccagaaacctacaaattttctttggtgcctctttcttcctcatgatgctcctgcttatccaattcattaccacacactgggcttccacttgtgtgtatggcattcatctctactaccccactctcatccaatctcatattgtgtagtttgggattaccacatttgttttttagctggtctctctgcttttactcttgttctcctccaaatctgttctccgtaacgtagccagaatgaatgtttgctattccaaatgtgaatacgtcatcgcagtgcttacaaactcttcccctgacttcccttaggctcgtaggataaagaccaaaattctccccttggccacatctcccatcacttgtgcccctggccatctgcactccagccatactgtcccccagccactttgtcccaccacaaagcattgccacacatttctttattttgccttaaaggtaatctacctctccctacattttgttaatttctgttaactccaatttacctttcaaatctcagctcgtgaaagccctctgtgccatcgcaggggttccaagattcctcctgtgcttatcttataccactatttttcctctagtttgtagttataaatttatctacatgatcatttgacaaataactatatagtccaccagactatagactccaaatgggcaagaaacctttttgtttcttaccacagtatcaccaatattgtacacataataggtgttaagtcaatatttgtttaattaattgtgaatgattttaaaagcatttgaacaacaagatggaaatgtagacaaacccaaaataaacatttattttgcactctttaaaatgtgttaaaatcaggcatatatttataattatattgttgaatattttgttttcattgataaacacctcttaactatttatattctgtaaggggagaatgctatgtagtagattgaactgtataaaatattaaaattttgtttcacttatattgtattttattgcctattgaatatcaaatttaatgaaaatgaaacatttccaaaaggatgaaactagtttttaaacgatttaagtgccaatattataagtttacaagattttatttatagtttttaaaagatttcaactgctaacagtgttttttatttctccttttatatttttaaaagatatatatataatataaaacaagtcatatctttttggtttggaacttttaaaattggcacgtgaaatatttaggaagaaattccacatggaactggctcattgtcattccacggggtcagctggttgctccttctttccttgtgtgttgttggtccttatggcttgcctgatgagtgcttcactaccacttagacatatggagctggtaatattggaagatgacccttgagagtatcatataaatgatttgatctgaaatctaattttagcaggaaaccatatgagtccacaaatgcaaaggtagacagtatctaagcaatgttatctattcagtagttaggtttgctccattagattctagttttaacataaagaaggcagaaaatgaaacacactggtcatatccaaccaagaaaattatgtgcagattttaagaggcacagtagaactgcttgagctaaagcaggaaagtaacagctacattgttcagaagtaaattaacgtgtgcctaatggtaatgcatgctgcctagacataaatactctaaaaaacaaaacaagaaaaaatagaaaaagaaatgggaaaaaaaaaacctagttgagtgaatgtcaacataaaagaaaaggtaatcaaaggcaagagagatacaagatactgtgtaaggcatcatttacaaaggaacactgtaaagattgcagaatagaggtaagagaatgttaaaataagaaaatccaagatagagaatgaaaggaagattgtacaacatattaggataaatgagaagttatttgtcaaatactcaaaggacaagataatagtgaataagaagaaggatgactaagagatggagatggtaatttaataaaacacagaaagagccaaactgaatcagacagatagttcctatcatgtagtatttagcattcattcataacattatcaatagcctgtcctgggtgagattgatttttgtgaattttgctttggcagtgataccactatctatcaccactacccataggtgatagtgcatttgtcataggcttctttatgaagtctctcgtgggtatttttgaccagggtgaatcttcaacttaattactgtgtaatgagacatgatttttaaaaatatatctagatgatgttctgatatgattttgaaatgtgttaattgactgaaagtcaaaacttatatacttaaagtatacattaactggagcagtgtcctccactcacctagaatactccagtttttcatgtattttactactctttctggatgttagccaaacacaaaatagtgttgggtacaaacaaaatataagtctgtgagacaaaaaaaaagtgtatttcatctccaattccctgtacatgtaagttcagataagttacttaacctcctcataccttccttttcacctgtgtaaaaagagggatgatgccttctatatatctctaaattcaggaagagtaagtgagacacacgagagtgctgtaagcctttgcaaacatgtatataaatttggcataactattcacaatagcaaagacatggaatcaacctaagtgcccatcaataatagactggctaaagaaaatgtggtacatacacaccatggaatactatgcagccataaaaaagaatgagttcatgtcctttgcagggacatggatggagctggaggacattacccttagcaaactaacacaggaacagaaaatcaaatactgtatgtcccacttataaatgggagttaaatgatgagaacacatagacatgtagaagggaacaatgttcactggggcctaccagagggcggaggatgggaaggatgagaggatggagaggattaggaagaataacttatgggcactgggcttaatacctgggtgatgaaataatctgtgcaacaaaccccattatgcatgggttttttttttttaacctgtgtaacaaatctgcacatcctgcacatgtatccctgaacttaaaagttaaaaaaatataaaaaatacaagtaattctgaggtacagatgagcctgactgtgtaactcatcctttagcatgctaacccgcattaagttgatgcttttggtgccgggaacctcacgtctcctcctcttctggaatagcctagagaggaagctcttcttctgtgtttagagggaaggtatctccttcagtaagcactgtgctggccctgaagagtcttcctaccctcttcctgccccctactgccactcccaccccaccagcgtggaacttcgtgtgtattcaaaggtccagtttgaattactgtgaggccagtggctagaaagcagtgtagttgggactggagattcacatgcctggctcttctcccaagcttcaactgtagctcttgagcagcagcttcctctgagcttctaaaaaatgcccagaaaattgcccagccaaccacatttcctggcaagcatagcaccaggcatatggtcagtttgagtgctattagataggctttagaacttccaagggatcattggtttgattgtcattgtatccaccaatcacccaacatctatgacccacgacaatttgccagacactatgcttggcactctgaggaataaaaagagtaagacagatccctagccttttctaatctatctatctaatggagatatggcaaagcacctaacaaagtcactacccattagagttgtgaatagtggtaataataattatttttgaaaatctaagaaaagagagcatgtgctagaataggtaaggagggcttcactgagaagatggagttggaattgaatctcgaaagctggatttgttttggataagtagagaagagttaagaagcaaaagtatgaacaaaatctttttttgagaatgttccaaaaggaagtaggcaagaagaatggtaataaggttggcaagattggttaggaaaattgttttttagtcctgtatataacaactttagagaatatttactataagttaggcatcatactaggagctggatatatgataaacaaaacagaccaagttctcacccccttagagcttaccttacagttggagaggttgtcaataaataggtgagccaattactaagtaattctcaaatccatggtgctatgaaggaaacgtcctgctgcaggaagtgtggaaacctaggtagcaccctgggaatggccacgctaaggagaagcacttaaactgaaagctgatgggtaacaaggacccagtctttacaggtgttgaggagaagctcattctaggtaaagacaatgggatacaagaaggtgctaagaagggatgagttttgcatatttaatatactaaaactatgccagggaggttgattgcatagggtcttagtgctaattgttttaacttctttcttatcatggagtttgtaggattcttgacaatttagtattgaagtaatcatataatcaatactaagaataaaatgcatgtgaatgatgactcttacacattactacgtaaatgaaataacctgtacaacagatcataagccagaggaagttaagacaatgaatatgatcttgatcatccagaatttaaaagagacagtgtatgatatacatttactttttaaaatttagacactttgagttataaataagaattggtccacttggtgtgaaattatgatcttttggtaatacagaaaatatattgatgaagaaaaagaatatattttaagtttaaattataatgtacattttctgtaccataagagacactagtggtattgatacattaatccgtaaggtaagatattggaagatgaccaaaatatagatcaagttccttattatggtgttcagtaatatgtgaaagtaagagtggtaccataaagttcagtcaagtctagactagaaaaatatccaaagcagtttagactacgaacatctttttttttcttttcttttctttttttttgagacagaggctcgctctgtcgccaggctggagtgcagtggcgtgatctcggctcactgccaagctgttgaccttagttagtgattcagaagtaacatttaaataattgggtatgagtatgtgtgtgtgtatgtgaatgtgtttatgtatatgtgtctgtgtgtaaaaagttatttgacccatcagacctttgagtgcaaacacgtgcaggaagccaagtttaaggaaattaatggaacataattacaacactcaccagaaaagcaaggatttgagtaacctagggactggatgcacagtttatcccaaaaaaatttttaaatccaaaagtgaaaataattccattattaatgttttagaagaataaatccagagcattataatactttggttaatactctccaaattattgtgtatatgtactgcaaattatacagaaaaaaattttaattttccaatggattcttatcctttcatcctttcatttgtgatgttaacacttgcaggatgagaagttagatgataatagttggactttatattccttcatttgtgcaaaaccttgaaaactttcataaattaaacctcttgctgcccttggaaaatcacaaaatgcagtacaattcctctagcgtcttttaccatgttctgtgctggccagacatttagttctatttaaaatccacttacgtatattttaaatattaattctctggccatgcctagtatgcaagcactctggtacaagattctagagtgttaatatgctgccaacttggaccttattcaaaactatattgagacagtttgtgattctctaattcattatctgtagttagactatccatatctttttagtaaaagagaagaaggcttatatattagcatatgcaacacatagaaaaatgaagtataaacctttcagggtactctaaaccttgtaatttttaaagaaacaatgttatacacacaccatttttgtttgactaaatatggtatattttaaccgtgaacacgttgaatgcattccagtgtgtcaaatgatattttaaatgtaaatagaggtgaatgtgcctgagaatactctttgggaggtggggctgttttggggttctgttttactttgctgacactgctgcatgattctgtgattaacaagcatatttctggtgctatcatatggaaaagttagcatttattctcccttaacattttattggcatctttgatgtgttataaaacaggcatttactactgagtagctaagcatttctccctctttgtttctttaattaacgtattgatctaaaacaaatctataggatcaagcttattgaggcagacagcctgtttgtctctcaagagatcattgctgcactccacacactttttcagtaaataaaatatggacaaaactgcaacatgtggaggctgaagattccattaaggacttttggcatctgtaccttaaagatatttcaaaaataattgtgctttattgcttcttctctgccatagcatataacaagcgttttttaaaagaccaaatacagctctctgatttccatttaatggaagaagtaataaagtttaattgtatacgtgagcatggggcatcatttgcaatacatctgatcaataattcatcgattgccgttggctcaaagtaatatttgaaagaaaatgcagccagtgggagcttatctagctgtagcttcatcatctctattaattatgtgtttcccgaatttggatcattaggctaccaaagtgacagcagatggcgagcagaccggacaggatgctgagaggaccaacacaagagcaaagtccctgggagaattcattaaggagcttgcccgggatgcagaaggtattagaaagaatcacattttaatcatcatttctcccaacagaaaaacacagaaagggatgacacaggactggaatttctcttgttataagtgacatctgtaaaatcaaaggtagagtttcaaaaagtagtgtggttaagatattcaagggtattatctgctgagaacctgtgacctgcagtgttaaattagcgacaatagtgaattagcgacaatgagggcagaatagcagtaaattcttgtaacatggctattataattacataagaataggcaacttttgttttgttattgtttttatttgaaagtatttaaagtatttttcattttcaagcaagctaatgtcatcattccacttgatacattaaagcagcactttagtttctccaaatggcttttcaaatactggggactggtttttaatgaacatctgttgcttgggatttggatgtgctactttatgagaagctctggtgcatttagctcacaattctctaggagttagttcttgccatctactaacatgaatgagaaagtggaagccattttttggcaaaagcccaaattaagaaacttaaagaatacagataatgccccatccgcactcgccccccaaaaaaacctagtccttaaatatctgttaaaatataataaacgtgcatgcatgtttagaaattgggaaaaatgctttttgttgttttttgcttgaagcagtaaaacatttttcttgctctgcaatattatgcattttagatactttgcttcataatgtagccaaataaataaggatgtgagatcaacttcaaggcagattctgactgataattcttaggcatcactggccaagaagagacaaactcccaaatgttcaccactgcaagaagcaacagggttttaatttgagagctaatttgaggcaaaggtgtgaggttctgaaacagaaattatttctgccagaaaaatctcagttaattcattgtggtttatcctctgctagatgaagctgttgtactttccctagtattattttccattaatgctacttgaagtgtccccctccaacccaaaacaacaacaacaacaaatcccactgcaggtagagcaccttcactctgagcggatccccaaaggccctagtcaatgctccaggaactttccttttctttccattgacatttcaaacacccaacacctagcagcccatcctggggactcattttcaatttgtttcaatcaaacactggtatgagaataaatgctagcatatgttttagtagatcctattatcaacactgcttactttgttctctgcaatgaaccttccatctcccaccaaagagagatgcatattcatggttacctctttggtcaatatgaatatttgcttcttctgggtgcctagggcctctaggtactatttgtacaatttgtggaccaacaggggtagactggagatggagatttatcccaggcttgctcaccaccccaaatcccacgtctatacaccagagaaaggattacccatcaccaaaggtgtctctcgttccctaaattatgcatagatcaggtggtctgattgtgtctgtccagatagggcacccttttctaatttatgtgaagtgccatgtgggatagctatactttagggaaataagaacaccactcacttttgcctgcaggcactatttggtagaattaatccaactgttaaaattgaatgaaaggtcaaatttaaattgtaccagagcaacactaaatgttcattgagatgtaatacaaagcttggcagtttaatggagaaaaaaagagaaagtgggggaaggaagggaggggagggaaggaagagaggggagggaggaaaaaggaaggaagggagggagggaggagagggaaggaagggaggggagggaggggagggagggaggaaggaacagagggaggaaaggggaagggagagaggaaagaaggaagggaaaggagggaggaaggaagaaaggaaatggaaagaaggaaggaaagaggaagggggggaaagaaggaagggaaaggagggagggaggaagaaaagaagaaaagggaaggaaggaaggaaggaaggaaggggaaataagaaagggagggacggaaggaaggactcaccaaaggctttaaagtaggttatactgtatatccacacctctttttctctctctctaaactataataatgagggataaccatcagtacttttacatttttgtttgtcagttgtaataaattgctgtgggaaaagtaaatgcttcagactgacatttatctatttcagctttatgtttggatagatgtactattcatcctatctttcattatgagtcatgacctcgttatagataatcaccttctattcatctaaggcattcttatctcactataattttataatatctaccgtgctatgactcctgattagttcataaataaactgttttattccacgcattattagaattaatgagtggacataggtaaacccattagtgtttatttcctgacatacaataggacttaatcaatgatagacacctttccttcctgtttctcagatcagagtattactttctattcttaataaatttacccatcagaggattttgttttcagtcttagtatgaaaacagttttgcttctcctgaggaatttttacttacctttatagatactgtatgcctcttaagaatcctatttgtattccctgctacgcgtagtctactaagatgcttagtagtggacttaggatgcactgcattgaacgttatggcatggttttctgtctactaattctttccctaatttatacaacttttttttttacctgtagtgctatttccttttattttaattttatctgatattaggatttttaaaaaattacctaaatcctcctttgaattaagttggaaataaataagtaaattccaaagatacatcttttacaatcattttcaatactgtgggaaagaaaatatattgaagtgatagtgcatacttttgaataagagatgaaaaacacattcatctttaagaatgctcagagaagttccagatcctatttatacataggatctggaactatatatatgtatataaacataaaactgtatgtttatatatgtctataaagagtgaaacagacttctattaaaatgatgcttcctttccttttttggtgggggagatttctaagaaaatcatattgcctagcaagtgatagatgcctatgagagaaatggaaaatgacagcattttaaaatttaactttcagtagaaaaataatggaaataaaaattaaactagacagttcaccatacaaaaataatgttaaatgagggtaagtaaagcgcagtgaaataatctggaaaataactataaaactttaaaacactaataataaataaatgttatccaaattaaactggcaagttttaatgggccatgtgtaatttatctgtgtcccgatgaggccatatttttctccaaaacccatatctaaaatttgtttttcataatgaagataaagtagcacacataccaaaaacccatttgaaagatgctctcatttaatccaaaaagatactgaaggcccatgtccattttggggagcttgtattttttttacataacatgggttgcaacaaaaagctggccatggaatagcagtttattccataagcagccaatatatttgctaaaatgtttgttcttttggtcctaaccacattgaaatcttctgggactatttcaataacagtaattgcaacaattgataatatccaactggaaaaaaaaaaacaacctcatgactgagctgcacagtgatgtcctatagaaactttatggggtatgtgttatatgttttgatgtttttcttttttttattctcatgtttttattttcctttttactttaagttctgggatgcatgcacagaatgttcaggtttgttgcataggtatacctgtgccatggtggtttgctgcacctatcaacccatcaaaagaagacatttatgcagccaacaaacatatgaaaaaagctcatcaccactgatcattagagaaatgcaagtcaaaaccacaatgagataacatatgacaccagtcagattggtaattattaaaaagtcaggaaacaatagatgctggcaaggctgtggagaagtagaaacacttttacactgttggtgggaatgtaaattagtttaaccattgtggaagacagtgtggcgattcctcaaggatccagaaccagaaataccatttgacccagcaaccccataactgggtatatacccaaaggaatataaatcattctactctaaagacacatatacagtatgtttattgcaacactatttatgcaaagagatggaaccaacccaaatgcccatcaatgatagattaggtaaagaaaatgtggtacatatacaccatggaatactatgcagccataaaaaagaatgatatcatgtcctttgcagggatatggatgaagctgaaagcttcagcatcctcagcaaactaatccaggaatggaaaaccaaacaccacatgttctcgctcataagtgggagttgaacagtgagaacacatggacaaggaggggaacaacacacactggagtctattgggggttgtggggagaggaaaaggaaagcattaggacaaatagttaatgcatgaggggctttaaaacctagatgatgggctgggcgtggtggctcactcctgtaatcccagtactttgagaggccaaggcaggcagatcacctgaggtcaggcgttcaagaccagcctggccaacatggcaaaaccccatctctactaaaaatacaaaaatcagctgggcacggtggcatgcgctataattccagctactcgggaggctgagacagtagaatcgcttgaacccaggaggtgcggtcgcagtgagcagaaattgtgccactgcactccagcctgggcaacagagcaagactccatctcaaaaaaaaaaaaacaaaaacaaacaaacaaaaaactggttgacgggttgataggtgcagcaaaccaccatggcatatgtattcctatgtaacaaagcttgctttcttaatacatgatcattttgctaaagtcatttttgtgcaccttaatgattgcttcttgtttacaaatggttttaatttaaagaaattatgtatgccatccaaaagatacagccatatttgccttttccctttctctatctgttgtcattctttttccaccagattcttctctgcagaagtttagctttgagaccagagcacaagagaaatagtgagactctgtctctcatttttcccttcctctatactgcctaggcccagaatctaaattagatcaaatttcaaaagatatttcttatgaaagctgatttatacacgcacacacacacacgcgcgcacacacacatattcatttaacaaagaaaaaacatacagctttagcaggttgggaagtggcatttattaatatcatcttcattttaaaaagtgagtacaaattatatcagtagttacttacatgctacaattggttaaagtcagctatacagatagcatgcactcagactaaaggatgagatagtaccataggtagagccaaatctgctactgctttcttgaaatctaagaagcagaaagcttcttacatttaatcattggtactctggaaggcttcccacctagtttgctggaccagggagctttcaaactaatcagcctatggttactgtgattctgtaacaaaattgagacacagcctaggtgatgtatcttactgacaatagtggtgaaatattgggaggattctttggcatatgtcaaggtataactgttaggcagtgggtcaagaaagagccaccctcactaacttctaggaatacagcacctgacaataacttctaccacagggctaggaatggccatatttgttctttaagacatgtgattcaaatatttctgctaattaaaccatggctgtcttagcccatttgggctgctataatgaaaatatcatagattttgtgccttataactgaaatgcatttctcatttgtgaaggctgagaggtccaagatcaaggtgctggctggtttggtgcctggtaaggagctgcttcctggttcagagatggctgtctccttgttatagtttcatgtggtagaaagggcaagggggttatctggcatcccttttataagagcactaatttcattcttgcccttatgacctaatctcctctcaaaggctctgtattaatctcttctcacgctgctataaagaactacctgagactgggtaacttatgaagaaaagacgtataaattgaccacagttctgcaggcttaacaagaagcatgactaggaggcctcaggaaatttacgatcatggcagaaggcaaagggaaagcaaggaccttcttcacatagtggcaggaaagagagagaatgaaaggggaagtgccacataccttcgaacaacctgatcttgtgagaatttattcactatcacaagaacagcaaggggggaggtttgctcccatgattcagtcaccacccaccaggcccctccctcaacatgtgggtattacaacttgagatgagatttgaggtggtcggtggggggacacagagaaaaaccatatcaggctctgcctccaaataccatcacattgggaattaggtttcaacatatgaatttgaggagaacataaacattcaatctacagcattggctatcagggttaaagtactgactacaggaacttttaaaccaaagacatatataacgaaaaaagaattataaagatgcattgtggaaagggtatattagacattgaaactcaattctttctactatcccagtgtttctcaagctctagggtacatcagaagctctgagaaggcttgttaaagcccagattgctggtcctcacccccagaatttctgagtctgtaggtttgtggcagggcctgagaatctgcatttctaatgggctccaaggtggtgatgctgctgctgcttataggggaccacattttagaaccactgtactgacccaccttctcacatacccctctgcctgctctgcttgtcctgactatgtacacctgtttcaggagctctgcccagtgcaaaactctctccaagaatagaaattaattttcaggaatctctatgtcataaggagatcttcggatacacccttgaatggtagaaaatgcctcttggccaaccgagacccctcattctaggagttttcaaaggtaatattatagaaataagtattcagctgacaaaagagtttgagaaaacatctctcttaaattcaccaaaaaaatgtcctatagaacacactccaggaaactttagtctaaaactaataatataactgtgtaaatgtttcaattcaccattttaaacttttatttgacgtagaattcttttctcaaatgaaatcctgcccagaacatcagcctataaagcagactcttggcagaatagacatcatttgtagaaaacctgaagcacctggagaatcctacgattccaaggagtacagtttgaaaccccatttaatgcataataaacacagacccttgtgaaggatgctattgctggaaagtgtccttgaagcctaatttataacccttctcctagaagggttataagtctagaccagtgcttctttcttcactcctttaaaaaatgaacacaggagaactatgtggaaatacaagggcaggttcattttcagagatctcatcactgagtgtatttccacactcagtatttttaaactgactgatagccactgctatgactatcttatcagcaatgcagagcttgcgtttccagcctccaagtgttatgctacaggtcactgttttttttaaactcttacctgagtatgcttcgacctacttctttattttaattctttctttcttttgaggttagaaacaccatgctttaattgctgtaacccccaaaagaaatataatattgagaaacatattacatttccctgtttgttactgattgttgtcttaactgcctctgtggttcccagcaggaacactcacggcaaaatactcttcatttggagatggtggtgcccagcagatgctgaataccatgttttcatgtggcatgtttgtttactaatttacaaaatttgttttaccccctgcagctgtaaatgaaaaagctataaaactaaatgaaactctaggaactcgagacgaggcctttgagagaaatttggaagggcttcagaaagagattgaccagatgattaaagaactgaggaggaaaaatctagagacacaaaaggaaattgctgaagatgagttggtgtgagtagatgagttattattttttcttttgacaaactgagatttccagataatttacagttttctaaatttttatcacacgtataagtaaaagatgctttgtttttccaacctggagatatttgctatgttatctatcatctatctatctatctatctatctatttatctatctaccatctattatttattcatttacttatttaattgtactttaccattgttccaaaatgaatcaaaagcatgttcttgcctacatataatcaagtaaatgatcttttctggtgctgctccttctgtaattaggctaatgagtttgttttgttaatcatctgcattagggacttttggactatcagttgatttttgttttaataaaaatacctttggataaacaaagttatgactttaccattcatatattggccaacctatacattttatcatcttaagaaatgctgaaaagaaaagtcatcaaataataaacacctaatactttcaaataagagttgcgaatatgagggttgggaaaagtgatagtgattttacccatgctaaagaacttttatgataacgcactcaataaaatagatacatctctacattcatagtcagctaacttcaaagtggtagtattactaatacttaaataatttatactaaaccagcaatatcagcacaccagagaacttgttaaaaatacagattgtcagaccccctcccagacctcctgaatcagaaactttggggatgggacccagcaaaccatgtattaacaagcccttcaggggattatgaggcatgttagtttgagaattactgtctttcaagtatttagagtttcttaatgactcgaaaattatcactttagaaaaactaggtaagttaaatccaaaaacttccagatcaatcagttggaagaaaaagaaacatagattaaaattatgctagtctactagcatgacaatgacctagaattctgttcacagtttctgagcaaacataacaatattcatcattacattcaaagtaatagagaaaaggtctcagtacaatgaaacaagtggattgtttgattttggtatgtgaagtgaatcttaaaactcatttcatcaatcagattcctagaatgacatgattcaaaatgttattttacttacaaatttaaaaggtttcttaaaaatctgtttcgcttttattttaattaattataaatggtctcaggtaccagttttcaacttgatttagcacacagtgaatctattttacatgttttcttattttctcattcttttcatgttagcatctctttgtaacatggtttaataccaataaaccctaaggcagtgacatgagctcattgtctattattgggctgggggtggttacagagctgcagaagcccttctgaaaaaagtgaagaagctgtttggagagtcccggggggaaaatgaagaaatggagaaggatctccgggaaaaactggctgactacaaaaacaaagttgatgatgcttgggaccttttgagagaagccacagataaaatcagagaagctaatcgcctatttgcagtaaatcagaaaaacatgactgcattggaggtgagtcttaggggcacttttatcttaatctcagaaggttggggactgcgggggcagtgttgaacatggctggactattcaagttgatgcacatttacaaaagtcaagagtgacaactctgaaagggggcttctaagaaacagaacaagaaatgacttttttttgtttttgttttgtttttaatgaccagttaccatcgcccaaagaatcaaataaaattttgataaattaaactgttgaagatatttaagaacactgtgatacagtggaagaagttctttacagggagtcaggcgaccttggtctcaatgacaactgtgccactatctagacatacaaattgggcaagtcaattaatctgtaagcatcagttccccaaatctacaataagtgcattatactatagcatacatatagggtatcttcaaatattcatatcatattattttgcagctttcccaaactaattcacaaatcttgttcagagatcttgctgccaaaaatcatagaagttccctacactttcaaattcaatctgagcacatgacaaatagctcaatgaattgagaccagagcttggaaaaattttggttcctctttttctatgcgctgtgttctatgcaaatgatcttttagaaggaactaacatgaatagatcaggtctgcgttattttctcctccttttccacacagataacagttacttctcaactcaagaaattatgggcagcctctatctttttaagagttctgatggaactagaactaaaacagattcctccattattttttcttcttttttttccaatttctttcttaatcttaacatagtaaattatcacttttcctaagagtaaactcagcacatataacagcagcaccctgtatgtgatattaatatttaaacaacaacaactttctccccagagacaaatttacctttgctgttttcaaagtatctgactccaacaggtcagaaaacagcagcagacctatacatcttctaacacataatttcaccgtcaacagtaactcagcaccctctggcatatagtatgtatgtagaaatgtttgttgaatgacagtaacaattgaatacaatcaaccaggattttttaaatctattcatttctattttcctttagattaagtagtaagaggaagaattacatttttttaatatattttatttccgtgtccctcttctgggacttagccttgtcattctggtagaatattgaagaggcttactttttttcttcactgatgcacctaaccaatttggagtctactgacatgctagcagtattccagaaatactgctgtgaggcaggatgctgggccactgtcctgtcacaggctccagcatgattcaccctgctcggtgacacaccagccgtgtgacttacccgaaggtgcacctgtctattttatggcaaccgtttgataaatgaaaattacctgtgtggaaagcatagtaagtatttgagaaatatttcaagaagagttatatggcacagtcaatagtacctttagctattcgtttcttttagtgatgtttaaaaccagaagtcatcattcttgggcacccctacaaatacctggagcttatgtatagtcggtattgaaattctgagtggtcctgtttggattttccttgtatgtgccacgtttaactaaagacttgtttaaaagttactggataaaatagataaactaactgaatcaatatgaataaggcatagattatttatggttgcttaaaccaaataaataatttggttgctgccaaaatggctgaaaatcacatggggtgtttgttaagccaacaggtttcatgggctcccacctagagagtctgtgtaggctgctctggggtttggccccatgtgtacattctaacactctccctgggctaatctgatgcctatacaggttcgaggaaaactgacacattgcatctatttgattgaataataagctgcattttaaataaataactcccttataactgtgtccacaatgaaggtaacacaattaatacccaactcaaaaactttttatttattttaaggtggcatgtaattttctttttaaaaattttatcaagcctctaattcattcaggaaacgtgctagacaccaaaattgattgtgtcagtgatgagcccccttagagcagcagcctcagcgtaacctagcaacttgtcaaaaagacaaattcttggaccccatccctaaatgaccaactcagaaactctgagaatggggcccagaaatccgtgttttaaaaattcctccagtgattaagatgcagcttcaaggttgagaaccacgggtataaacactaaaacaccatctctgattacttcaagtaacttgtatttagtgggaggtacacataagcaaaccactccatacgctaccataattatcacaggcgtaagcaaaggagggagtctaagtcacccctgagtttaggaagagctttgtagaggccctgacacttgtgctagatcctaaaggataagcactgggtcacagaagaataaagagaagaacatttcagaaactgggaaaaacatatacaaaggcatggaggaaagaaaatgacattttgggggaaagttcagtggtttgataggcttggaaagaagactgcatgtgaacgactgaagggatagaaagaaagagaagataggcagagtgcagaccttcagttataagagaatcgcattgtgagactaagctaaggaattggtttttatcctgagagccataggaagcaattgaaatattgcagtcatgggttaaaataaaatgttgcagaatttgagtggctcacttaaactgaataaatggttttttatcggaaaatagtgtgatattaggctagaaaagtaggctgggataatatttatctacatatctgtcaggtacctaccatatcaaggtactgttggtaaccagggtatttgaggttgaatagaaatgattcctggcctcaaagaatttacaacctcctgaaaaattcagacatgtcaacctttcactctacataatactatgataatattgactgggagattcagcaaaagtttcacaaaaataacagcatcatagcagaagtggagaggaattggaagaaagacagagcaacaggaaccccagccagagctttggaagtgtaaggtgatcttaggaagtgtccagtacagcagaaaaactttcaaaagctacgtaaaaatctgtagcagagaaggctctggaatttggagccagatcatagaaggctttggatgcagccaactagatggtgatggagttggaaaggcatttccagcagtggagagagggctaagggaactggggacgtcatgggaagaaaagagaagacaaatatttcagtgaagcaaaataatatgtattgagcagtctatccccaaatctaccattatatccttgccaaagaaggcagtgcggatcaagtaaagagtaagttgctacataaagaatacacaggccagcctgagcaacatggtgacaccctatctctatagaaaaatacaaaaattagtcgggcatggtggtgcatgcctgtggtcccagctacttggaggctgaggtgggaggattgcttgagcccagaagtttgagcctgcagtgagctgtgatcatgccacagcactccagcctggatgacagtgagacaatgagacagtgagacagtgtctcaaaaaaaaaaaaaaagaaaaagaaaataaaagaaaacaataatagacaggaagatagcttttgcaggttcctgaagaatctaccacaccaacacaccaaaaaaaaagaaagaaagaaaaagaaagtgtccaatttgcaaagctctggaataaataaagatctaattaattacaagttaaaagtagaaatataatcaaccttcatatccaaacaataattgagcaattatacttatgccatactttttgtagaataattctccctatacataggccttctttctgtttcttaaatactctaagtttcctatcttaggtattttatatgctacatcattttctatctgtgcctctctttgtttttattgtactcatctaatctttctttaagaatatattatacattaatttactcattcattttatctctcctccacacaagccatgaggaacatgtgttcttcctcacatcccccaatcctagaacagtatctagcaaaggcaaaacagattgttttccgtgaataaataaagtgccatagaacaaacccagatactctatacttttgtcaatatttgtgagctccaaatttccatcttttctcggttcaaagctagaacccatcagtatctaatctgaaaacaagacacctctaaaatttatttaacctcatcccagcactctgggaggctgaggcaggaggatcatgaggtcaggagatcgagaccatcctggctaacatggtgaaaccccatctctactgaaaatgaaaattaaaaaaaaatacaaaaataaaaaaaattagccaggcgtggtggcaggcacctgcagtccctactcgggaggctgaggcaggagaatggtgtgaacctgggaggcagagcttgcagtgagccaagattgctccactgcactccagcctgggcgacagagtgagactccgtctcagaaaaaaaaaaaaaaaaaaaaaaaaattatttaacctcttgatcatcatttctgattgagtatgctaagaagcacattttgatctttgcttttacaaaagattctaactcactactttattgaaatcaaaatatatatagctcttcaattaacacacgtgtggaaatatcttccctgtttccagtggcacagcattttaaattaccttgatccattaattcaaacaagccatgttgtaaaagattcttgtgtttctgtacatgctatactttaagtcagctcatacaaaagctaagggctaaaattggcagttgtgtaaaagaatgttagacccttggaagataagatatgacttgtaatcagggagattgtaatcagggacattgggactcttcccacatttgttgtctgtgaagagtgaatgacatatcaaaacttcccctgaattagtgatgggagtagctgaatgagccaagtgtcagcagcacaagtcccaggaatggacttcattttcttttttctttcttttcttttcttttttttttttttttttttgagacagagtttcgctcttgtcacccaggctggattgcaatggtgcaatcttggctcactttaacctccacctctcaggtcaagtgattctcctgcctcagcctcccaagtagctgagattacaggcatgcaccaccacacccagctaattttgtatttttagtagagacgaggtttcaccatgttggccaggctggtctcggactcctgacctcaggtgatccacctgccttggcctcccaaagtgctgggataacaggcatgagccaccgtgcctgacccatttttatttatttattaaaaaatatttattgaggaaactcatctacatactagagatagtgatatataaaactgtctttatggaatttgtgttacagtgcaggagacagtcactaagtcaataaataagcataagctacgaccataaagtctggatgcacgggctgataaacataagttgtttactgatatgtaataaatggtatgttgcatgatattgcataatagattcaatgtgttgtccttcattaacaatgtgtagttcaacaggctgtgcctttctgctagtccctgtacatgtatctgtgatgcattggtatttctgatttttattacctaatctttgtttttagcaactcccggcaaaagtaatcaagacgaatcaatctatataaaaaagaaaataatattgtctatgtttctaccactctgtagaatataattcagataaatgggttctaagaagaacaaaataaggtaattataatagttaaaattacagtgttactgggtgccaggcagtgttctaagctaattcttctccaattttacaatgtctatcaatcatgtggggttcttgttaaagtgcagattctgagtcagtagttcccaggaatggattgagattatgcatttctaatgagcttccaggtgacgctgatgctgctggtgaatgggctgcacattgagtagggagggactaaacattttgtatgaaggtaaattacttccttaaggtttcatagcttgggagtgagcagagctgtgatcccaaaccagaagggctgtcacttggatgtagcttttaatcactgtgccctagtacatagagaatgattgagacaaggataggtgctattttagataggtaatcagaggagtggctattaccagaatggagggaggacacaagccaaagagtaggaagagcacatagtgggaatatctgcaagtgcaaaggcttagaggcaggaactagttgtatgtacctggcaacatactgaattggtcggtgaagggaaggaaagaagggtatgaaattagcactagctcagtgcaaattttaaaactgtgatttctataatagaagagatagtattttcgtagtcaaggacccaggatctatcattaagtagacaggggtttaaatcttaatcacactgtactatgtgaccttaaaggaatcatttaatatcttagttcatctgagctgctatagcaagagaccaaaaactgagtggcttatatgcaatcaaaacttatttcttatggttctggaggctgggaaatccatgatcaaagtattggcagatttggtgtctgatgagggaccactttctggttcatagacaccgttttcactgtgtcctcacatggtaaaaggatgaacaagctccttcaggtcttttttataagggcagtaatcccgtttatgaagtctctgcttcatgacctggtcacctccaaaggccccacttcctaatcctatcaccttgaggattaggatttcaacatatgaattttcaggggacacagacattcaggccactgccctttacttattcaatttcccacttatgtaaaaagtgatcaacatgggatccaaagattggaataacaaaatgcttacaaactgtctggcacatattgagatctaaatgaattagcattattgtctatagaaaaaaactataagtggtcaaagcttaaaattataattgatgcagttaaatctgtaggtagaatggtgatttcaggaataggaatgaatcagaagtataaagaataaaataagtaaaaaatagaccccaaatggagaaatagcaatatttgtctctcactgattttactcttctaggccaggattgagtttcatgtacttttgagacaagctatatgttccaaagaaaaattataatctattctctcatgaaacagtccattaggttgattcttccatgtgatggtttctctatttcttaaaaagtattttccctaagtttccttaaaaatctcacttcaaatttcacagaactcccattgaatacatctgcttatgtttatgctcacaaagtactcatttgtatatagattctagaattcaatatgtagtaccaatataactattcagcacttatattttagttagaaatggatgctccatctttctttaaaagtagttttaattccttaactagtatcgcataacttttcttcgcttggatgactttctcacaatgagaagaagaaataacctgtacaagcctctacatagaagaactcttcaaggactggctaagtagtttatatttttctcatctagccacatttcaacatgatgtaccttttttgctaagcttttattcaaacagctcaggaaagtcaggaatacaaggggtaggattttatgaaaatgcaattttgatgtcttgttcataatggtctacagaaaaagaaggaggctgttgaaagcggcaaacgacaaattgagaacactttaaaagagggcaatgacatactcgatgaagccaaccgtcttgcagatgaaatcaactccatcatagacgtgagtattgggtaaaactcaaaagagagatgataatgaataaatgggagccgatgagaaagctcagtaatagaagcaaatactagtacttgttttcttgtggagataaaattatttttgcattattctactgtgaccatgcctatctattggtgacaactggaatatcactttgttctcccaatggacatgagtgtttgtgtaagtgtactcacacattcacacatatctgtttttgtccacagcgatgaaggacatttcttgttcctagagcagcacttacaatctgcttcaatatttatataacattagttaaaagacaaatgtaaatttacaaacaggcttttaacatgtaatgtctaatgcattacatagagtgatatgtggtcatagaaatgcaaatggcctaagagatcctaatgacatgtatacctatgaagtggcattgtttaaatagataggcttttcttggtctaagttggtttcttaaatttcctagtctattccattaaataatgactttaattctctattctttttgctatgttagtaagtttgaagtttcattttaaaactaaacatgtgggccaggcacggtggctcatgcctgtaatcccagcactttgggaggccgaggtgggcagactgcctgagctcgggagttcaaaaccagcctgggcaacatggcgaaaccccgtctctattaaatattcaaaaaattagctgggtgtggtggtgggcacctgtaatcccagctactcaggaggctgaggcaggagaattgcttgaaccagggaggcagaggttgcagtgagctgagatcgcaccactgcattccagcctgggtgacagagcaagactctgtctcaaaaaaaaaaaaaaaaaaactaaactaaacgtgtagttatgtctcatagagaaattagtaaaagagaggaggcttgaattcacttgcttaaaatgccctcttctctacatatcagtatgttgaagacatccaaactaaattgccacctatgtctgaggagcttaatgataaaatagatgacctctcccaagaaataaaggacaggaagcttgctgagaaggtgtcccaggctgagagccacgcagctcagttgaatgactcatctgctgtccttgatgggtatgtcatttgtttttggaaatgtttgtgtattttgatgcttgtccaaaggttttgactagcataaatagtagagaatcattttcaaatcctgatttctgttaattatgaacacactagctatatggcctttctgtggataggcttaattaggagggtctgggcaaagctttgctacagcagcatcaaaagtctgatttacaagtagactcaaatatggcttagtaggaagtgaacatagccctaggctacacttagaaaaaattattttctgttctttattaaaaagcacagtggttgccttattagcattttaaataacatatatgaaaatacattctgtttcaaatttcagtttcatgtttctaatggaatcaaaacaatttattgttaaaaggatggcttttgaaaatttggccccatacgtagtctttaagtcttttttatttttcctcttttaagctccagggagacattacattttctcctgtaaaatagcagcttattctagctgggattattacaaaggtcataggagggagagtaaagagggaagtatacatttgacttacaaacagccttctgtgtataactgatatgcttttcctacaattttgggattgtcgtaatttaatagcggtgctattagccccaagaataatttgcccagataaatctacatcacatgcaaagctttgttctcatacttaatacttactgttataaagaaaaaatgctaatgtttgaagaccttggacaatatatgaactatcattttattttatgtcaaacttttgccactttataatgaagggtgggtggcagatgaaacacaaagctaggtatcatcagatccaggctctaagtccttacttggggacatattggtcatttggcctgaaacaggccatttaaccttctgaaattcacttggtctcttctgggaagtgcacctaccccagaaagattttgtgaaattaattccagtaatgtagtacaagtgctctgaatctcacagcatgcttcacaaataaggtgaagaattgtctcatatcacacacctgctagagcacctggttgcagagacttttggaggatgctatgggtatttaagatatgttggtagtatttcatagctgaattattagaaatataagtttaggttatagaaaactataggacaatataataagtagatacttcactattatttggaattgtcatagatatattggccatgatcatttggaagccagatttcatataattaggacgttcttcatttgagtaccattgagtgccctgacattccttttttgaatcatcccaccagaatccttgatgaggctaaaaacatctccttcaatgccactgcagccttcaaagcttacagcaatattaaggactatattgatgaagctgagaaagttgccaaagaagccaaagatcttgcacatgaagctacaaaactggtaagaaacaaatggcacatgtgctgggaatggaagtcaacctttttgaatttttcaaatgtaagtcagtctggaaaatcccagtaaattggtatatttgttttgggttatttttgaagacctcttttaaaatttgcctaaaataaattctcggtatgctataattatagcagaactcttttctcagtcacccactaccactgttagggtcttaaaattatctcagaaaccaagcaagtttgtgctaccaactcacaaaataaaacaggcaaagacaacactctggatagggaattttatcaccattatctcaaatggcattagtaaaaaagaaaaaaaagtaaccattgtatataatcacacacaaattggttacatatgaagtttggctataaaattcactttttaataaaaacatactggatcatatgcttctaaacaatttataccatgtttatgaattaatgaatttttatgaatttttgaattaaaaagctcttaacctttggctacaatcattgttcgtaatacatttggaacaagtattttagagtttgggcattccaagttctatcacattatttgaatgccttcaatggtgacaaatctttatgctttagatgtaaagcaacattttgtacatgagttgtgtgatagtaagttggtagtactatttcaggttaaaaaaatctcataggaatcatcctgaataaaatgttcagaaccatcatttatttattttgtttcacatagaacctaccaaacacatgagaattttttgggggagaaatctgattggacatttgactgtgagtgaaatacacataagcagtggtgttaaagaaactgatcaatattttctttgcttcagtgttgggcaaaaatactttctaggatttaggggatattagagatatcccctaaatgaaccagtcttagcaggttcattttgtgatcataatgaaacatcatattctatgagcaatttgtactgtttttggtttctcttgagtgagccctactaatgccatatgttctgttgacttcttattcaaaatagtggcatgatcattgcagaagcatttctatgttcagttatcctttcagaatgaatctacttttcaaatctaaactaaattttaatccatcttctgttagataattttctattttaaagaccctaatttcaagttcaccattttcatttcacctgttttattgtatgattattttcagcacctaaaatggtgcctggcaaatagtaggcacttataaatgaatgagtgtattttttcattataattgacaccttttatgcctgttcataatcttttataccaataaaaatttgctgtagtaattgcttcatccttataaatttcttgtaacattttatgataaggaggtgtttaattttaccctaatttaatacctttaggaaaaatcattttttgccaacatgaagtgtgcacttacttcttaccacccatgcttatacatggtaggctaaccaacctcaaacagagagtgatggtgagttgtaatgcattacaccatgtctgctgttatcattattccttctctctttccacaatcatttaaaaataattaaatgtctgaaaaattacaaaataagtgctatagagaatcagtgatttattaaatgactattggataagaaaaagaagacaatctgtcccagaaattttgttggaatgtttttcatgaacagaatgaataaaattttagtttaatagatcagtataatatagttctactttgctggaaaagaaatatatttgaaaagcattacgttgagtaattatctagataggactaacatcccataaatataagatctgatataaaagctatagctcaacagagaagaatgagattaaatgtattattaagtatagaagagttcaaagcttaacaatacagaagagtcctctactcctttgagtctagccctataaagaaggaagaatgttttcaataacttaaaaggaaaaacaaagaaacaatttatacatttgcaggagaaaaggaaaaggtcaagtagtagagcaaccaacgaccactatgaagaaagtggaggtcagacaatttgagaagaaaaaaagcattgaaaataccataagaaaagaaacaaagaaatgatagaaataacctccaagcataattaagacaatgtttaaaatcaactttgattttttaaaaatttacttgtcttcctatatataaacacacatagacaatcaagaatcacactgaaaggaaaatatgagtgagaaggaagtggatcctttataagcaggagaaagctaatacgatttgtttgtactgcagtattattttgtaaagagtaatagctacttgtcttgcataactaatttctttaaatatcagaatgaaatgttattttaagaatttagacatcatgaaataacaaatgctatttttctattggtgtcgggtgaggaaagtactataaagcatttgttttcctacatataatcaccaagaaaatatctcatttagtacttctctagagggtgcaaggaaaacagaaaggagatatgtcactcataaaatggaataaaaatggaatatggacatcagtaattttttctcatcttagttgctttgatcctataagagactctaaaataacagagaattagatgtttttaaaacatttccaggtcatagtaaactcaaagcctacattatctatcagatcagatttttaaaattgatgaatgtattaatgttctctagaaggacagaactaataggatagatgtatacaagaaggggggtttactaaggaatattgacccacgccatcacaagatgaagtcccacaataggccatctgcaagctgaggagcagggaagccagcccgagtcccaaaacctcaaaagtagggaagctgacagtgcagccttcagtctgtggttaaaggcctgacagcccctggcaaacccctggtgtaagtccaggaatccaaaagctgaagaacttggagtgtgatgttcaagggcaggaagtatccagcatgggtgaaagatgaaggctggaagagtcagaagatctactctttccactttcttctgcctgcttttattctagccacactggcagcttattagatggtgcccacccacattgagggtgggtctgcctcttccagtccagtgactcaaattttaatctcctttggcaacaccctcacagagacacccaggaacaatactttgcatcgttcaatccaatcaagctgatactcaatattagtcatcacaagtccaccccttgtcaacttgaacccatacacatctcctgaaatcatacataatctccaaataaagacaataataacatcataattatacctaacataatacagctatcccttgtacaatcagaagcacactaatccttaacctaaatgctattacataaagttaacaacacttaaatgctgatatgaagtcaataaattttatgtcacatgataaaggaaaaagaaagcaaatgaagatattttcctagtacaagtgtatacatgcacaaacatattcttaacagaataaggaggaaatatatgacaattacagtcttcatttctgcaactggccacgtggttgtagctggtattgatgactaccttcttctactaaccattatgtattccctttgccttctgcaagcacctcagcgggtcatggctttttacctggtggggtgacccaaacctttattctggaaggacctgtgccatttgtagtcctgtctggattgggttggattgggttgttgtagtttcccattgaccttaaacacagaggatggtaatattaagagatgccctatgggatctcctgtattccatgcatgctcttccttgccttcattgtggaatagtagactgatttcaccttgatattctgggtcaattacccagccaacactgaaacccccttcttagcctgttgacttggaggtaggagggccccaattggccaggtggtaatcttaacttccagtttaatggaatcattgttgtatcccttggtgacagcattcttccctctggaactaagatgtctaggccagcagaacataatgttgtgggaacaggaagcaaaattttgctagtgggtcactagtggtgatggtgagtggtgccacttccgcttccaccccttgattctgggacacgtgaacactggctatgggagaaacagtaccatattttggacactgattcaaggcatacacagccttctggagaactttgccccagtccggcaaagtattgtcacctagttggcattgtaattatgacttcaaaagggcattccacaattctatcaatccacctgcttcaggatgatgggaaacatgataagaccagtgaattccatgagcatgagcccagtgctgcacttctttagctgtaaagtgagtgccttgttcagaggcaatgctgtgtggaataccatgacagcgaataaggcattctgggagttcacggatggtactcttggcagaaacattgggcgtaggatgggcaaatccatatccagaataagtgcctattccattgaggacaaacctctgcctttgcatgatggaagaggtctgatataatcaacctgccaccaagaagctggctgatcaccctgaggaaggatgccagacggagggctcagtgttggtttctgctgctggcaaattgggcactcagcggtggctatagtcaggtcagtccatgttgctgagcctatgcataacctccattcctgccaccatggccactttgttcatgagcccattgagcgatgacagggtggctggggaaagaggctgagtggtgtacacagaatgagtcatcctatccacttgattattaaaatcctcctcagctgaggtcacccgttggtgagcactcacataggatacaaatatcttcacagtttttgaccactcagagaggtccatccacatacctcttccccagattactttgccaccaattttttaatcatgcttcttccaagtccctgaccatccagccaaaccattggctacagcacattaattagtatataattacacatctggccatttcttcttccaagcaagtgcacaaccaggtgccctgctcaaaattctgccccctgggaagacttccctttgctactgtccttcagggatgtcctagaaaggggctgtagtgctgcagctgtccacttttgggtgctacctgcatatcttgcagaatcatctgtgaaccaggccctagtcttctctgcctctgtcaactgatcatggggaactccctgtgaggccatcagtgcaggcttggggagagaaggcagggtggcaggagtggaggccatgggcgtttgagccacttcctcatgcaactgacttgtgcctttaggactggctcgagcctgatcatgtatataccacttacagttgatgatggaaggctgctgtgtatgcccaactttatggctagatgggtcagaaagcatccagttcatgaaaggcagtttaggttgcatggtgacttgatgacctacagtcaaacattcagtttctaccaaagcccagtaacaggccaagagttgtctctcaaatggagagtagtgatctgcagaagatggcagggccttgctccaaaatcctagaggcttccacctctaggagtcacctatgggagcctgccaaaggcttcaaacaggatccctgtctgccattgacacctcaaggactattggatctgctaggtcatacggcccaatcggcagagcagtttgcacagcagtctggacttgttgcagagcccacttaaaattggcagcctttcaggtcactcaataaatgggcccattttaacacacccaggaacaatgctttgcatccttcaatacaatcaagttggcactcagtattaaccatcacagtgaatgaatagattttctatgacgttgactccttggaatgaccaccagaggcaataagcacactctcagtgacacgaggatatgaggccctcctctgcccatttacactggaaatgtcttagatgtcttagtgcttttcaatcaggtatatccaaacaacaaacaaacaaataaaataagactaatgcagaatgaattccatagttcagattcttcaagataatggaaaattatcacataatctccacctgttttgaaacattatcttctttccttcctttcctccctttctccctttctctaagtcagtggaatagtctagtttaactttgatgtagaaaatttaggcagtcctcaacctctctaggtatgctgaattaaaaaaaaaaaagaatgacatttttaattcccatggcaaatggagttctcctctttcttctgttcctcttcttcaccttgcaatgactgtcattttgtaaaactttctctctgtctctgtctctcttactcacacatacactcacaatgttccttaatatcttctaatcctgaatttcctttctcaatttgtttagttagatcttcactagaaataagtattagaaattgggaaaagtttatactggttgtattagggttctccaaataaacagaactattaggagatggatagatagatagatacattgattgatagatgacagatagatgaatggatggataggtggataataggctggtagatgatagatggatgatagacagattagatagatagatagatagatagatagatagatagatagataatagattagatgatagacagaaagaataagagatttattatgaagaattggcttacgtgattatggaggctgcaaagtcccagtatctgtgagctgcagatccatgatatagttcactttgagtccaaaggccagagaatcacgggagctgatggtacaaaccacagttcaagaactagagagaaaatgagatgagatgtcccagctcaatctgtaaggcagaaaagaagggaaggaattcctcctttctttgctttttgttctattcagccctcaagagattgggtgatgcacagcaatattgaggagggcaatctcttttactgtcatccagaaacaccctcacagacacacccggaaataatgtttaatttaggtgcccatggccagtcaagttgacacatacaatttacaatgacactggccttcaactccagtgcacaatgtggtcttcctctttattctccaaattcaagttctcttacttgctacagttgtccatatttcttgggaaccatcattctaaaaaatgttgaccaggcctttcttaggcatttctaggaaaaataatataaaatacagaataaagtgaggggagttcagatataatgcatttctcatagaaaaaatgatagtgggatggttagtaaagaactgtgctgtgtaagcaagatgtaagctttaaacaaagtgaagaaaaggggagaagcctagaaaaaataacattatacagaaagagaatattcttaaatatgtcaacttctcttatagcaaatttcccagtgttcattcctaatacaaggagagtaaaaactccatagaaacctcaaaaagagctttttcttgcaatggggttaggtgtctaaggaataaacaggacttttgaaactttactcttatgtgacagatcagtgaggaggaaacacgctgataagaagcactgaactactacaaatacgcttcatttgctataaatacacttcattcactgaactataataaaattcacttcaaaaggaatgtgaacaaaatgaaagaacttggatataaaggggcaaaagtgaacaaaaagatagaaaatgtgtacaaatctaagtaagcattatggaaagcataatgataataattattaaatatgtggaattaaaaacaaagtggaactaaaacacaagagactaataaaatggaaaatggggcaggtagtcagttatttaataaaagtttttaatattcttgaattctggggaggaaagcaaaaagctaattaactttagttttcactaagaatatgtattaaacattgaaaaaaaatctggaaaaataaaattgacaatattcgagttctccagagaaacagaacaaattggaagtgtatatatacacagatatattatatattttaaagaattgactcatgagattgtggggtctggctgcagggaataggtgaatattgccgtcttgaatccaaaggcagtttggaggcagaatttcttcttcttcaggggacctcagtaattcttcttaaggcctctgactgttggatgaggttccccaacatcatggagggtgacctgctttactcaaagtctactgactgaaacgttaatcacatctaaaaaatacattcacagcaacatctagactgctgttttaccaaaaaccaagtaccatagcctagccaagtggatataaattaacgatcacaaacagctaaacattccaaacaagcagacagagagagaaaaaaataaagaaatgtgaaggggaggagaattttcaatcaattctggaaaagacaaaaaaagagaaaaagagaaacaaatcataaatataaaatataatggaattaaatccatatacaacaatcagggtaattatcaccagctgcctcaagaaataacccctgaaatctcacatgatggacataattcaagtttatgtctcacatcacaacacaatgtgagttataccaccttttgcatcttgtagtgacaccatacagtgtagcctccaaggcagggaagagaaaaaatgaagagacatgtaggcccctaccatactggctcatgaagcctggaccacgtctggtctgagtcattgaccagaagtagccgtgtgccccaagctaactgtaagggaggtctggaaaagtaggaggcacataggatatttgatgagcactaactatctctgcttcaggttgtcttcataataaatgcaaacattaaaattgacaggttactatgattttcatattggattaaaatgtctaaaacaaagggattcgtctatgtatgacttacacaaatactgcaaatcttaggggaacagaaagactgaaaatgagagataagatacactatgcaaactctaaccagaagaaagctggtatgctaccattaatagcaatcaaaaagactttaatttttttaaaagaattattaaggacaaagaaagtgatcatgatagaataaaaggaacaaggaaaactaaaaaattatgagcctgcaaggtcataataacaaagcctatggataaataaagataaatatatcagaatgagaacattttcatatatataatagggaatgattttaccatatctctcttaaaaagtgatagatcaagcaaagagacacagattttaaaagtaccttacacaagataacttaatggccttatagaactctatgtcaactagataattaattctacatgccccattcgatgaagtaactcatgaaacaaacaaaggaccacaacctagatcataaagcaagtatcagcaaatcctaatgatccaatagcatctagactacatcctcttatcataatgcaatacaattagaaattggtacaaaacaattgacaaaaagttttaaaataaaaaacatacttcaaagtaatccatggcttgagaaaaaaacacagtttaaatttacgaagtatttaataacagaatggaaataaaatttcacctcaaaatttgtgtgtgcaaataaagtggtaccaacaggaaaatgtacagtttggaatgcagatattaggcaagggtaagaactgatactaattatctaaggtttctgctcaagatgtttaaaaaagtacacagaaagaaataaaaataaaagcagaaattaatgacctaaggaaaggcattagacagggttgacaaaacagcaagttgattcttagaataaactagcaaataaacagaagacaagaacaattaagcaaagagagacaacacaaatgaataggatcaagaatgaaaaggggatcataactgtagatacattatagattgaaaaataaaaatggatatattggaggatatgcgcaattttattcaaacacatttgaatacttaggtgaagtaaacagtaagtttagagcaaaatttactcaaaaagaaatagtacacctgagaactataaccgttaaataaattgcatcagtagttaatacaacaaaataacaatatgtacaaaaatgtaaaggacccattatgcaatttgttcccaagaatggaaaaagaagaaaaatttcctcagcttattttatgaggctgatacaatcttgatggcaagccctacagaggacagtactacaaagaaaaactataggccagttatttaaatagagaagctacaaatgaaatattataaaacccagttcaaatgtacatattttaaagatctgtaaatatacagtaaaacattaacatttgccagatacagatgatgggaatagaggtgtctgtattaatttctaatcgtatctatcttatttcctacttaaatagtttaattaaaatgaacctcagaggagatagaaaatctgtcctgcaataaaatctgttctaaaataataaagaaaataggtctaaaatgggtctggaaatgaaacaacaaccctcatcctttacaccagcaagaagttctaaatttctttctttttctaaattcatgatgcatacatgttttaatttcttttaaatgatcagaggctgataattgcaagcaacaatcccctaacctaacttttctctcaactaagctcacagctccaggatcaacaattccaaatctttcaaatattcttcttttactacatctcttagtaatattattgtgccatcacgtatttcattaagtggggcattatctatttaattactgctatgatgaaggagatgtagttcacttacagaatatcacatcacattttcccacccttcagtttcccaatataggtacattactgtgcttagattcttcatttttaacctaatatactgagagcattatttcctgtataaatgatagactctgcactctttaagatgaagctatttatgtcctcattcttccctttagcttccttttttcctcgtcctctcagcttctacctctttaactttgatattgtgatggtcaataacatttacattttatctataaccataattgtgccatggcagaatacagaagtcccttctctgaagacattttattccttaaaggactccctttgattttttttcagtgggccatttgatgcttgattgccagttgctctgtgcagaagagaaggggtattttattccataaaataacttgcagtgaattattcctttttattttcacaactgactctcattctctaccttacctgttctttctgaggcctggccttctccaaattttttctatctccttgctggcatataccctatagtgcaagttgtgggtacaataactgcaaaagattgaggagcaggaactatctaaataaccatggtggctgggtgcagtgactcatgccggtaatcccagcactttgggaggctgaggtgggaagattgcttgagcccaggagtttgagaccagcctggacaacatggcgaaaccccatctctactaaaaatacaaaaattagccaggcatggtgacacatgcctgtaatccaggctactcaggaggctgaggtgggaggatcccctgagcctgggaagtcaaggctgcagtgagccaagatcatgccactgcactccagcctgcgtgacagagcaagaccttatctcacaaaaaagaaaataaaaggcccatggtggtgtggctaggaaagagtgccaaccctgtccaaagggaagctttctttgctgaaattatacactttctttctttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccgcccaaagtgctgggattacaggcgtgagccaccgcgcccggccgaaattatacactttctttgatcaacttctttttactccgtcatagttttattccccaccaatctcccccggacagtcactccattttacttagtctcttggtactattctcagaattcaaattttaaattaattaatctgtatttctgaagagctgtttgttttcttactgtatattttgctttctccatgggaaagatatgcttgggagcctcatgcagtcttggtgggagttatgtaaccactgggccagatatgtcagggcacacagcatggtgagccattccctggccagttccatcgcccagagccagaccctttgggccctacacagactgcacagccccagcatgtgggggcttgtataagggaagttctgatgtcacaggatccttggggtgtttcttcaccagctggaaacctctgtggccagtggcacctttgcctgagttttgctgaggtccactgggcacattccgcccactcagcctggcaggctacacttggctcacactaccactactgggctggatcccacacctgccaagggtgattcagggcagagtggcgaggggtgtgtgagtgagcgtgggctccagccactgtgcacagctaagcgtgccagctgcagtgggctgggcagctccaggtcctggctctatgtgaggctgtggctgaaccagacatactacaattggcttccaccactggtaccagggaatgcggtggcacccaggagcttggagatgccaggaaccacagagtctgaaagagggtctcacagccctggctcagggagtccataggtctcagctccccaaaaggccacagcccttctctcctgctcattgctgtcaacatggtgagctggggaagggggtgtgtttcaaccctgtttgtgttgtagctctctcatttccaccatttgcgggggggtcccaagttcttgtcccacatcctggaagaatgaggtttgcagacaactggagggttagcaaggtgaagaggtgctttattgagtgacagtgcaactctcaggaggcctgaaatgggtagctccgttccacaggcaggtaattccagcatctgtgcagcaccctcaacagaggtgagacacacagtgggtagctcctatccacaggtagatcatcctgttgtctgcccacgtctggctgagtccggggttttttatgggcctcagaggggaggaagtgtatgctgattggtccatgggtggccatgagctggcccaaaaaaagcaccataagttctcactccagtttgtggaaccgacagtccagcccccttccttcaggcagtccctggcttgaaggtggagcttcactgagggcccacccctttccacccaggaacctgtatgcctcctgccaccaccaacctgccatccacggcgcccactggcacccaggctgttcatgcctagggtcaccttcaggcccatgcagagccaccctcaactcccccttggcctccctaatgtgctccttggcacccaaaatccagaaggggccaagatagtagggggctagagtgtcagtgctgccccgagcatatgcacacctggctgggttgcaacagcctcagctttgctctgaaatcagcctgggtgccgggaacagtgagagaccaggaagaaggagcgggcacttctgagcctgtaggggaagagaggtggctgagggcacagggatgcctgggtccacagctggctgggtggctgcagctgcacccagtagggcagggttcccccaccttcaactcggaaggggacatggctcccacttgttcctggctcccaccagctctgtggagcacaaagccagacaggctgacactgccattactgagaccctcttgctctcagaagagttttcatcgcctgctccctctgttttcactgcttggtgactgtggtgttttgttttgttcctatttccttttctcagaaaagaaagtctttagaattaaaatttaagctgacaatagatcccctctccccagggagcagaaatatggatatccctaaaggtcttgagtgtttcggtctttcactattttatactcaatattccatgatttttatctagatatgcctggtggacaacaggtgatcgccaaatataggttgtccctcccatctccaaattctgatgctagaaatcaggaatggctatgatagtccagattttcagaattgataagatatttatattaccctaagagatacggaagttgaacagaataaaaaaattcaaaataaaagtaaataaaattactttctttccctgtttagtttgagatcatgtgtaaatatcagtgaacgtgatgtcatataggatttttttttattgatcagaattaggttcaagttgtgttctggaaacttctaattaaattgagggaagatgctagcaggccagaatttgggaattagatgatctggctccaaattcaatacatattgtctatgtaattagctgtgtcacctaatgtaccaataatgccttttcaagaaacactgtgcagtctgttctgattcctccattggcttaattcctataataaatatagtttccaaagtttataacttaattttcagaatttatttattttaattgacagataaaagtggtatatatttatcatgtacaacatgatgctttgaaataagtatacattgtggaatggctaaatcgaggtatttaaaaatatgcactacctcacatactggtcatttttctgtgttgagaacacttaaaatctactctcttagcaaagccatgctggctttagtgatttttttttttgtacatgatactctcatttgggtcaataatttttttaaaagtctattggaagcagagaaataaattttttgacccagccttagatgtatttaaaagttcagggcataaaatgatagatgtctcagggtttgtgtcatcagtcggaaacacagaactcttttgaacaatgccacaatgcaatctaagtttgatctaattttcttcaagacaataatgctcttggtgccatcctacctgctctttatgatttctacccgtaggtagaataatcaagaggtgagattgatgttgtttttgattctggacattaactagagggaaaattcgaagccctctaagaatggtatctaacttaatagacacctctccattacctttactcaaaactaagactctttgtggtatgggcccaccccacctctagtagccagctgctagtccagtgtctgtctcactgaagcagtctagtggtacacataggtactgagcaattatgtctgtcatgctgtaattgaggaaaaccatccttacttcattttatatttttgaatgctcccttgattgtccttcttggtgttcccataaagctaaaaattcacactcacgaattttaaattatcatgagcaatttgggggatttcctattttatcactgagtctcctttgagtgctcagctgctttcaatcttgacagatactcatctgacccatctaccacccttagggtatgctatgcgatgccagggacctacagccttttaagagatttttgaccaaagccgtctctttggggtgtttcttgactcattttttactcattatttaattttaataacctatagtacttaaaaatgtacagtactatataaagcaccttaaaaattgatgcatggtgattttcttattttaaaattgtgtatgattttttaaattattataaaagcagcttatgtctattatagaaaataggaaatacagaaaagcaagaagaagaaaatataaaatgtgcatacgagtaattacttttgtaatatcattgtatatctactcatatcttttcctatgcaaatagtttttctacaaatgggtgatatttatataactgtttcataacttactatgggaatgaacatcacatacgtattttaaaaaatattctcaaaaatatatttttaaaatgtatattgaactagattctgagaatttacatcattattatagtaagaacattatccttgattttgattcatagtctaacataccaaactctaaatttcttctgttactcactttacataaacacattgcagccagtcaccaacccttacatatatccctgcacagtttgagcagttttctttattgaaaatatttttaatttaaaatcattttaagttttatattatcttggcacattaacccctgtggaaatgtgtaagacttctcttctaaaataaattatttcataaagagagagagtaatagaataagtcataaaccatgctgatgaatttttagttactactgtctttaaaaagtaaacaaaaaaacagaaaataaatattttacatcttttacagccaactctttcaatgagttcaaaaatttcatctctaataaaaaagtaatttggggaacatttaggaaaaaagcaaaatatataaagcaatgtaaacaataacttttaaacttgcttgtttagaaaatcactggggtacaggttagtcagcctgataaactctaacttgccttcacacctccctcctccagcagagcctcctctgacagccaaacatctaggcatttctgtgttccattatggtaatgattgtctttttttataagtgactatatttgtttgtctttcctcttccctccactccagttccattagggaaggcatagtctttccattttgaatatttggtgcttgagataaataaaaagttttgttgggtaaataaatcaattcacttatctattaatcaatggcagtatgctttagcaagagtaattatgaatatctaataagtagtaggaagaggaaaactaacatgtattaaaatgcaattacatgccaagtcatctgttgaatcctaacagactttataatttcattttttcctgctataatgacgttttaaattatctcacattttcttaaacaattattaactaataaaaacatacagcaacttacataaaaatagactctgttttgcatgatatagttgaaatttttatataacttgtatatccatatgtatgaatatatatatatgtacacagactcagaaagagaataccaagaatttattgtttaaaaaaaaaaacctctaaaaagcaagaaacaaaatatcttgcaactcaaagaatctcatttatatttcacatatgctgtagacacagctcaggaactcagatgtgatgcttatgaatatgtataaagtataattagcttagaaaatgctgcttcatcacctgtcctgatattgttgatgtgcttcaataacttaccaagcaatgctggaaaaggttctctccaaattccagtgagttgaaacggtgcttttcacccataacatgttagtgttttccattcccttatcatgtgaaaagcctgtcctttaaacccagattgctggcagactgcttgtaactgacagttgtatgccataagctctttactttaatattttagagagcttcttgaaacattgaggcatgtcttttcctccaaatctcttgatttttaacctctcaattccacggtgcttgcatgaggtgactattctcttttctctggcctatactattacaataaccaattgatggctccttttttcccacacagctgcccaattcatcttcttggactacagctctgatcacactctcctactcagaaactttcaaggcctccaaattgctcattgcccagtttccttactcgcacattcaaaccttccagaaattgactctgacctgtctaatagccttacttctccacattgcccttgacgaaccctacaaacttagggagctgaaatactcgctctcacatccacacatcaaaagtccctgcctgcctccctgcctttccttatactatttctactatatcttctacattcctgtatatactacctgtctcctttcatctgagcaaggaatggttgactaaggatccaggaagaaatcactgacttcctaaaaagcagggaaaaaaaaattgcctggaagcaaagagcaggtgatattcagaaatgcaagaagatagaaaattagcaacacggaggtctgtatcagtacatagccttcagtcagggctgtcatgtttctggatgaaggtgcaagagccagtggaaaatcaatacattgataatcatccagccagactaatcagaaaaaaatcagaaaagtcaccaactaccaatatcaggaatacaagaggtgaaatcactacaacttctgcagatagtaaaggatgttaagaggatattatgaacaattttatggcaataattcaacaatttggataaaaagggcaaattctttgaaaatcacaaactaccaaaactcacagataaataatctgaatagttctatattcattagagaatttaatttgtagttcaaaaccttcacacacacaaattcagttccagatgactttacttgtgaattccaccaaatatttaatgaagaaataataaactctttcagaaaattgaagaggagaaaatacatccaacctcattctacgaggccagtattactctgataccaatggcagacaaagatagtttttaaaaaagaaaattatattatataacaatatccctccatgaacatagatgtaaaagttcatggcaaagttataacaaatcaaatctaatgatttactcaaaggattatacatgatcactaaatgatattaatgccaggatgtaagattggtttaatatttgaaattagtcagtgtaatttaccatatagcaaactaaaaagcaaactatataatcacctcaattgatacagcaaaggcatttgacaaaatgcgtctatttttttttaaaaactgcctactaagagtaggggaacttcactacctgatcactataaaaacctattttttaaaaaaacctaacagctaaaatcatacttagcacaagactaagattaggaagaaggcaaggatatctgcttccattacttccatttaacattgtactagagagactaaccagtacaaggggcaagaaaaaggaaataaatggcatccagattgaaaaataagtacaaatgtttttattcacagatactatagaagtctaagcataaaatcctggtggttcatgcctgtaaccctagtgctttaggaggctgaggcaggtggattgcttgaggccaagagtttgagactagctgggcaacatagcaagacctcatctctacaaccaaaaaaaaagtttaaaaagcataaaataaaatgctatctattaaaaaaaagttactagaactaataagtgagcttaccaatgttataaggtacaacatctatatgtgaaaatcagtcatttcaaagactggcaaggatacgttggaagttgaaattaaaaggttacagtttacaatagcattaaaaatgtaaaagaccccctacactgaatactctggagataaataaaagaaaatctaaataaatcaagagatataccatgttcatagatcagaagattcaatattcctataatcctagtttatacatattgacctacacattcaatgcaatcccagtaaaaatcctagcaaggttttttcctaaaaatttacagatatgttttacaattcatatggaattggaaaggagaaaaatgttggaaaggttatactacctgacttcaatacttactaccaagctatggtaatcagagaatgtggtgttggtatcaatattgacaaatagattattagaatagattaaagagtccagatatagatccagacatgtatggtcaaatgatttatgacaaaaatacaaaagcaatacaaggtatatttaacaaattctactagaggaattgaatatccatgaacaacaacaaaaaaaatgaacttcagtctgtatcttgcaccatattccaaaattaactcaaaagagatgctagacctaactgtaaaacataaaaatataaaacatctaaaaatatataagaaaaatctttgtgatcttgggtaaagcaaagattcttagatacaccaccaaaagcatatcctcaaaaggaaaacaaaattaacaacttaaatttcatcaaaattgagaacttcttcccttcaaaaaaaaaaaagcacttttaagaaaatgaaaagataactacaaactagtagaatatatttccaaattacatatctgataaaggacccatatccagattattcatatgtatcattcaaaactcaaaaataagagcaaataacccaagaaaatttgaacaaaagatttaaacaggtcaccaaagaaggtggaaaataagcatgtgaaaagatgctcaatgttattagtcataaggaaaacacaaagcaaaaccaaaatgatgaccagttagaatgtctaaaattttaaaagacaggttataccaagtatcaacaaagatgtaggcacatgcagctctcatacactggtgatgggaatataaatagttcagatactttagaaaacaggttgataatttcttaaaaacgtaaacataaattaccatatgatccagccattctgcttctgtgtatttactccaagataaatgatggcatatgttcacccaaaaatttgtacacagatgtgtacatatccctatgatgaaataattaccaataaaaaggatcaaatatggatacacacacaacatagataaatgttgaaactatgttgagtgaaagaagccagacaaaaagagagtacatgcagaatgtttccatttgtataaaattctatgaaatgcaaacctacagtgatggaaagcagatcagtatttgtctggggacagagggaagagaaggaaggatagaagaaagagattcaaaagaaatgatggatatattctctaccatggttgtggtaatggtctcatgggtgtacatattcaaaacttatccaattgtaaattggtttgcatggtttatttatgccagttttaactcaataaaagtattaaacagtattagtcatctctggtcatagtccctccacaatttccacaacttagattttagcctctttcactgttgtttgggccatcttcctcttttctctcttaccaattccatttattttcttttttaaattctttttacttttttttaatttttgaaacttgtattttaggttcaaaggtacatgtgcaggttttttatataggtaaactcttgtcatggaggtttgttgtatagatttcatcacgcaggaactaagtctactacccaatagttatttttctctgtttctctccctcctcccactagctaccctcaagtaggcctcggtgtatgttgttctcccctttgtgtccatatgttctcatcatttagctcccacttataaatgagaacatgctgtatttgattttctgttcctgcattagtttgctaagaataatggcctccaactccatccatgttcctgcaaaggacatgattgcattcgttttatgactgcatagtattccatggtgtatatgtaccacattttatttatccagtctgccgctgatgctattccttattttcttatgctcagcaaatcaaccttttctctccactttaatcctgtgcctcactttgcacacctgaagttagctttaaaattatgacttttaaatgcttgtcagattacattcttacaaaaaggtattcacactccaaggcactggggaaagctgttttctttttttgtctagtttcatctagtactataaatggcctatattatcttgacaattcaggattgtattatcatccttggttattttaccacaataaggttggcatctactgagacctactttacctctatacattttatccctttccaaattgactcagactcctgagcttcaaaaattcctctctccactttttagagttttctcttctctttgctcattgtcggacagattgtcagctgtcacttctgctgttttcatgtgtttgtttagagaatcttcacacattctttcattgtaatttcctgtctctaaattgttttgattcagaaaacctataaccaagggagtaaaaatgacgtgtaaatttggaacaaatatagaatctgagtgggtaacctgaggcttacttcgtgagttaaagtacattgcatctgtgtcattaattttgacactcttttttttttttccaagatgaatgacacttatgtgatgttactgtatctaattcccaagagaactgtagcaatgagaattcctgtttttcccagcagaaaacatcatcagttttctggagaataatttgccaaggttgtcttttgcaagaactatgttcagtgttcttttttatttatgtagatgtttccaatatatctttttgtagatatgatagcattgtacaatcaatctgttctatgagcaatcaattatttacctgaaagctgttagaataatacattaaaataaatttgaccacagccataccaagttctgtaatcttttctagtttaatgttcaaataatgtgactgataaaaataatgtaactaaggcagtccagatgcctttaacgagtgttatgtctgtgataatctgagttcagatttatatcttcaacagtaagtatttagcactctccaacccttcttgcacttgcaatacttttccaatttaaaatttacacataagatcctgtttgatttatctcttggtatatatgaattatgtaatgattgctgaggagcaaacactattaaaatgggtaactagacattcaagttaaacattccttttcccatatcattctattaactttgtgtcaccttttttaatctgagtctaaacaaatatatctttgcttggagataattgtggctcagagattgtcatttagaagattgtgttttgccataccgctttaagatgcattttttaaaagaagcagtgttctttctcatttcagcacttgggagatacaggaaatgctcccctctcagtccacaactagagtgaaatttgcttaaggataaagtcaggggatgtgtttagttcttaatttgcttgacttctgtagcacgtcataatgctgctcagttatgtccttacaacaccgccagttatcatgcatcgagtcacttctgcatctcttaatttccatagtgttatgctctcctaatttctccttttcctctgtggaatgccagtcaccttgccagctccactttctctgcctactccctaaacattgaagttcctaagaactctgttctagatcttcttctcataccgtaataaacagtctcctaactttaactaccgaatatgtgctaataatttacaattctatatctgcagcccagagctctttcctaaaggcaaactctgtgtaccaactgccttctggatccctccactccattattctatggttttagatgtatgacatttgtttttctgtccacaggcaacaggtcctcggggtttattaaaggaagatgccaaaggctgtcttcagaaaagcttcaggattcttaacgaagccaagaagttagcaaatgatgtaaaaggtcagtgtggccatagtttttattatattccagttaatcgggttgttactgataagatattctatcacactattggagaatgtaatttctttagcatgatttttgtgatgattctataatctatttaatgcaagtaaactttctcactagttttacaaaatgttgtctacctatctcacttcaagtagggtaatatctcataatttgtaagtcttatttctatagcatcacttcacctatatctaatgtatagtaacttttagtgtaataagtttttaagagtatcaaacccaggccagccatagtggctcacacctgtgattctagtgcttagggaggccgaggcaggaggatcccttggtgccaagaatttgagaccagccggggaaacatagcaagatcctgtctctacaaaacattttttaaaaatttagtcaggtgtagcagcgtgagcacataggcatagctacttggaaggctgagccaggaggatcgctttagcccaggggcgtgaagttaccgtgagttgtgatcacactactgtacaccagcctgggtaacagagtaagatcctgtctctaaaaagaaaaacaaaattaaatacatttttctttttctgagatgaagtctcgctctgtcaaccaggctggagtgcagtggtgcgatcttggctcactgcagcctctgtctcccaggttcaagtgattgtcctgcctcatatctgggattacaggtgcatgccaccacacctggctaatctttgcattttgagtagagacagggtttcaccatgttgaccaggctggtcttgaactcctgacctcaagtgatcctcccgcctcggcctcccaaagtgctgagattacagatgtgagccaccgtgcccggccctaaatacatttttcttgtattttatttctgattcaggaatcaaaatgcacaaaatatctactgccatattatgggttttatgttaagaatatatcattaaacatggctgctctctatatgagccattacaattattattttatgcacttatctcttgtctcccatttgaattgccacctgtttctctcttcagtttcattccctaccattttctgtctcatatctgtctccctacccttacctaagtattcataattcctcccaaacatgctactattccaagccttcatgttttcagtattatttcttccccttggaatgccccatccttcacctctcttctttgcctaactgctttcttccagaccttcaggatttagttcaaatgccatcatttccaggaaacctaacacctcatctgatttacatgccccctctctggtatagttttctcataggcttgtcaaaccaccacaatcatggactaattaatattccatcttcttttacaatttttaaaacttttttattgatgcataacagatgtataaatttttggcattccatcttcttgaggaaagacatggggttttgctaactgtgtatttctagtatgcataatagtgactagctcaaatgaggaaatacttattttttacaataaatggtgttggcttatcttacttatcttagaaagagaagaggttttaaaatcatttatatttggcatgttttggtctcagtagaagctgatatgaaattacaagttctatctcgattataagtaaaattttaatagtacaattcttcaggctgtgtattacaggtgaaataaaactccctacacacataattctgctcagcaggtacctcttattacaatctgaagaatgactgtaagaagccaaaacctgtgttcctattggacaaatggactcaatcccgtgactttgcggtcactccttcctatctcatacccttgcccagggctgggaatagggaggaagggagcgaggtgattcatgcaagtgcaagaaccaatcctgtctttaagattttaataataccagggccgtgccctcgcctctatttccccacaaacactggtattataaaaatgaagaaagaattttattttcagccattttttttccaagagaaaaagaaatctaaagacaagcattgtaggaagggttaggagacagaaatgttcattagtttaaatttattttttttgtagttcaggtagtacattatttaaagtaatgaaaacccacaaactactcaagtaataattcctctagaaaaccaagccaaggctatgacggagatgggaatgttttcttgctacattatgacatttctctgatttgtggccaattacggaggttataaaatggctgttaatcagggaaatgccatatattactaccaggaactgctgaaataggccctacagagcaaaactcttgacagcagctattaaaatagagatttagtcatttctctctctatggtgcctggagttagaaggaataaaaatggtgaggccagtataccctccatatttctaatttgttgcttggttcaattcagtacagttcagttagtttgtgagcttcagtcatgaatgacttagtactgctccctgccatttttatgctgtccttgccttgagggaatctgaacttgccgggagcaatttgttttgctttttaatttttgaatatacatctgttaaaagtaaatttgcccttgtgtgagtttgagatttgaagcctgtctacattgcactgatcgaatgtttgtggagataaaaagtattttgttgatggatatgaggcttggtacaaattgatgactgaaagagtgaaaagatgaattagtaccaccaggtgaatgaacactgctttgcagatagacaagaaattttttaaggccgggcgcagtggctcatgccctgtaattccagcattttgggaggccgaggcaggcagagaagtgggagaataacttgagcccaggaggcagaggttgcagtgagccaagatcgctccattgcactctagcctgggtgacagagtgagagcctgtctcaaataataattaattaattaataataaaaatttaaaataatttttttcagtaaaatgccaacttcattttctcatggaatgtgtacgaggcaaggaagaagtagaccttggtttattaaaagtttgagaatattaagattttaaaattatacatcttaccttatattgactaacttttcagttttatttccttcttaatttatccccaatttttgtctttgcccaagataaatgaaattatttaattacttagaaaaataataggtaacatgttggccaggtgcggtggctcgcacctgtaatcctaacacttcgggagaccgaggtgggcagatcacctgaggtaaggagtttgagaccagcatggccagcgtggtgaaaccctgtctctactaaaaacgcaaaaattagctgggcatggtggtgggtgcctgtaatcccagctactcaggaggctgaggtaggagaattgctggaacccaggatacggaggttacagtgagctgagattgcgccactgcacttcagcctgggcaacagagtgagactctatctaaaaaaaaaaaaaaaaaactaggtaacatacctataaaatagataacacaggaaataaaaagacctattccctggagatctatgacagctcattttaaaggaggcggtttgtctcatagcactgtagcctgtggtatataattacagttaacccttgaccaatgcaggggttggagagcatggacccctgcacagttgaaaatccatgtataacattagactcttcataaacttcataactaaacttcataacataaactttataaactaaaaaaagaatctattcccaagcccaaataatgaatcagtgcattgcttgacatatggtgctgtcccacacagagaacagtatgaaacattattccaatcattaagttttatcaaaccagttgaagccttccttctatacagtggtcctccaaacactcagtcattccgttcagacaagtgggtcttgaagattctgagatcatggatgtaatacacttgcaaacgctaacctgttgagattctgtgttattattttatattttaaaaataagagaataaactggaatactgcagtgctgctaaaccaaagtatgatataggagtgcaattgtgactaagggatccttttattattaaagatatactccttttgaatttgcatattaccctttgcctgaatcagcctttccatagcaggcatgcaaaagacaagcaaaatctgctctattgaccacaattttagactaaaaggatgaaattaagcctgggtcccctggcctactgtggtctggagaacaaagcagtcttttccaggtgaaattgctgatccctcatacaaagttttgattcctcctttagagtgtgaatggtggaaataaaaaaataaaaccagggtggacttccattagagaaaaaacaataagtggcaaaatagtggcaaatatagaggggcaggttctattggaaagattatccctaagagcgagacgtagcttgtcatatccaaccccaccatgtgagtagaggacaagaaacaaacattcagaacactcctgtatatcatctcagcaagagacaaaggcctgtgcaataaaaatggggcttagagctaaaaacttatctgggctttgttgtgtgttcagaatcagagtctgagattctatggcgttttttgcaagtaagttaatttagaccagaaataaacagaaatgccttcaagagacttacagataacataaagggatggtggggcctgtgttaaaccaaagactatttgtcttatttaaaggtattcaaactcaattttcttgctgggcaaaagaaaacaagcctgcaagcccacagtcaccatgtcctagaggagccaaatgcaggtgttgatgtctggtggttttagtttttcattccactggctgcagaggggactcccttttatcccaatatcctgaatctttgcagaacctgctaccagacaagtacaccttccctcctttcctgaagctcctactatgaccccctagtgggaggaagagcatatgcaagcatggtgcttattgcgaacaagatctaatttcttactttcagatcagaagagggtttctccataacctgactccctgtgaaacagtcatctctgaggttcccatatgtggtcactctagtatgtatgtctgtctgtgcagaataagtaatcagatatacagcacatcccaaacttgtgacagctactagggaaagggaagcacaggagtaacaatcatgaaagaaggctagaaatataaaggttcaggaaatgataccgttccgaatcattgtcaccaaattcaatgattgcctgcataatgcagaaaattggagggattttttctaagaagtacaaagattgggtgtagcaaccttatcaaatcaatttgctggagacctaggagagaaatacagttgtagatttcaacttctattcttcctcactcgggtgctcttctttcctacccaggtctcaagatcctgcactgggtatttaggttgacttaggggacagggtctttagaaatctcaagaagccaaaatctgaacacagtcacttatgcctgtaatcccaggtcctttcaaaagtaatcacatttccatgaatttcacccttgtgaatggggcattctttcagggcatttatttgtgccctattcatattaataaaaaataaaaattccatttgagaaactcaactggatggaatttgaatagtcaaattaaacatttccattaaaatttataaaaatcgtcccgatatttagttgaaaagtgaggaatatatacataggtatacatatgtttaggaaatataaaaacgaaataaacttaggttctggaccaagtaatttaaataaaaaaggaataaagtcataaatagcattattataataaaaactggtaaaacacaccaggacaattttcaaaccaatgtcagtgtgttaccttttacttactgcctatggtaaatccagcactttctcatacatctcccagtttatttctcatatcagtcacatgaaggaagatgttttctttatttgccatatgtaaaaagggacagaaatgacatttgaacccacatcttccaactctgtgtcctatagtgatttcattgtaccagactagatttcagagaaatactgtgtagcagttttattttgagatcgtacatagttagttctaatataactaagccctaatttatatttagcatcatgtcagaaacatgataaacaagagtaactgctcattattaatgcaagtgacttgcaactctgccctgcgatttttattctggatatatctatcttgtgccatttcaatgggcatgtgacaaaggaaaattacactgtcattgtgttcccagtcgacccttgctactctgctgcttccattccctcattgtgagtcctgcttttgccaaactaattctagcacatttttcttctactctatgaggaggagatgagaaagggagagccagacttaaagacgtatgtgtgtgtagcctttgagttttggtggatgtgatctttagagagaaagtagaatgactaggcttctgttattgggtttgagagctgaaggaataaggagagggaatctagaaaataaaactatggattataaattaaatcttcttcttattctccagaaatcacaagtaaaaaaattcagttggattttcttttaactatcgataattctatgtcttcacccttgttacaattcaaactgaatcacaagagttctttcttacttttagttatggatacactatgcctcctctgtcttttatttaaaatcagcccaggagtgcttatttttctaggttttcctcgctattattttgtaagttccattttgaaatctgcaattcttctctgaatagcttctactcatctaattctatcaccaaagctacaaaatgtttagatgtagttcaagaaattccagaaactactttagaaaaaggtgatcagcgtaagaaagggcaaattaataaggatcagagtcaagcagctgaaacattaaaaaaaaatcagaacagggttggaatatacacattgtaacttgctagtacaaaaaaaaaatgcagagaatcaaaattagcgctttggaacttgagaggcagcagtaaaaatattcttcaggtcagtcttctgaataattggcccagttgttcagccagcattttgctatcagaatgcagaaagtggtataaacccagggatacccttcaaattaatgatctttctcaccatacatgaatatcttgcttgccagaacatttgaatgctccattattttaaaaactaaatccaatcaagaagctaagaaatgaaatttctacagttccattttcttaagtgttgaagactttcaagctaatatcaaaagagcagccctttattctcaaagaatttgtatagatatcacagtcataatcagactggctttatttcagagagtatgcttttggtagcctatccaaagattttattttagtataaacagtaaaaataacagaagtattataagaaagatgaattgtgattgacagaggagaaaatccaattacttggaaagtatattttgtgggcttagaattgaaaataataatatattagtgactgaactagacatattgatgttttagagccgtgctttgctggaatattttatgctttgtttttcagtgatgtcaggtctttggcttggaatttaacaacagacactttaaacaatgttatgtgcttatattagtataatctgtagtataacagaagtttaaggtgtctgcctataaaaccctttatatgaagtggagtgaatcattaattaatatgtcccgtactcttcttcacatccagacaccgatagttcagaatcctccatctatccacctttccctttgctattcttcacagatgcaggccaacaaagatgaggatagttctccagctgcccatggcctgcacagttcctctaatgagccacatgcacaacctctgagaggggtgtgcacacagtcaaatcaagactgctgtagctctattctttggggcgtattctctcccacctgccttctctgggtaccaggaaagtgatgaaaatcagtcttggtgttgacaaataacatgaagatagcaaataacattcttccccagttaggtggtttaagttttttaaaacattgaaaaacagaaatatatgcacacagaaagcaatttagccagcacaaccgggtataaaatgagaagttttagtacattgtccctcacggcactattaactgcctcattcattcccagtttctacccactattaattactgtaaaggtttttggcatgttcttctctacccagctcccaccagcccctaccatgccaaatgcttgtatatgtgtcagcatatatatggtgcatcttgcttattttcatggaaaggtcttaaggtttatttcacatccatatccgctcatctacttctttttatagattgcacctgtaccattgtatgaacatgctgtgtggatataaacagcactttaatcttattagggtatttttattcccccctccttttttttattacaaatgaagagctaatgagtatccccaaagataaatcttttacaggtatattgaagggtaaatttctatcagtagaattgccaaaccaaatacatgtctatttaaaattctaataaacttattaacttgctcttcaaacaatggaatcaatctgcacgtccactagcactcttgtgaacacttggcattatcatacatttaattttccccaatctcaaaaataagaaatgacatcttactgttgcttagttttacagttctttatgataatcttgagtgctttttacgaatttcataaatgattatgtatgtttattttattgtgaactacgtattcttatattttcctcattatccttaaaaatatggaacactttgcatatttgcctgccagttttgcacatagacaatgctattctactctgaataattacaacttggttatatatgttgcttaggtgaggcttctctgatttctgtaactgtgaccaatttctttaagacaacaaaggagaaaatgagaggaagacaaaggaaaggaggaggacaggaagaaaaggttgagggtgatggtgggaggagcattgctacccaaaatgctctactaatccctagttttgactatcaatccttggtagaatgcagtagttagcattgtttatggaatgggactatgtggatttgaataccaccactgccatttattaaccatgcaagcttaggaaatttactcaacttctctaagtctcaatttcctcatttgtaaattggagataatagtagtatatacatcatcatatacatcatacatcaatgttattgtaaggattaagtaaaacaacccactgaaactgaagaacactaaatgcgtgtaacatacacattcaatgcttgtcaggcattactcttactaaatacttgtccatcctatccaggagggactagaacaacttctctttcttggtcctttctcagtggtcctcctcacttggggactctgtcttgtatttacatgttgcatttctgtggagctaatttaaacaattagtacgcatgtcccaaaacaatttttatggcataagaaactattaaaaatttacctaaaaaatgagctgttgtatccagtcaagagaggtaaataatattgtgggaagtataggatttttcatattttgttttttcaatttgaattttcactaataaatgatgtaagaaaaagaagacagatgaactccatttcagtcttaagatatatttgcagtttaatgcatacctgagtaagatttctaaacttatatcaacagattggatctttattttctttccccttaatgatttcaaattttactctttatattgttgtactcgaatttaaactgcttagttactattacaatataaattaatctaaagtttagagaatattaaaaactagtggaaagcagctagaaaacttatatatgtaatattaaattatctctagcaaatggcatttttgaatattaaagataacattgctaaagtatcaagagaaaaaaactatataaaatttattggacccaatttgtaaaaatattgttttctttatgagaaaaatgactattatcagatatgtgctaaatgttgtttttccatttctttaatgtgtatttttgtccaaataaatattaacaaatattattatactgaagttggaggattctgctaaacaatcatatctgagattttgaaaatctaatccaatgattcattttggtaataaaagtttttaaataagtggaatcaatgggagtgataacaagagggcataattacaaatggaataaaagactaattctttggaggtttcttctctataggaagatatcaaattaagtcagataaagatcagataccaagaagaaaatgtcattgttcaacatgtagaagcatccaataattcaatgataataaaaacacatatttttaaaatatgattggaaatatatttatgtatagatgccaataaattaaatacattttcttgcttttaattaattttatattaaaataacctgaaattgcacatccaagtataagctcagggatgataaaacttatttaatccttttttttgttttttattcgcagaaaatgaagaccatctaaatggcttaaaaaccaggatagaaaatgctgatgctagaaatggggatctcttgagaactttgaatgacactttgggaaagttatcagctattccaaatggtaagcattcaggacactaccaactgtgtcagttgacctgaagttttgaagactgttgttaacttttaccatttttttctaagattattctggtactattatctggaaattagatactgtttttcttactcatgaattcttctttgtgagaatgagaaactaaaccatactttgcattatggtattttttatcttttattgcctttagccagtatccttaggaatgtgttacagaaaggaagatatagacatcttattattataaaactcatccttcagtattggcaggggattggttccaggacccccccccacagatatcaaaattcttgaatactcaagtcccttttataaaatggcatagtatttgcatataacctatgcatagcctcccatatactttaatccctagatcatttataatacctaatataatgtaaatgctatgtaaattcttacagtgtattgtttatgaaataatgacaagaaaaaagtttgtccatgttcagtacagacacaaccattttttcccctaaatatccaaatatccaactctccaaggttggttgaatttacagatacagagcccactgacacagagggacaactgtattgtcttctgtgtttcagcccaagaaatcgtgtattagtgaaatagaataaatcacatagacactaatctctaaaatactgatgtaccaccacaaagacacagtttattaaagtacctgcagtaataggtgatagcccactgcattctctcttgataaaattcaatttctttaactattccaactttcaaaaacattagtggtcaaaccatgtctgtaatatctttctacctattagaactgctggaaatttttgcatggtattagttcctgaaagcacacgttattttaaagatactacttttactatttttatattgttaaagcatgatataataacaacaaagattataaacacttattgagtacttaatatacttatgttaagtgtatgtaatcctcataccaattggagcaaaaacatttgcttcatttgcttgcatcaattggtcatatatatatatatatatatatatctatctcaattggttatatagataacataagtatagataacataggtaacattcagaatagtcacttcactactttaagagctaattaggtattcatacagatacagaacctactgacacagaaggacaacttgtcttctgtgtataacataagttagcactaacacttaacatcagttaagatactgttattatccccactttacaggtgagaaacagacagaggatactgaaggccattgttaaaagtggcacagaggaaacttaaaccccacagtttgatttcagagcctatgatcttaaccactaacctatacacactagtagtcatctataggtacaatatacaaattaggatcaggagacaaatgcacatatttatacaacacagttaatattaaaatctcggtggtttttacttttttaacgtttaaaaacctgagtaacttttcagattttcatgtccctttttcagtagtaagtatatagaaaatttccaatgctgaaaacaagtataaatgcatggcctaacatacctgaaaatgtttctctatcctaaaatgaaaatacgttagtttccctccaacccccaccccaacccctgccctgctttggaaatgcagattaaatcttaagcctcgttttcatgaagctcatgtggataaatttatctcgtgaataagttcagcagcaaatcacaatatgatcttatacaatgaacatttagaatagtcacgtcactactttaagagctaatcaggtattcatagcaaaagtccctgagaaaatttaatttacctaaaaaaatttgcttcatttgctacacctgaatgagacaaagttcagccttttccctttgtaaatgtgtccgaggtcagccagccacagcctcgctttgtcaagcatggattaagccactaactccacaccctttgttttgtttttcataccctcatctgctgacagatacagctgctaaactgcaagctgttaaggacaaagccagacaagccaacgacacagctaaagatgtactggcacagattacagagctccaccagaacctcgatggcctgaagaagaattacaataaactagcagacagcgtcgccaaaacgaatgctgtggttaaagatccttccaagaacagtaagatctcctttttcattgtgatgatgtcatttatttcctctcactgtaaaagtatcccagacctgtaaatgctcgagttggaaagaccctcatggtggtgtagtctgccttccttctttcatagattggcctcagaaattgagtgtcatgcagttccaaagctggaatccaagtcttctagctctgccccggtgcttttttcctctgaaatttttccagttgagaagagattaggaattctcaaggtgtgcctaacattcagcagagagatgcaaaacactttttaatccgtgtgtgtaattaaaaacacagttgtacttgggtaattatatcctcagaactggcgaagtgtcatggaacatagaggttaaggggcacgttcatgaacagacttgttagaacaggatatgaaaatgatatcaacttgaaatgcattaaaatttgaaaatcttgatattttattatttagattccagttacatcacatttctgggaaataaaaataaagcatttatctagtttctaaagactattcacatctcttatatattatataaaattatattgacttaaggatttactgagaaaacctgagagaaaatatcataacttatattattagttaaatatagtcaaaatattaagattttaaaatgcatttttccttttccgtcaaatgatacaaggctatattgggccaggtacagtggttaacacctgtaatctttgcactttgggagcctgaggcgagaggatcacttgagcctaggaattcgagaccagcctgggcaccatagcaagaccccatctttacaaaaaatttaaaaaatagccaggcatggtagtgacattgcacctgtgttcccagccacttgggagtctgaggctggaggatcccttgaacccagaagggtgaggctgcagtgagctgtgatcacgccactgcactccagcctgggtggcagattgagatgctgtctcaaaaaaaaaaaagggggttatcttggtatccttgttacatggtttcaccaaaggagatgcttgggtaatctgtgcttttcactttcaagagactagccctctttatatgccaacatttttgggggggtatcaaaatatttggagtataaaaacaaaagcactgtaattggtattatatgccataaaattcaaatgctgtttgagtggggaatggagcctgatttcagcatcctagcctcaaatcaaatcctatggatgctatgatataatagacattattaatacgactccttcatgagcaaggaagagtacaaacacatataacataaacttcagagccagggtgaaaaaggggagataaaaacattttttaaaattttttaatgtaagcccagaaatggcttctcttgtagctcaaagtttacataataacttcttatgatttatgccaaatcacaatattcccactaaaaatgaatgaaaacaaaattttaatcaaatattactatctctgctgcttacttcataatttaagatatatttttaacttttattttaagttcaggcgtataagtgcaggtttgttacataggtaaacctgtgtcatgggggtttgttttatgaattatttatttcatcacgcatgtattaagcctagtacccattagttatttttcctgaccctctccctcctcctgctctccaccctccaaaagaattccattctattttagattgattctcaactggtagtggccttttgtcatatctctgttttaatcctatcctctattatgagaaatagttaattatctataaatattaattaaattgggtctgttttctatcttactaaaacatagaaataatttttaaaatacaaatagtggccactaaattatatattttgtgtacttttatttgataacaattgcttcagttaaaatggggtgcatttataattagtacctgttatgaaaaataccatttttagtcactactttataatatttatagaaaatacttcctcatgaatttataatttttttttgttttgcttccatgtgaaattgcctgcagaaatcagtacgtatatgtttacttatataccttttagtaacgctcatgcttcattgcctattgcaaaaagtttcagctttgcatgtactatattttggttttgctttaaacattgcgtagctattctttccactgttacagtattaatggtagatgcgtaaaaggaatcttcctttataaaaaggtcatatgtggataaaggtgatataaaatgtttttaatagtgttataaaaagtttggtcaggcgaagtggctcatactctaaccccagaaatttgggaggtcaaggtgggaggatcacttgaggccagaagtttgagatcagcctgggaaacatagcaagactctatctctacaaaaaggaaaaatgagtgaaatatctgtatgatagccacataaaagtggaaaactgaatttctctatagaattaactagattatgctgtttctgataacacaaattcaccccaacacacgaatgacttaattgcaagaggattaaaatagataaggtctacactgttgttgtttttacccactgaagctcactttttcctctccttgtaattattctcaacttctgtagaattatatttggagaaacacataataaaactaggtcttaacaaatgaacaactactgggatatcaaaatgttctctcttaaacatcccacagtttaaattgaaagtcaagaaaaactaaaaaaatagctacaaaaaataataacaagaataacaaaatttaatatatcactatttgaaaaatatgaccaagagtgtcctcagcggaaaatgagagcaactacattactaaaccatcattgaaataacaattctaaacaatcaactttgctgactttagaaaaagcagagttaacttaaagaatgaaaaagatggaaaaattaatgaatttgaagacagaaaatattagacctgataaatcaaaaaggtgactccttaggaatatagattaaaaattaagtgattgtcaagtttcatcaagaaaaataaaggacaaataggcaaagctctaaaagaggtatcactagacaagggaggaaatttaacacataagagatcacttggaaaaacttcaactgctccggagaatagaggaaaaagaggggagaagaggaacttccaagttccattttgaaacatttggcaaaaacttctgagaacttgtgaataaaagggtctgtaatttgcctaagtctaagtagtctttaactacttttgctctttctcattaatctaaatctaaatcattttgcctcagttttagaataatttgtagaatgtcagaataacaatggagaattaaaggaagggaaaaatgaacaaacggtttattaaaagcatacaaaataaagggatcactgtgtttatgctatctgtatgatgatataacaaacatttctatccagataacatgcatttcaggaagaaaatactgcactcagttcttgatatagcaaatctattagttaaatttaataatagacctatgttctttttaaatgccgctaacagcataagtcatacttatgagttcaaaatacctactttaaaacctaattttaaaaaaatgataatttacttccctttgagcacatgtgattcgttcctgagggttagttctcagtggttgtatgtcagccgcaaagcagatcattcagagtctaacacagcatgtagccttgaaccttaagcagtttaactttttcatcagagtcacagtgacagaaagttgaacaatacacacttaatcagataataaatgacatagtgtggatgagactgccagcatcccagcaatagaataagtggtttaccacgtggcataggccctcccttgaaaagcacatactgaaagtctatggatcagtgatgaccttcaactattttagggttgaaactttgaaattgccaatatgtaaccctttattttttttaacctacaaaaacagctgtttaatataggtcaacctaatatgtaacacagggtaatcaactattcttcaaaatgaaattgaactgcaccatgaaagatttaattaaatgtaggcctttagtctaagggtttttcaacatcaaaatgttcttcaaaagacattttgatagcttctctctttaagatgtgcaaaaaaagacggtgagaaaaagaaagaaaaccaattttgtgtaaaaaccctgatttaaatacagttctggcttggacagactaggtgacattttaaagatgctttcatttccttgcttctgtgactaaagttctattctgtaaaggttaactttttggctgaagttagaaattaagcattgaattaagttcttcatattctctaccttcaatgctaatttttaccttaatcaaaaagaaaaagtggtggccctctgtcctaacatctactcccctggcctgcttgagtctcaactaaaatattgacatttgccatcacacattttgctttagctgttatggccatgctttgtcacattaataagatgaaattgtttggttaagcatactgctattctaattctgtgtgtgcacgtgtgtgcatgcatatacatgcacactaattttgttctatgcagttgccgatgcagatgccactgtcaaaaatttagaacaggaagctgaccggctaatagataaactcaaacccatcaaggaacttgaggataacctaaagaaaaacatctctgagataaaggaattgataaaccaagctcggaaacaagccaattctgtaagttctttttatcgtcagtatcagtaactgattgtaattgttggattattcatagagggaatgtctttccccaggattccccgttgaatgatcttgggtccttttcctttaactcgaagcgatttggggtaggaggggttggagtgggggagaggttagttttgttttgtttgtaaatttcaaaagacatttcatgagaatgataatcaccacttattgttttaaaactgggaattctggtatattctattactatttgcatagaataatacaaatagcaagaaagaaaaccttattattgtatactaaaaagccatggatgagagtaccttcctcttgctaaaaacaaaccaaaaaaaaaggccaactaatggggttatggcaggaatgaaggaacaatatacagaataagagcaaagagaaacaaacattttacatatatattcttttgtctggtataaacaacaataaaaatggctttggttatactttttacatttattttttgttttggagtagataggaaatagctgatttgtctcaaaattttgctctttacttacccaattagaagtttactaggatagaaacagagctttctagaaggtagcatgctaatgagccagggcagagttgctaagtggcaacgtgaaactttagtcaaaggaaggaagtaagggaaggggaggagaggggaggggaggggaggggaggcgaggggaggggaggggaggggaggggaggggaggggaggggtggtagaaagaaagaaggaagggcagttttcttgtttgaacaagaaaggcttgaactcaaacctttttagatacctcagttttccatgtcaaaaattctgttttttgaacaactttggaactaggatgatcagaaaagccctttcttagttcatcagtttatatttttagtagtatttaagaatacgatgctccagtaacagcatattctttttcctccttattcacatctaacacttctaaacaactccaagacagtaagttcaaggtgaacattgaaaaggaattcacgactgactgaaaaaaaacctagaaaacaacaaaaagattagtgaagatgatgttacataagatcagagtagtaaatcagtgaaaagatctgagaaaacatatattcagctagaatatgaaagccaggcagtatcgttgacatgtgatcattatgtatgtaaagcacaagattaaaagaaaccagatgttacttcaaggtttgaagttttatgtaagatttagccaacatggaaaaagcctctactatgttcagtgttactttccgtaaggtacacaaagacgaataaaggagttctttcactcacaaagtttataaaatagtagggaaaataaaatatgtacacgtaccttgtcacacaatgcagaatgttatgccacattatagaagccgtgagaagtgacataaaagttctagaaagaacaatcacctctagtagggcctgaagatttcctgaagggaaggatttgagccaggcattgaggtgggatagtgctggggagttgggggtggagtcaggtaacagggagagtattctgagaagagggaatgacttaaaccaaggcagtgggagaaggaagttttagggtccatttaggaaaaagaagtccagtttgcccagagtaattgataaaggaaacacataaccagaaagatcaacagaggccaggtctcgtcaggccttcaataatcagttaagcaatttcatttaacaacactggtacttgggataagcctcactggttaggataagctgaaagctttgagcatggaacacagtataatcagagctgtgctttttaaatataaatccagaagcagtgtatggggtagatgaaagaaagaagaatgaaggacccaactatagctgtggcaagagaaaagaagaacgtgatgtaccactcctatattttgcaatgttaacttggaagaagcaataagagtaaatattattttgtgaatctcacatttagccacattttctgacttagtcatcaagtggagaaatctagacatttttattatttcttcattgtaaagatttctgagtgcttttcccctcctcacaaaacggtgaaattcagacatgtaagcatataaaacctgtcttaaagtacaaaataaaagaaaagtataggctgggcatggtggctcaagcctgtcatcccaacactttgggaggctgaggcaggcagattgcatgaactcaggagtttgagaccagcctgggccatgtcacaaaaccacatctctacaaaaaattgaaaaattacctgggcatggtacatgcctatagtcccagctacttggggagatgaggtgggaggatcacttgctctggaggatgaggctgcagtgagccatgtttgcaccatggcactccagcctgggtggcaaatagaaaccctgtccccccccaaaaaaaaagagaagaaaaaaagaaaggtacaaaagtaacgttaagaaaaagtaatcattgtccatgcatttcaaagaaattcccaatcagttttggaaatggaattacaacacaatgccttattttttgtaagacgttagaaatatgcaagtagccaatttttttccaaatgagttttgtactaaatgaatattacattttctgatttgtaaatatggatatctggatatgaccttaacacatacttgacatgaccaaaacattaaagacatttattttaaagtagctttctctgggtttgttgattctgaaattgagtggctgatactcctttaaatgaatgacctacttactggatgaaaaatgcagtgaaaatccaatagatataataatgggatactcaataatgtttgagttcatcatgattaactggtaaataatgttgcagtattgaaatgccttaaagatacttaatgcttagtgatttttctttagatgtcttactaaggatctgcattagaaataacaataattgatagagccaaacattctaaaaggatgtttgaatttcagaaatttctttcctcttacaagagtgacatatcctaaagatttcttctagagatacagtattttgatttacctgatttcttctagagatatagtattttgatttacctgatttcttctagagatacagtattttgatttacctgttttaagttgtttaaaagaaatacctataactgaaaatcaaaacagaaagtattcaaaaggaaaagactactgattatgtactggctgtcaacagtttgggctaagtgaatgtttcagtttctgagagtatattcaaaaccagaaaacagaaagcaggtaatccaagagtattttctatatgaatgtgtgagagctgggcaatagattactgtctagtccacttcatgctgctgtgacagagtattacagactgggtaatttataaagaaaataaatttattctcacagttctggagactgggaagtccaagatcaagatgctggcaggttagggacctgtttttatgcttccaagatggcactttgaatgctcaggagaggaggaacattgtgccctcacatggcagaagagcaagagagagagagctctcacccctgtaagcctttttaatagtggcatcaattcattcatgaggacagagccctcatgaccgaaacacttcccaaaaggcccccctcccaacactgttgcactgaggattaaatttcaagcaaatgaattttgttggacacattcaagccatagcagttactctgtaggattaattgccggcatattgggtataacaacatcattttgcttcaagaatcatatttgttagatatgtattctatacaatagattggttgtaacctctagtgacattagatactcagttttaaaatggcttctctcttagacttggagttctcagagcagttagattttagtgctgctgctctgtctgctacacttttttttttttttttttttttgagatggaatctcactctgtggccaggctggagtgcagtggagcaatctcagctcactgcagcctccgcctcccaggttcaagcaattctcctgcctcagcctcctgagtagctgggactacaggcacatgtcaccacgcccagctaattgtttttgtatttttagttgatacagggcttcaccatgttggccaggattgtctcaatctcttgacctcgtgatccgcctgccttggcctcccaaagttctgggattacaggcgtgagccactgcacccggctctgtctgttacactttggcaacccccttttcaacacactaatcatggaatcccgtttttttttttttaccaggcttacctaagcaatgactgaaattcattctgtgaccaaatgatcacatattacatttatattgagtcatctcttctctaaataataactgagggatattattcaattgtgttgtttgttttgttttgttttgttttgttttgttttgttttgttttgttttgacatggagtctcactttgtcacccaggctggagtacagtggcacgatctcagctcactgcaacctctgcctcttgggttcaagcaattctcctgactcagcctcctgagtagctgggactacaggcacatgccaccaccatggccggctaatttttgtatttttagtagagacagggtttcaccatgttggccaggatggtctggatctcctgacctcatgatccgcccatctcagcctcccaaagtgctgggattacagatgtgagccatcacacccagcctcaactgtgttttttaaacaaaactgatttattaggaattaaactagccataatacagccatagggccaagctataaagcatttattaaataaaaatgaagtaaactacatacagtcgctttgactactaattcagccccattcagaattggatatgattgtctgccagggataacgcactatgctattcagttctactcatgaattccagtcagatcttgatttcttgttcactttgatcctcttatgatgtcaatggtacgtatagcctgcctcagatattaaattttctcaatgccaaggtcttctctgataatgattttggttcactttcagcagcttgctaaaaaatcactatatctgacaccctttcctgaacattaaaaatatctgaagaccatatttttcccacctgccctctactgtgctgtctttctcttgcttctctctttttatctctaatcccttggatgacccttggtatagctgccattgtatcacagaacaccctttgccaagtcccattgctcatctgctttgccatattaacatccaagtaaaaattgtacatttcctacctccattgttttgcaattcattttcactcacctactctcaacactgtatgtagaagggaaattccatgatttgtgaagcaggaactaacttcccaactgaaaaccaccctatccagaagactgtctccctaggacacagaacaaacactctgaggaccatagttggccctgagtcctgcacccagcagttggcaggctggccccacctttttggggaaggcaagaataagaaagtggtttaagcagtaggcttcctggaatgtccagccccaggccaccacactcaggcctccagcagtcaccctcctctgggtggtggaggaaacagcccctgtttctctccagaacacagtgtcctcttcatggagatacaatttgattagcagatcaggtgaggcaacaacaataaacaaataaatgacttatgcggtctgtgggagacgtaacagatcttctgtatccccagaaggtctcaaatctatatgaatttacctattgcaaaaatccctctttagccttctcttttgaatccaaccaatttggcacccaacctttgcagtatacttgcatgacccttggagaagggccacagttctgcccatactcaaacacaaatgaggctcttggagacacctcctggtgtcatgatcatatggaggctgttttggtttctaggctatcttgttgggagtctgcacagccctttcatggaggtaatgatgatgctagttggttttcttccaaatgtgcaaattacatgagtagcacaaaatgctagaagaaatgaaaaaatggaaattcactgctagtgaaggccaagagggcatttgaacaaatggcaaagagagattttacatcttcccctctctctgcctccttctggagcgctatcaatgaacaaagttacagattctctctgagtccaagcaactattttgctatcctgaaagtaaccctttgatggtgattttccatctgaccctacagaaattaaatcaaataatcaactagtgttatttatgattgaaggaaggctctctaaatataagtaaaaattggtatgaacagtattactctattcatataggcattccttttttagcaatttatagtaatttttaaggtattattcaaaagaaaagggagctgttaaatacattaatagtgatagccattggaaattatttccatttcatttcctgacaacttcatgaaaaggtacaatttattctgaaatgtatgttctgagtagaatgattaatattcttcttattgttagaacatctagaacaaaatctatttgtcctctttcaactgtaagagtataggagggttggtaatttcctcttgaaaactaaaagaaaaatagtttcttagtttaagtgataccaaaaccgctgaaatttcaattgtaaaatttcattaaacaaccttaatgaaggtcattctcattagctccatgtaaaatcacctgcctaaaacgttcccatattgataatggagaaatgtatgacgttagaagtttgttagttgcatgcttcaaaaaatagtatgctaacaagacatggaactgtgaacagctcatagtcaaaattctagtggaaaactgctcttctgtgccctcattaatgagtataatggtgtctgcatatgggtgtttaatgatagtatttgatgatagaaaataacttcaaagaagaaacgatgatggctttgtggttgtatggaagctacttcaaactttctgagagatttactcttggttctttgtatcttgttttttttaaagatcaaagtatctgtgtcttcaggaggtgactgcattcgaacatacaaaccagaaatcaagaaaggaagttacaataatattgttgtcaacgtaaagacagctgttgctgataacctcctcttttatcttggaagtgccaaatttgtaagtctaatattcaacttttcattaggctgctgtatgtgtatagctagaggttaatctgaaaatgtatagaatccccaaatgtatatggtccccaaatggtctaacgtaggctttcagatttgaaaacctcaacgtcttaccttacaaaattctgaagagtcaaattaagttagaaggcaaatgaaaggaagaaaactacagtgtttagtcacatttactttcatttgtcagtataccatcatttctgttaaattatactttcagatccagtgatttaagaatgctaatgagaataaagctattttatttacttcttatttatttatcttatttactgttcaaactaaattacaataaactcttccgttaatgaaatgaaaatagcaaagtgtgtactattttttttaccaatggaaactcttctaacttgtgttgaatttatgacctgaactgaaataacacagattatatctacaaaagcccacccataaagttctaatttcttccatttgaactatttgactttgcatgcatggggattttccaaaatgaatatgacttcttaacaaatcattcatggcataagtcaatatttgccatttgggtaaggaattctgggtcaatttgggaaataaaatcatagctgccccctcaaaaatgtcagtgtccttggtgaaaataataatggattctgaatttaaatatttgtttttatctttaccacaagtatcagagtgagaaaggctttggtctcaaaattagacttaatttgaattggtaaaattaacaaacatgcctgagcattatggactttttttttttttgctttaaggatataaaaataaaatattattttaataatgtataataataaataatattatttgacaagtattatcatgaagctcctaatcatttcacatgtctgcaaatggcgcttattgaaaaacactctgctggtctcctctttaaaggtgctttatatctgatatctcttgtttttgtatttctctgaactagattgactttctggctatagaaatgcgtaaaggcaaagtcagcttcctctgggatgttggatctggagttggacgtgtagagtacccagatttgactattgatgactcatattggtaccgtatcgtagcatcaaggtaaccaacttaataaagattaagataattaaatgatagaattttgaagtagtttcccagtttataagaaaactcctatttccatttcaataaggtaactgtgtatgcatgtaaacacatgtgtatgaattttatacatgtctgggagtgggtatgtttgtcatacttcttaggaactgacaaaccttccaggtattgaccagaggaacaactccatttctgaccccttcatcttgtgtctggtaggaatttgggggtgtcgctgtttcaggcttcctattttgcctgaagaaagtactgccacttattcttatgcaatacaagccaaagcataagagcaccattattgcttgtctttgttgtacacagctcctcctttagtctacatagccaccatagaaaaatgcagtttcaaaacactgaaattcttatgtaacataccaggtccaccctacttaaaatgggaagtaactgagaactgattcagttattctatctttggagctttaatgcaattatcaacatctagtaccatatatattacttatagaactatccctgtcttcagcacttccctcccattttctcttcttgttttcccaattctcaactccctgttaaacccaaagcagctaacagttgaaaggtatggttaagggcctagggctagacatgaagctgatcagagacagagaagacttaaagaactggttaattgttgactctgggtgatacatagagtttcatgctgtttgtagatacttaattttttccataataaaaagtttaaaagaaagagccatgtgcaatggcatgtgctgtagtcccagctacttgggaggctgaggcaggaggatcacttcagcccaggaattcaaggctgtggtccatgatgatcatgcctgtgaataaccactgcagtccagcctgggcaacatagcaagacttcatctcttaaaaaaaaaagttataaaaaaaaatgagaagcaatatttttagttctttttaaggaagtttttcagcaaaagtgtgtgtgcatgtgtgagagagagtgacagagtgcttgcgtgtttggtggtgttgagggaattaagtacttaaccgggtttaaggacatttatactcataaagtgcagttcttctttcagaaaagatacattctgttaaagaaggtgaaccttatttgataaattcattcttttgttaccatgtatttcacttaacattgcatcctcaaagaaaaaagattaccaaagtgagacagcagtcagggaaatatgacatcgaagttttgttatgactgcttgtctcaaaagagagaccagattttcatatttaacagctcatggaaatcaatcacttaaaaaagaaaatgaaataaaatgataatagctttcaaaattctgttaattgaatttaaaaatgaacttctatgcaatttgtacactgaaatctgaagggtggatattgtactgtatacattagtatgctgtgccaaacaataaaagatataccattctaggaagactacttcaacaaactgggatccaagatattataaagaattttaggagaaatcatgcagcttatgatatgaaagggtggctcatttggggtccactagctgaattaaattagacaaaatgctgaataaagtaatataaacttgcataaattgtatgtgttggtaaatagtaaattattatgtaagccataggaaaaaggctttccacttaaccaatagcaattccatcagttaactgctgctgtgtcatttcatgtcaatgaacacacacagaatcaggacctggtgctcactggttctggttgaaactgatgtaagtgttgagccaagatcagactctgagtattgattcgagatctaatgaatttggaatgttagaaactaaacagccagttttctcttaaattcttaaaaacaagtctccgcattttatatcttttaaatctggaattaccagaaatgtgatgcatatttcattttctgtatgttcctccccttcacttcaacacgtacccttgaagaactgggagaaatggaactatttctgtgagagccctggatggacccaaagccagcattgtgcccagcacacaccattcgacgtctcctccagggtacacgattctagatgtggatgcaaatgcaatgctgtttgttggtggcctgactgggaaattaaaggtaatgtgttcatcctcctcctgtttatttcatctttgttgacatctcctgacataattacttcaggagaaggtatgataaagctctgtaaaacttgatcacgttttacttaacttgcatttatgaaaacatgaatttactttgagtaagaattttcttctttgacgattcaacctggaaacacaatatttttaagcctatgtgtatttatttaaacagctgttgttttgtctttatctgtggcatcagttttttgtatattcttgttttagttgcctcaagagcaaagtgttttttaagtatacctcatcttctgaatcgatttatgatttatagatatgaagtgctataaagttcatactcacatctaattaaaagatttatgaatactttgggaaatatcacaggagctataagctttcaaaacatgatctggtttttaaagttctcaagttgctcttattcttataggatgatgcacttaatattcataattgcttcatgacagtccttgcgcatttcaaattgcagaatgcctgccttttaaagaagcttgtgttgattaaatggaattaggtgttgggaaaccactatgggtgagatgcaggagcacaaccaaatataatggataatcctgggcttgtcagaatcatcctgagttgagattagtcagaaaatgtgaaaagccagggtgaccccaaatttatgaggactcaaccttcatatagaatgaggttattttatttactttgagtacgagatgtgactctaaagtatgagaatttattccaaaaccacacgctgaagttatcctcgtttcttagaacttcatataaatgtatatggtacatagtaatatatagtcatattatcaactttctctccttcacagatagataaatatagggatagcacacagtagtacaaaagccatgaattttgaaatcaaatccaggttggatttcctcctcttccacttgctaaaatataaccttagacaagtcacttaaccccttgggctttggttatctcaactagaaaagaatgataaaaatatctaccttgcttgcatattgtaggatacaataatacattttttaatattcttataactcttcctatatgctaagtaatgttctcagtaatttacatgaattaacttgtttaatttttacaacaaccccaaaaagtatgtcttagtccattagggctgctataagaaaaataccatgaaactgggtagtttataaataaacaaacatttatttctcacaattcttgaagctaagaagtctgagatcaaggtactggcagatttggtgtttagtgagagccagtttttcatagaaggaggcttcttgctgttctcacatagtagaaagagtgaacaagctcctttggacctattttataagggcactaatttcattcatgaaggccctgcccctcaccatctaaaactcacctctcaaatgccctgcctgctaataccatcactttggcgggtaggattttaacataagaattttgagagggacacagacattcacactatagcaaggcagatactaatattctcattctgtagttaaggaatctgaagaagagagatgttaaatgtcttgaccatggtcacacagtaattagcagagctgggatttgaacataggttaataggcacagtggtcttcactctcaacatcttgcttcactgccacaatgaatagtgagacacacactaccatagagtgtgtgtataaaatatatggcaaatagctgagatgtggtagtcacaccttaaattgtaccttaataattattatgcaaatgtaattggcacaaaaacagtattctatcagtctcagaaaaagaaagaaaacatgaacaaatgaaatctatagcaaaccttaggaaatcattttggccaagaatttcaagactactgccacaccagaatatgaaccaaaagctgaaaacaactaaatgaacttgctcatgagaattcaaatgagcaggaaaatctctcaaatatagcttttcaggatgcaagaagaagcaaaaagcaagcagaattcacaagtaggataatcaatctctagaaaattaagaggttcagagtgatgacagagcattgcaaggacgactccaatgtgcaagtcaggggctccgatcaacaatctttctatgcggctgtgcaatacatggtcacagcagtgggaaatgtacatgttgatgggtttaacctaaaaccatagcagtaggctataccatagagcctaggtgtgtagtaggctataccatctagatttgtgcaagtactgtacagtctatgcttttaactattcagtaactgattttactatttaaaattttaactattcagtaactgttttcttatgtgtgttctaaaaaccaaatgagtcaatgcatgtttttcccagataatctgagtaaatatgggttcactttggcacagagtttttaaagttgtaggcaccagaatataatacagtcatgtgtcactcaatgacaagaatacattctgagaaagttggaattaggcaatttcctcaatgtgcaaacatcataaagtgtacagtacttgcacaaatctagatggtacagcctactacacacctaggctttatggtatagcctactgctccaaggctagagcctgtacagcatgttcctccactgaatgctgtaggcagttgtaactcaatggtaagtatttgtgtacctaaacataaacaaggtacagtaaaaatacagtattataattttatggaagcaccatcatatatgtgatctgtcatttaccaaaacatttgtaatgtgtcaatgccaaaacagttgtttcaatttacaacaaacttctctaggagggaccaggtcattctctttcttcatgattgtgtatcaagcctaagacttttcctgtgaaaatgacaccaggattgaatttgatcagattatttgtcgattctctatttgactccaggccctgtgctgtgtatacaagcaaacgacaccaatgtggtctcatttcctacaaagttgcttactttttctttattcccttgaactcgaaatcttcttggctgtgaacagaaatttaaaaatttacagcagcactaccatagagtgatttatacaagtgcttttaaaaaatctcttctatgtcatcagcatgtcccctttcttctgatctcaggggaaaaagctttgtgtatgcatggcccaaatttgcccaaagaaaattatgtaggagcactagcatttattgaacaccttctgtatatcaggcactgagattggtgtcataaataaattatctaactttattctcacaaaaattccacattacagacaaaagaatagaattgtggagaaggtcagcagctcacctaaagttagaagctaggaagtgtttatttactgatgatgaaaactggtatagcaaaaagtaatcagcattcgtggattaaatagttgagcttttcccctgttgttgactcatcctgtagtagctctaaggatacggacagactatgatgaaaagatgaatatgtacatatgccaaaatatcagaaagaatggataatgataactttagtttctgctgataataactctcatggataaaccaagattatttgtgaaattccaaattctagcaaataacggtatttctttctgcagaaggctgatgctgtacgtgtgattacattcactggctgcatgggagaaacatactttgacaacaaacctataggtttgtggaatttccgagaaaaagaaggtgactgcaaaggatgcactgtcaggttagttgagatgagaactctcccagggtctgtcctgtgcataataaaagcttcgattttattgcataatattctattatcatgtggatgatgtggagcaggtttgaaaggattatactcagaggtggaattaccacaaaactaatgaatcttcaagtccctgcctgcatttgcacaggcatttttcaaggccctgggaggtatactagcagtacatttgcatagtcatatgtttttataaaatttgcaaaggtaagagattttggctacaatcagttaagtttccactccaatgttctttcatgtcgaggggtttttttgtgtctgtgagtacctcattgttataatttttttttcctaaagagagctttccccaaactgattaagtttcaggtcttgctgagcatgaattcactatatttatgtttataacaaaattagaaccccagcctaggttttatctcttacaggatttttttttaattgacacataggatcctacaagtgcttcaactggaaacctatgggatttaatgattctgcttcaagagagaaggagaacaaggggccgagatagtccaggaggaaagttcctaatacatgacctcaattataagatagagggtagaatgaataggaatttgaaaatatttaacatcctatcatactaagcatgtgtagagaataaacacttttatataaaaatgaatacaggatataaaatatttagctataagtagaggatttctcagcataaaaatcttagagcccacttatcacccaagcctaaagcaattttgttaaattaaaactataaaacatactttaaatacctgcaaagttaacatgtcataacagcaactcaaaaaccattaagtgctaaggagtttgtgttattttccatttaaaggatatacatacgtttctaggacccaaatcctagcaaagtacacttcacatttctttctctacatctctagagtttcatagaagaaagtagccccaaaatgttatccctctaaaagtcttaacttccaactctttgtttctttttgacatcatggacttgtcaacatgaaattgaggatagtttgaaagcgtgacccattcattgtttaaaatggttttgtcaataatcttaaacaaaatttaacatggaaggttgtctgtaaaattctttcaatacatgaaagacagtgaagcccacattaatattctgctactcacaaaccaacaccaacttttccctaagcgtttctttggtaaacttctaagtaggattttcaaaagcctattatcaacaacaaaacatctaaggcatttaaatatccattcagcagtgcatgtcatgtgaaactgtaacatcactaattatcaattctgcaaagattttgcacttcaacacataaagtattatgctaatttatgattataagagtattcctatgtatacgtagggtgttttgtaggttgcagagattcacgtttacaacttctcctgatgctagaatgaatacagcctagtcctagccatgaaaagacatcaccaggaagggaggaaaaaacaaatactaaaatagttcaaatatcaggcataataaaagtccctttaaaaaggcacatttggagtatactacaattacccacatcagattaagggcatcatgatctgcttcacagaggaggtgacatttgaaatggtcttgacctgaggtaagagtccaaaaagaggagatagcagaagaaatgtgaagaacattctaattcctgaaaccagtaagagcaaagggaggaagagtgggaagccggagtgtttttagaaaagaacaagtgtgaattcactcatacaagattggcaaatgggagaatgattcgggtaagatgcagtggccacataggttcatacacacttcttcccagcataatcatgtttttttttctaccctataacggtagctgaatccaaagtaaaccaacatagctgaagacaccaacctcaaagtactgtgccacaacacagcctgtacacagtgtgcattcacccatatgcctgccttcagcttgatttagccaagcactctatctcggaaatgttcgtggcccacgtcttttccgtcattgtgcatttttgccccatcgctaacacttggcagtgtcagccctttcttataccccttgtcatcaaactatattcacattttccttttaaggtgaagtgatatgtatactgaaataatcctatattttttaatgttttagtgtatctttttgagctgtgctaatactttgatcaggattgttattgttttgtgagttctctaattacacacttgtgtaagtttttagcaggtcagccccaaccctattttcccataagccctgttatttgtaagaataatttttatagaactcctggtgtttgtttgtttgtttgtttgtttatttgttgctttcaggaaaacacttatcacatttgaacataaagagcaatcattcctactaaagagcaggagtgatttcatggagaagatgtaaaagtgaggctaaaagaggtagactaagaaaatgtcataaagaccttagaatgtcagttttagaaatttgcatttattcaatagtcagtagaagagataaaattgttgttatgctttagaaagagtaatctgtcaaagatatttttaaaagtgtatcttatttttctcatgcttctaaaattcacattaagattaaagtaaggggaaaaatctgctgcaagtaaaatttagttagctgagcattgaaatggtgatattttaatagacttagccccaatattcacctagaacgtagctgctccaaaatagcataattaatctatactaactttaccagacatcaaggttcaaaagagaaacaaaaggcaaattaagaagcctagcatttattaattatgaaagaataggggcttttttagtaaatgcattcagaatgaataggataactctattctattctatgtcgaaatattatagagtgtacctggaaggactcatattatttctcatcccatagtcaccaattcaaagccagacttaccttgtttctcctagtgttttctaatgaattaaatgaactggggggatctacagctctgtgtttagccactcccagtccacaactctttcccgcaggtatctccacaatcgcagtaacatcagacagataggtaggtagatagacagatacataaaaatagcctcatgtttggaaaaaatattttaaatgtattcacaagacttatcttagatattcattaattatgcatccaatattgattaaacatatattctctgtgaggcaatttgctatactaaaatctttgtcatcctacaaacatcaactggattctaggatccaagtactgtattgtatgtactagatgttttgagtttgtgcctgacataggacctagcccataatctcttagatggtctcatgaaatttacattctagtgaaggagacagaagaaaccataaaaataaatacaggcctccttaatcgtctgaatctaatttgttccagaaaaatttgttggaaggcaaatattcagagtaggatcctatatataagaaatgtaataatgtattctcagcccatccagaaaccccgcccctttgcccaaataccactaagacacccttaagcatcaatataactatctactaccaagtgcttttacaaaacataaagcacttaaaaaaactaatgacttagttattgcacacctcatgaaaggtgagaggtggtttttacttattctagcacggtggcagtagagatggagataagtggaaggaatgaagatgtatttagggtatttcctgccctacaacagcctatagtctcattgctattcagtgatgcattgaataatgacagactgaatagatatgatctgattcatgtgaaatgtctctcttctcagtcctcaggtggaagatagtgaggggactattcaatttgatggagaaggttatgcattggtcagccgtcccattcgctggtaccccaacatctccactgtcatgttcaagttcagaacattttcttcgagtgctcttctgatgtatcttgccacacgagacctggtaaagatcatatgcatagcagagtttccgtgactaaaatgcgtttgcttcttttatcagttattggtaaaatcatcagttattggtaaaattatcagttattttctaaaaagcctgggatgattgtctggcagccaagaatgggtgatacagatagtgcttatatattttcaataataactttaatcacagatacaatttaattactatttattttcaatacaactccccacataatcctttaagcaatacatccggtaataatttttcccagcatggagccatacagcagcaaaatgcttccttaatcttctttcagagacctgagttgaaaaggtgattataagtattctttggcctcatttttttctggtcagtatttcttactgaattctttctgggaacataccttttggttcacttaatatgttttcaaatgaactcacattttacgactgtaataaaaggatatgtcttagaaattttgttgtgaccatgtgcatcataatatcacagccacaaaaattcagaaaatagtaacaccaattctattttcaaaatggatttctgcaacagagtgacatattcagcaatttagccacaagaccctaacataaaccacacaagaaaagtgaacactcatatacttctctgtgtatctaaccactggggtatgtttactctattaatagagagatttcatgagtgtggagctcactgatgggcacataaaagtcagttacgatctgggctcaggaatggcttccgttgtcagcaatcaaaaccataatgatgggaaatggaaatcattcactctgtcaagaattcaaaaacaaggtgagtttttacagtaataatgcaatataggccttaatcatgaaatccaaagtgcacatgtacctgatcaagaggaaggctccgtctataattttagctactcacgagttcagtgaaaaatttatacagtcatttttttggcttagattataggtgatttgggttagacatgactgattgaagagccaaatgcttctctatcattttcttttgaaactgagagcttaatttgaaagcataaaactgtcttacaacttgcaaaattatatcctgtaatatgtttgaaaaatgttgggtgcttttcttttctccctattttgtcaagatgtttcctttaaagtggcccacagtggaatctataggagtggtagggcatagttatcagttctttgctcatttaaattgccaaacatttgtatgcctgcaagtaaataattgatcaatagtaacatgacatgtttatgattcggggacattttaaaacactttcacaaacattgttttatctgatcacataagcaggtattttgttccagtgttagagaaagtaaaatatacactcaaacttttatgtggtcacagacatatatataaaagatctcacaaccaagacagaaatccaagtctattaattctgagtgtagtgctattgctttttaagtatataattgctctaattctgtgtagtatggcattaccaatatctgcaaatgagactttgttacttctgctaatataaatagactcaattaatgttgccaatgccagtgtgacatttcatgaaaatttacgtttaaatttaaatttgtaccgtctttcatttctgcatttaatacatatctgccaggcaccttctaagtaccatgtaagaactaaatgaagttctaagttcttgccttcaaggaacttgcatcgaactggggagatagacaagtatcaatggttagaggatagagagctaattgctgtgatagagatgtatgtagccagcgagcaatctcagaagagagacacttgagtcaaacagagaggtcagtttccactggagtgaccctgaggcacaagctggatgaggagttagctggatgaaaagcatgtatggacatttcagagtagtgaaagttgtgtgaaagcctggagtcatcagagagaataacacatccttttccagctgcatttccaacaggaaactctagagaaacctctcatatgggacaaaaactggctttgcaattctttattttggagtgctgctgcatacattgttcctgtgtaagagaggcacaatgcacatttgcatgtcagaagctctgtgtagttagttgttcagtaagaagaatgtttagctgtttaacccagcatttcccaaatttctttaatcagagaaatccttccattcctgtaatactagcattctgctgaacacactttggggaatgctttagtaactacaagtgaatccatagcctacacgaatgaatgttggcaggaaattatcagtaggggccaagagataacagaaccagtgcataaggggacatatgagctaagtgagtgagtttcagctttatcctgaaagccatagggataccgagaactctaagagttttaagaaagggtgtgatatcataagacttgtgctttagtaaagtttctttagcagcagtttggagatatgtaacaatttaggatgctacggagtctggtgagcctagtgtctccccaccaacttctcttctatagtagtagaataacagatttgaagaaagaaggagaagatggatatgcattataaaagaaaaaaagacaacctaaatgtccatcaacagatgactgagaaaagaaaatgtggtatatatacaccacagaatactatgcagccataaaaaaagaaggaaatcatgtcttttgcagcaacaggaatggacctggaggtcattatcctaagtgacataacccagaaacagaaaatccaataccatatgttctcacttacaaggcgagaagctaaacaatggatacacgaagacgtgaagatggaaacaatagacactggggactccaaaaggggggagggaggagaaggggtgaagatttaaaaatcgcctgttgggtacagtgttcactgtgtgggtgatgggtccactagaagcccaaacttcactcttatgcaatatatccatgaaacaaaccttcatatgcaccacctggatctaaaattgtgaaataataaaaataaaaataaagacattcggaacactaagctgaattggctaatgctataaactctaaagatagtaatatgcttggtagatgtacggtataacaaacagggataaaatgattcaacaacttaggagaacaatttttataaatggtcatcttggaaacgctaatttccataatcagtctgctatctcaacttttattctatccattaaaacaaataaacaaaagatctgtgctctgaatcaatattagtcaaaggtcaagttacagaatcatataaatgtgaaagtagttaaaaatatgttttaggtttactgtaactacagcattccatcaattcagaaagttcttcccccaataggtctaatttttccagattttactagagctactaactgttactgttactactctgtggtccagaaatcagaaagaattttcctttatcccagcctactcagtatcttctgtgacatttctggtttctagttcaatccctttgacacagttggctgataccttctcatttataagtcttctccttggctttcaaattgactctagactcacattgctttttgcctttctgaatactcctgtcaaatgcaccaagcagtcattctcacttttattttgggtattaatgacatgaatcattctccttacttctctattgtatctctatggtatcaccgttaaaaagaaattaagccctatgaggtttagttgttcagaattttgattcttaaattagactgggaacttctaccttctgcccatggttgttacccattctctattatctctggtgtctcaccacaaatttctcaagttaaacaggtgaaattttttattataataaaactatagctgttctgtttttccacatgtcttctcatatatccaatatattttctctaatacttttaaagtattttattactatagcaggtcagttaatatgtattaatttttccttataaaaagaaaagcatcgaagctgcaatggaaaaagcaaatgttataaacaaataattcacaaaagaaaaatgcaaacttcttacataaagttgaaaaatgcaatctcaatagatgacaagcatatggtcattgacttgcagtagcaatatccaaagatcacacttaaagcagtaaaatctaaatttaaaaggaaaagaagaaaggcttggcaaaataaccttactacctgctttgataagattagctcttacaggacacatttattaaataccaactatgcatcagatgctgtgctgcatcagtgaagatgcatacggttcctacccttgagtaacttacctgctgcacaagtagcaaattactgtatctgtttaggatacagtaaacaccaagggagacatatggagggagagaaataaggcactaactgagccctaagtccttttttagttgagggggtaggaggggtggaagcagttgcaggcgatccaggccaaaaagcatcatatgaaaagataaacatgtataaaaacatgaattatttgggcagctgttgtaatcagtttgaattattggagtttaaatttcaaaagagtgatagaagataacgctgggcatgttggcaagggccagatcacaggaagctgtttaaactgtgttgaggagtttgcatttcatcttgatgaacttgattttaagtagagatgtgacagggtaatttcaatttaagtatattactcgaggtgtcagtgtggaagacatattgtcagaagaccaaactgaagacaaagcgaacaattggattcaataatagtctaggcaggaggtaaattatgcttgaagtaagagatgcagtgggaattgacatcaaagaaatgcagaataaatccaccatgtgataccattacacagctattagaatgactaaaattaaaaagactgaccatactcagtactggcagaaggtggagacactggaactcatacactgctgctgaggatataaagtggcataacattggaagaggttggccatttcttaaaagactaaatatacatctaccatacaaaccaatcatttcactcctaattattcacccaggacacaagaaagcatattttttatagaaagacttgtaccaaaatgctcacattacttttatctgtgttactcaaaaactgaaaacaaatcacatatccatcgacaggtaaatagatatacataaattgtggtatactcatacaatggaatactagcaataaaatactcagcaataaaaaataaagtattaatatagatacaaaatggatgaatatccaaataggcagacaaaaaaggcaaatttaggcagacacaaaaaaatacatttgtataaaattacatagaaaatgtaaactaatctatagtcacagaaagcagacggatgctacttgtgaatggtatatgtacgaaaaggcaaaaaggagggattacaaatgagcataaagaaacttctggggtgatggatgtgttcattgagtgtggtggtggttctgcaggtgtatacaattacatgttacaaacatggtttaaattatagcatgttaattattcctcagtaaaactgttttaaaaataggacagatattagaggtatttaggagaagaaattagtgaagctgttgattgattagatgtggtgaggagaaagtcaggatgactctctagtttagtagattgggtgggggggtcataagaccaacaaaaaaaagtaagttaagtaatacagatttgggagttagatgataattattttgatttggaatgtttagcttaaagtacgcaaggaaaatatagatgatggtgtctcacctgttgaatgtggacttttaggcaaaaatcaggtccaagcatacatacatttaagtcatcaatacattgtaagtagatataaacttgagtttgcccagatggctaaaacctgagatgtgggcaaaggaagggatattataaaacatcaacattttagaagtgttcaaaaatagaccccagggtaggagattgagaatgaaaggtaaaagaagccagagagcttgacattatggaagccagaagaaatttcctatagggaaggaaatgctaacagcattaaatattgcacaaacatgaattcagataaagtttaaaagaactccactgagtttgggtataggcaggtccctgaggactttagcaagaccagagatgacagagtagtgggagaggaattgaaataaggctccagcaatgtggatgattgctccttttcagtgaccagattatttgttttatatgaattattctcaactagttggcaagagcactgtctcttgaaattcaagtacagtccttcaggagtgttccccatctttcttgagtcagttacagaaccacagtccctgacagaagtgtgccctatcccctaaatgcatcaagtaggatgcaaagttgagaacactcaattagattttcagtggatcaagaaagagaacaaaagaataatagccaaagtaaaaacacttagcttataacaactcagcattgattataaaatatttcttaagtccctactctgtgtctattatttaataaaatccttatttccctacctacttataaatcacatctgaactcatcaactgtgaaattttgtgtcaatagcctacttttctattttgtaaagaaaagaaatagggtaagaaataaaagcaagcattagcatttactagcatttcctggtagaacccacttcatcgctatcactcatgaaggatagagtaaagcactccctttaagtcagtaaaaatatgccatcctgtctctctgccagttaccttttgggccagtgaatttcaattcaattgtgttgctgctctttaatcatgttttcttagaatgatttctaaaaatgcatatattcattcatggataaggaggaaaaccacctccagtcactggcttgcctgtgatagagaggcagaatctcattttcagacaccattaaaatacccaccaagtctgtagaaagagactattttcatcttccagtcaacagccccatatgaaaatacctttgccgatctagataaaaaggaatgtatatgaaaaagtcttgaaaacagttttataaatctattttcttttagcccccagtccagtcaaggagatatatgtgtatgaaactaattatgtatataaaaataataaaataggtgtgtgaaagtaattcaattttaaaatcttaacttgctagctatatttaataggacaattattcttttaggtatttttcttgtttgtttttacaaaagtctggtttgaggtgtccattggtatgtgtattttagtccttttttaataaggcaattgtgtttgattttattgaagacacatctttttgaaatgatagggctataaacttcaagggaattttggaatttgatgtttctctctgttttccaaagaacactgattctgaaagatgatgagttgagtgaaaataatagtatttcgtggtcaaataaatttgggaaatactttttgctctatgtccttctctaggaacattgcattgcatattagcatgctgaaagatctgggcagctataaaattaagaagatacatgtttaactttgtataacccagtatttgtcatatttatttgagccaggaacatccaagaaactagcatcctaaagaataaacatttagaaattcccttataacccactggttcaaatgcccattttcaaacccttgcttattcagatcctacatcagacaaaggtttagaggccaaatctatcatcttacgggactgatgtcaatacgcatcaaggatgcatatgaagtagttaaaggctagatctaaggacatgtggtagaaaagcatgtaattcagaaaaagcctagcttgacccctaagaagggggcggtagtgagagggatcaatgagataaggagttcctgtctgctttctaaacaatgcagtttgaacagagaagtgcctcatctttccttttttccatctatttctgaattcttatcttcatcacattaaaaataccttgagagacccaaaagaaaagcaagaaggcatgaggactgtacctctgtcacaacacttagcatcctggtctaaaatgtaatttacagtgtacctggatctcaccacttccttgtacaacatccccttccacttccatgtacaatcatattttacaacagtgacactttgcagatgagtctaaatcccagtagttcctgtggatagtaaaacttacagaaagagccatagattaggcatatttctaattaattatctgattcctaattagatatctttgttatttagcatttttaaccttgctttattttctaactacttatctagattatagaaaactacatcaaatggatctttgatgttcagttatagttatctcttttatcttcattggtttgccttcactggtgttcaagctattattttcatgctctttgggggatagtttaataatgtattttattgatgttatttctgtaattattaaattgctaaatatagtgcaagtgcttgagaaagtcaatgttaattctcgaattaaaccaaatttgtcttgaagtattaatgatgatatagatgtggttgatattgctcaaataaaatgttaaactttctttctcctttacagccaatatatcaattgtagatatagatactaatcaggaggagaatatagcaacttcgtcttctggaaacaactttggtcttgacttgaaagcagatgacaaaatatattttggtggcctgccaacgctgagaaacttgaggtaatttagtttatatgtaaagctaaggattaagttttaattaaatgaccactatgctcactagagttctgaagtttaattacaataagaatgtcatataacccttggttgcagaaaggcctaatcaaaaacatcatgttgcatgttagaacaacaccaggatttagaaaccaaaggactaatttgacatctttgttgaagagatggattggagtcgctgtttcctttatatgcacctgctgaaaagaattatgaaagtaattaaaggtagaagccagagttgaatgtggatcttgtaattgctgttctccttctacattcactggagataatggcactctgacattgcttagtgttccgaaaattagtcagtgttccaggatgctatgagtataacctattttattgctaagcattagcatcataatggcgtgttggagctttcccatatgcctaatacaagaactatattagttgttctcatgcccatgccaacatttttttttaatttcacatatgctttttagctagcagtatggggagacacatttgcttcctaatttagttagttcaaaaaataaagtaactaaaaaatgtcagaaaatactcacgtgctgtgtagttaatttactgctcattataaaacataacatagtctataaggatggtacttggtgctcaataaatgttaattacactctaattagaatgggattaattgatttggttaaaccgtaagagtttattacagactaccatgtttttaattttttgttttgtttaattagtttggtattttttaaagggtataaaagttctgtccaggtgtttctactccaaaaagacagattatgtttggaaaaatcccagaatagctgaaaagtgtgatggtcagttattttcacatttctaaacgagcagtgaaagttcagtctcattctatgacagctagtgtgcaggctgaaatttcttctccccaaatctaaactcatagatgaagcaactgtctaattatctgatgagcttcatggtgcaaataaattggctctgcattcattgtaatgtatttgtgttagaaaaataaatttaaagtgtcaagtcagaaaaacattacaaatcaaatttaaatagtaccacagttattacctagaaattcatttgccagtcattcaccaaaagtttgttgagtatctactatgtgacaggctccataccaaatactaggaatccagtggttgttcaaatctaagatttgctttacaagatcattaaccatatattattgagtgaattaaatacagccaaacctaaggttattcaaatctagcttcatttattctagtgatgattttaattatcataaaataatttttaggaattatctataaaggtgtgcctgttaaattctataaaatctgttaaaatctgaatctgttaaatgaatctttatcactaaaatgtttttactttcatgatacagcattgcataattacagtatactatttccatggtgtggcacattatttcaaaacagccattagaggtatatttgtgattgataaaggaaccaaacattcatagttacctgttattttgcctgcagacaggttctcagtatgacaaagtgcaaaagatgtggtaaacataaattatttttacatgcattgttaagctcaagctgtttgagaggcaatatttataagccattcatgaacactacagaatagtgacattgtacattttcccatttattagattgataagaacaagtactttaaattcatatttcaaagtaaaaattttccaagctgatattgtgagctacggtcatattttgattctaatttcactgccgtcaagggtataagtctatttttagttctattggggcttttgcatttctttcctttgtagatccctgtgaaatgattttttaaagatttatgattaaagtttattgttttactaaatgaaaatgtaattataagtaaattgtttttatttttgttttttttttcctctttcccgttatctagtatgaaagcaaggtaaaatttaaatttatgcatgccttcttcgagtgcatgggttgggtaaatgtggcttcttagataaagcagccgtgcagaagcagagcaacaccagtacagctttgttcatagtatgtttcacgagcaagccgtgcattctgtgagagttctcctgctgccccttgctggccgacattctgctgcttacccaccatcagttgggctgcaatttgagttgtctcaccagcagtgatgagatttgctctgctcacttgttcaaccatctgcacacagtgcccctggtgaccagcagcacacactcaaaaggcagctggtcaatttctggtacacagtctagttctgggaaacacggtaaagtggtctcttgagttgaaccccgggccctggcctccctagtgccatgctgtctgctgaagaatcaaactgtgctctcacatgcttaccactgccttcttgctttttgcaggcctgcagatatgcaaacatttacacagcctttgcacctcttgtcaaagctgtttatctattgacatgtttatttaaaactagctatggtgccagatgaaggaatctctggaaatactatatttaaaataagtatttgcgttaatagtaaagaagtgtgagatagttctcctagcttctcaggagcattttaattcttactagcattagcataaaagctgtgagcaatgggcctccataaatggctgaacaaacctcagagatgtgcagggctggtatcctctggctagagctaaaagcctggtgttttggcatttcagagcccagctgtgccagatttctggaaagaagataataaagccgaactgatccaagaaatttttaaaaccgaggctagatttttaataagagaaatagaatatacagaaatgaaagtagggaaaaataaaccatgcgttttatcatgatacagttgtaagaccactagttgtgctacatttgctgagatggctaaaaagcgaaggctggctttcatggaaatatatgttaataaaattctgggatggcactgtgtaggtttgtaattttgcctttgagtggtgaccctcaagaaacagggacccgtggttaccattgagtccagtcaccttatgtgactatttatcccctgtaattgtcctaatattgaggttgctaaatcatattttggaatggttctttgtgtttccatgaaacaataaactatataacttgtaggagtgatttactttagtaacaagacctctgaaaaaaatggtgataagtcagtctttccataaaggaaaatatggaagcaagtgaacactgttaatgaaattcaccttctctgtgcattatgcaagaaaaatataagcagaattctcaccctacagttgggcatgttctttataacaaccagctgactgactgaacgaaaagaaaaccttgggaacaaggaaaaattatcaatgaaaataaagaagttccagaaaggagtgcgggggtggaaacagacagacacctgacatgaaataaatcacctgatatacactgccaaggtctaatttgtttttccacctgtttttcctcatgccatgtgtttttcattaagataaaaaaaggaacttggcatcatgggacaatgaggagagaattaatcatcaccctatcaactacaatatattgatgccgactggacagtttttaccgatgctgattaccaccacataaagaattatctttttcacttctatataccttcactattcaaaatagtagccacaagtcacagtagctatttaattgtaaattaaatcaaattaaataacaataaatattcagtttctcattgagacaagctacatttcaagtcctaatagccacatgtggctagtaactactgatttggacagtgcagaaaacagacaatatccatcatcacaggaagttctgtggaatagcactgttataattaaagaagtatcatcatcactgacattctgatagcctttgtttgttgagcacttactgtgtgcagtgctattccttaatttattaaacctttgcaatttgattatgtaggtactatgattattattatcatgcccatttcacatataagaacactgagtcttggagaacttagatcacttgcaacatctggactcaagggcaaggacttcatttcctaatctgctggcacacttgccccattttatgaagtagtatgcaaaagtaaacattcaagtgtagtttgagtataaaagtcatttttcaattttattgaaaaaataaaatgtatgggtttttgcatttggttgctttattttgttattgttctaatgtagaatacagactttggggtcaatctgtaaactaaattaatctgttaaaaaaaaacatttttttattttgagacagggatctcactctgtagcccaggctggagtgcagtggcacaaccataattcactgcagccttggcctcctgggctcaaaagatcctctctcctcagcatctccaagtaactgggactccaggcacacaccaacatgcccagctactttttttggaggggagggcaaagacagggtctcactctgttgcctcaggctggtcttgtcttgaactcgtggcctcaagcgatcctccctcttcggcctcccaaaatgcagggattacaggaatgagccactacactcggccagtaaacctaatttttaaacatctgttttttagactatataatccaaaagaatgtttcttggactttgttttacttaaaagccttaaagagatatgtaatattatcttattttttagctatctcccaagaaaaagcctcaaataaaaaaaaatctttttcaaaataaataaacgttttcagatttttttttctaacttttgagcaaggtttttaaaaactttttggtatatagtttgtttatgctgcctatgcaattatcttctctttggtgaaaaaaataaaacttatttcattacacatataaagcatcaataagaagtcagttaattcctgtacctcatgtttaaatgctgtgggtgagattattgctaaaggggagaaggactacaaaaagactccttctgcaggataacatgaacatccatttagaccaaccagtagacaatggaaaccagagtttgctgggtacacgtgtgcacagtttgatagacatgtgcctgcatgtgtctgctccacaaggcttccttcccatagtcagagactacactaccatcaccctaatgatattgcttttgcttttcatttgactattcaataggccagaagtaaatctgaagaaatattccggctgcctcaaagatattgaaatttcaagaactccgtacaatatactcagtagtcccgattatgttggtgttaccaaaggatgttccctggaggttggtctgtttttgatagttctctaaacacatttatatcagatttcacttacttagtgtggctgctcctacaaggatcagtcttttgttaatatattttacttttctactgatcctactcttaaacgataaagcaagattaaagcattctctaaattaccatgataaaaaatggtattatgaagtcctagaattgtgatccaattttccaaatgtatagctctttatagcacatatcattaatactaatctcttttctgtttttctctttttttccaacactacttttcccttttccttatttttgtcatccattttaaatttattttacttttatgtgttgtatatagctttattagcaaccttacattttttctggaaccattgaagtttacacaagtagcaagtagtaatttacaccgtagccattagtgcatagtctgttgtctacaaacttgaagtctagcccccttgtctttgaaataacatagactgggacctgtggcaatcaactctgcaaagacttgtgtttgacatgcctgcaaagtcctttgttagctgatatcctcagtaactcttctttgatgctaaagcatcctagcattcccctattttcgtttaactattttgcactgtttcttcagttgacactgacccatatgtgagaaagaccccggccatagctctactctcttaaaatatccataagcaagagtcaatagtcaacagcaaatattagcaagaattttatagaaactcaatagtgatcagcttgtttttaaaatgaaaacgttaaatatgtcattctcatacatttttaattatcctatcataatacaattattcattttgtctgctgcttctaatcaaaattatcttaaaccactccaatagaattagggaaatgaagggaaaatgtgggtaaagaaaaaagtaaatccaccacttgaatgatgaggtttaaagactggaacagaactttcaggatcttcattgttcatagctacaggctccaatttggaattggccatagacacccactctgagaagtttgggaataagaaaagagaaaacacattaagaactaaaactgtaaggacccatactggcttcttaaaggaagttttactgagaattttaatcttcaaagcctaactctcattcacattcaaaagatatatacatgaggatggaaactgtccggaaaatgaatagcctctgcacgtggaaattatgattccctaaaggcactttgcagtaaccaggaattattttgcaactaaaatatgaggcagaaatttgatgtggataaatattgaaaagtctgcacagtagttttatctgaactatctaaaactccatgatttgaaaattggaatagaaaacagattatacattttaccagctcttgtgtcatttaactggtcttgaaacactgtgggaggaaaatagcctacattaaaggattctttgcttttactcctacaaaatctaggactttaaaaatgaatattttaagcactttaaattcctaactacatgggcttgcttaaataaatactagcaaattcataaagtagaaagtcctcctgccattaaaagtgactatctacatttactgagagagtgatatcttccacatatgtaagaaaaaaaagtcattaggaatgaacatgtctatcaagattcattttaaatacagggaggaggagagaggaagatggcaaggttgtgaaagagtgaatgaatgaatgaatgaatgaattatagaaagctatatgcttctgcacagctttgagattgagatggggagctgattttctcccttttgcaccttatttacatttctacttgaaatgtaactgttttaattttatactgagcaaggacaatggtattactttaatattgagaaaaaactagactatgcgatgtttgttttatttatttttaaggtttggtcttatcactggggaaaaatgcagacacagataatggtcatacccatctgtaaaacataaacaattaagtgatagagtttattcaagagatattcgttacagtgttttcaaaggaaacttagggacaatctccctagacatgtacctgcttgtgtgtcagtttgacttaaatctttggtttaaacaacaacaacaaaaaaaggtacctaacagtgataatcttctatatttaaaatcaaaagctctagaataaaagtagaggctataattctgattttaacaaaaactgctcagaagatttgaagttatcatataactagaaataatatttcttcaactgctcttaaactttccatgttttcctgctttctaaacctatgatgtatttcataatcacattaattgcatcgaggagggtgagtgagatggagaacttatttaaattttcatttctaatggtttctactcttcttttcctttactcacagaatgtttacacagttagctttcctaagcctggttttgtggagctctcccctgtgccaattgatgtaggaacagaaatcaacctgtcattcagcaccaagaatgagtccggcatcattcttttgggaagtggagggacaccagcaccacctaggagaaaacgaaggcagactggacaggtaccctcacacctagctgataatgcattttccctaatgcttatataaagcagttaacttacttttgtatttttagtttcgtatcatttatttctgctctcatcttggctagcaaggactgaacattccatatttccatgctggcctcctatttcactcacatcatctccccaggacaattgtcttctctaggatgttcctgttgatcaattgtaggtgcaaagtcaccctcatatttgcacctatatttcctatgggtttaacatatgcatatgtaaagaggacagcttaaaatatattcacattatcttaatttctactgtctccaagtccgactccttaccaaatctgtagacagtcagcttcggtcccttaaatttaaatgtaaattcctctaagatcattttcccagttgcacaagctgaagtaatagtcttttgggcctgactcatcccatcctctctggacacaaagaagggcagaaaatggatctgggagaaagcaagtagaacacaaccaacacagacagggacaattttatcccaatagcattcaaggatgttaaagcctaaagaatgtcaaccagccgggtgtagtggcccatgtctgtaatcccagcactttggcaggtcaaagcaggaggatcgtttgagcccaggagtttgaaactaggctaggcagcatgataagaccctttctctacaaaaaatgtttaaaaattaaatgggcatggtcgtgcacaactgtgattccagctattcaggactgctattcagctgttcacgccaccacactctagcctggatgacagagtgagactctgtctcaaaactttttttaaaaaagagtatcaattttgcaaggacataaactttagtatctatatcccctgtccatttgattctgttaaaagcaatccctcaactgcccagatttaagcatcatacctcttattgccttggtattctttaatatcttcaatcacattttttaaaacgtaattttccatttaatctagtttttctcaatgaaagggttcataggaattattttgtctgccatgaccaaaagaacacaatgctttacaaatatatccttaagtatgcacatacccttgtaaaccagatcatgttatttgtgattacgtgttttaaaaatcaattttagtatgtaacatttagtgatcaatcatattatgtaacaaatcttatttatttttctaaaaaatacaaagcccacacaaaatattcacaaagagaacccaaagatgtataaccacgagtaacttggattatttcaggaatgcagaagtggtttaatgttagaaaatcaaaatatcagccaggcacagtggctcacgcctgtaatcccagcactttgggaggccaaggtgggtagatcacaaggtcaggatttcgagaccagcctggccaacatagtgaaatcctgtctaatttgtatactaaaaatacaaaaaattagccaggcatggtagcaggtgcctataatcccagttacttgggaggctgaggcaggagaattgcttgaacctgggaggccgaggttgcagtgagccgagattgtgccattgcactccagcctgcgcgacaatgtgagactccgactcgaaaaaaaaaaaaaaagaaaaagaaaaaaaagaaaatctaaaaataatataatcttgtcaatagatagtaaaaacatttggtaaaatttaacagtcattcatgatttttaaaaaatacttaagtaaactaagaggaaggaacttccttagccatctataaaaaaaaaactataacaagtattcctgatttaaaaaaaagacattataaacatttgctataaaatcaagcccaagaaacagatgactattttgactgcactgatcttagctagcatagtaagaaaagaacaagtaaatatagcacaagaacaagaataagaacaaatatataatttaagaatcattataacaaaatagacataaagcccatatggagaaaattataaaatttcattgaatgataccaaagtatttctcaatgattatagtcaataaattggtatagtcaacatgttaatgaagatattaaagactcaatattaaaaatatgtcatttctccccaaaatgatatgtagattcaattataataaaaatatcaccttatttttctgtgaatcatgacagcttattctaaaatttatatcaaagatgaaattcctagaatagaagaatagcgtagttggggctgttccaccagatatcagcacattagaaggtaaagttttgtattgtggagctatcatgttaattcatgtataactgtgcaaataggaaagaattgagaaccctgaaaatacacaagcatagatggaaacagcatttgacaataagtggcattgcatttcatttaaaaaagacaacagtgaactgttcagtgaatgatttcagggcaattggttattcatatggaaaagatgaaactaaatttctttttcatatcaaaccaaaaaataaattcacaataaattaaagtcttaaatatggaaggacaaaaatctttaaaattcttagaagaaaatataccaggattaaattttgaccttcgggaaaagaacacttgattgaacaaaacaagattatgagtggaactgcattaaaattaaactctttggtcatcaaacaacacaaaacacaagcctcagtctggaaatgtacagtatatataatctacagggaatacagtccttgtccccaaaaggggaaaagctcactgcagtttataatgggatatcgaaaccatactggttgttatagtattagaaagaacagtattggaaagatgtgaatcaaagagtgcccttgatcactgctggtagaaaaagtaaatttctaaagtcactttggaaaacaatttggcactatctcctgaagttgaacatgtgcatactctctacaagccagcaattccactcctgggtacagacccagatttttgcacatgggcataataagacatgtacaagaatgtttatagaagtattctttataatagcagagaaactagaaacaacccaagtgttcatcagctggagaacagagaggcaaactgtggcacttttgcataatgggatatcaaggaataagaaaaaggaataaattataactaaatataacaacataataaatagaaaataaataaaaatgaaaaatgtgctatatggtaccatttttgtagatttctcatacaagtagcactaaacaacatattgtttacagacacatgtgaatttcaaaaatattttttaaaagtaaggtaatgataaacataaaatccacatttgtggttacctctgagatggagaagcaaggagatggtattagaaagaaactcataagagatgcaatggtattgtttctgaaatttggtggtagatttacaggtattcatgttattatacagtgttaacgcagcttcatcgtttacatgtatatcactcatattgtgaagaatatatcaaatagtcgtaataaaaatatttttgaagagtagagggagaaaagtgttattttatttcatttcttactacacataataagcactaaataaatataaaatacaaatgccctcgtcaatttttttgtttatcttgaaaaataaacttttttctcatattgcaaatgataagctagttataataagaataccagatcaaatattctgaaatagatttccactaaaggatacttgattccttcatcattgccagatatttaaacactacctactggctccaaatttctcctcttcaagataaaagaaatgaatgtgaatcaccagctttcaggatagtgcttaaaataaaacagattcctattaaaacaattacaataagaaaacactatgtagtatagtataaagtaagttaaaatgacattttaatgttttaacattttaataactcatatctactttataaaatatcatagtatatgctatctgaaggaggaaccaatgttaaatagtataagtctgttagacataattagatttagattcagtgctggttaaattgacaagttttatatttcaaagctaacggttttgatacccatagagttatttgtgattcctttctgctaaatgggtttgatatggcaaaccatccatgagctaaggaatttttaattgagtagtttgtgttttccctttgacagatggtgagcacttatccagatcctcaaaatgttctgtggtggacacgtaactacatacatgatttagtaaattattggaacatgatgatgtttgatggaatctgtctctaccaccatagatgactcatggagaactgagccatcactgtgtggcaggtgcccccatactccacaagaaagggagagcacgtggcatcagctctagggacaaggactgcattcaggctccctggggttcatgatgggatatcaaaaccacactggttgctatagtaacagtagcaagaagaaagcaggcatgcttgtggatgaaaaattatcttccttctttctaaatgtgggaggcaggttacatgtttgtgatagcgatctattctaccagctcagagaacaaattgaagtctaaatactcagaatgccacaaggttgggagtcaggcctgattctcagaagctagctgtccacttgtgaatataagggagagggattttgttgacaccctttgtctcctgatgggttttataagttagaggaccaacgcaagcacagctgttactttcagcatcacaaatctgctttgcagagaactgctatattaatatatccactttccagatcatctcacaagcaaaaatggtaaatgattagaaagatatttccagctgttttcaaaaccgtttgagaaaataaagtcttaatttctcaggtaagatctcagagcagacgaacctgtggttctgccagggaatctctaaagctaagccataaatgagacttctgtttaatcttcaataaccacttgctgttgcaggcctattatgcaatactcctcaacaggggccgtctggaagtgcatctctccacaggggcacgaacaatgaggaaaattgtgatcagaccagagccgaatctgtttcatgatggaagagaacattccgttcatgtagagcgaactagagggtaacaatagcactaaaatatttattattgtaactcaggtgaacttcctttgctagcatcggtatctatcagtatctgcctgaacctctgtgtgtgtggacctactatgcattgcaaaaggataccgtagcttaattccctcttctttacttttcatacttcgggaacctcatttgcctcagcccttaggagttctacccttaacatttttattcgtgcagttatctccacctttggaaaaaccaaatgcattttctgaagctataaataagaaaaatccctccctctgcccctcttaaatattacctcctcaaataaggtatgcacacagcaaaactcacaaatcagctccactggagccagcaggctttggcggtttctatctcattcaggttccaaagcagttatggcagctgcttagctgtcacagatacagagtgtggcagcagctgcaggacctattgagcctattaagtgcatatcttgtccctgtcccccttcccaaggtttgcagggtccctgcagagtggctttctgagggaacagaatcaagggaggggaggaaaatgactgctgccctgagcctggccacctttttacaaatctaccagagtgcttgccccagccctgggccagggaattggctttactcatgcacaaactgatgactttctttagaatgctgcaatactttatacttactttattaggaaagtcatctgtatttttcatcaaaatattgtatgacaactcagagagataattagtttagaaggacaattagagaaaaaagaaacagaagcccagagacttcaggggttcagacctccaagccagcaatccatttatcagactgaagacatagaaaagaactggaaatccaatttgatgaggcctcaaaacacagaggatacttttaaatgcaacgagtatgaatatgtagcagtagttcagccaagccaatactatcctgcagtgaaagacctacatttactaattatcctcttggggaaaacatttagataagcaataaagatttcttaccttctaagtaaacaacaaagctttcctcagtttttattattattattattaggtagaggattaggctgtaggatgaattgatacaaagcgttcatgcagaatggctactgagacgtttagaaaccatgatcgagacaaatgagggatcatttatttggacaaactgagaacttttactaatctaacagccagatattgtagtcatggtctctgaggagaaatgcaaactgaatgctctcatttgaatcttagaatgctttagaatcctggtttcacatgtcttctagattagatgttaggccctttgacaaactttaatccttttcattgcggaaaggactttttaaaagatttaaactttagccgggcgtggtggctcacacctgtaatcccagcactttgggaggccaaggcaggtggatcatgaggtcaggagttcgagaccagcctggccaatatggtgaaaccccgtctctactaaaaatgcaaaaacattagccagacatggtggtaggcgcctgtaatcacagctactctggaggctgaggcaggagaaatgcttaaaccagggggacagaggtttcagtgagccgagatcgcaccactgcactccagcctgggcaacagagcaagactccaactcggaaaaaacaaaacaaaacaaaaacatttaaactttaaggaatttcaataagtaactgcagatttgagaaattagtttaccgaaatcactcaaaatgtgttattttgttgagaaagaattctggaattcccaaatgcattacactattgtaccactatgccactatgtccttttaacaggtgcttcttcaagaagggcattttattatgccaacttcacagctgttgaccatcaatccaacctttatttgattaagctcagtatatagtacatcactggaaaccagtcatttagttaattggccatataaacgaacagttttgccattcattgttaattacaggataatatatgacatattagtgtgtagtcactgaactctgtgccaaaacagtaatacatttgctaccataatggctcattcggcactctaaggttaaaatgcaatctactctataagcaagtgccacattaaactgattgaccagagatcgcaagtgaccatgagaacttcacccagaaaaaatttttaatgctttatatgcctattctatggcatgatttgtgtcacatactagacaaagatgatttgttttcattgttctgaatgtatgtgagatctgtaataacatcctttcatcacagatgagaaaatattaactaacctgcccaaaatcatgtactacaaataacaggaccaggtattaaatgagatgatatatttgacttaaatacctccatctatgcacagccaatagattattcttacatttttgtgtgaccataaaggtttatattactaaatgttgattatgatgtatgattattaatttggagatatttgcattatcccaacacttttcagattttcagactatgcatgtcagtcatcatttcttttcctaaaatcctggacaaaatgatagctttaataccgcctcacaaaataattggattttcaccaaactgggggccaagcttctcaagaagctccttctcccttgtcctctgcctctctttactcctcctccctcattctctctcccttccaccccttcatctggaaaaatctccctttagtcactttggtatctaatttcttggcactccagtgacctctgcctcctatatctgctttgtcctctgatccttctcctggcatccgccttggtggccagcagttcttactggacaaaaacatcaaaccctaagagcctgaagtagttacttaagcaaataggacaagcaactgaactgagtttttcttctgggaaagctttcttcacacaggtacagaaataggctaaaggtcaggaagtagggtgagatattttaggagtcatttggggtttccagaatgagataaagattttaacactgaaccctaaatattttctttcttaacatccaaagtatgttcaaacagaaaaaagattagattctatttattatgtaaattacaaacattaggacacatttctcttaatatcttcttccacgtatgcaatccaactgatatggttttaaaaaaaatcttaaacccacattccaaacaaataagaaatagggtataagtaatcaagtaattatgaaactctaagaatcagccactgaaactgtaaaaaaaaaaaataaagctgacctattacaatactaaagtaatacaaagtttaatgtacctttttgcacatagcaggcctcagtaaaaagctgttaaataaatactttttaaaaatggaaaacacaccagaatcataatggacatattggcaatgtccttctcaataaaaactaaagaaatgatctagatttgatgttcctaaaaggtaaaataggagcaggatttagctgtagttttctagcaatgccctttttaagtaatacagcctcagggcaatcccttaattaatattttccgctgtttgaagtaggtatttttatctccatcttataaatgaatgaaatggacctgagcatgattaaataacttgcccaaggtcacacagctagtaagcttccacactagtacttaattccagtatgttcctcctgaaagcccacactcattctccatcaccaccctgtgaattggtttaaaaaaaataagggtcactatgatggtccttgtggcagaaccacactacagagagaggctacaccagaaagaggaaggcctctagctttttaaaattctaatcaagaacagagatttactctccttggacaatctttaacagaggcttatatccttcattaaaaccttagaagccctgtgatatcatgttgctaagaagaggctgctttcagctaaaggggaaaaagagtgtaggggaggggcttctcagtgagtcacacatacccggaagtgagtggttttctgaaattctcgtctcaggaaaccaccgacactcttagcaaggaagctgaacctcctgggttttgccaacacatttttccatagtttggtaaagaaagaaacctcaaaagtatgtcatttccccctattttctctttgaaactaaattttaccggtcccttcttcacccccttaacagtgacgtttttgagccacagcgaaatccattttttgtccctttctcttacttttgaattatcttacttgtaaagtgccaattcagagcatctttaccctggcttattgttttttccagttctacatgtggttttacttctttataaagtcaagtaagagggtactttaggactgaggtttccatccaagtactccggttttctctccagatatgaagtaagttttcagtaatccattcatgatccccaggctagtgactaatgcttatgactaatagcaccatgatgactgttaagaccgaaactcaaaacttgcttccggaacaaaagagaaaatgcctttggtcattttcatcagaactctttgtctccttctgattcttggcccagggatccaaggattgttgtaaataagtagcatgaggttctcaattagcagtgtgtgagttctctctcataagcaaattaggaaaattaatgaaacagccactaaggaaaatcattgcaaggaacaattagcagggtgtccttgcctgcctcttctattcaaaagccatcagctacattctttataaaaggtgctttaagtgtttgctgttgattcctgcaatctaagctctcaggagcatggtttgttccctagcaagaagataatagccagcacaacccaaggaagaccccatgctttgctaaacctgccaacccttatacggttagacattactgcacactgcagaagcctcagttctcacaggctcatgtgttgggctgcacagcgctgttgtcagctctacaagaggctaatgttgcagtgcgccatgacctggtttcagtaaactttcaggaagagtgaacgagggagtcatggaacgagatcctgagaacagcgtttgcttagtgtagaattcctaagcatccaattttggctcccttaaaagctatggttgagaggggtgaagggtggcaggaaagaatttgatttccaactgtattgaatcagatgtgacttatacttgtttatttttaatattttatcagcatctttacagttcaagtggatgaaaacagaagatacatgcaaaacctgacagttgaacagcctatcgaagttaaaaagcttttcgttgggggtgctccacctgaatttcaaccttccccactcagaaatattcctccttttgaaggctgcatatggaatcttgttattaactctgtgtaagtggatctcctcattactactactaattttttatttttatttcttgctattaggggtcccaatgcatctacattgtctacagctatgcaggggaggagggaaacaatgaggatcttcaacttagactgagaaaagcacactaatggacttaaaaaggcatgcggggattgggcttaattgtaaggaagcaaaaaaacgaaaataaaaaaatcttatttattacattctattagccccatggactttgcaaggcctgtgtccttcaaaaatgctgacattggtcgctgtgcccatcagaaactccgtgaagatgaagatggagcagctccagctgaaatagttatccagcctgagccagttcccaccccagcctttcctacgcccaccccagttctgacacatgtaagtgtttatattatccccattgctttctaatttttacccagtattctgagtcatttcagaaggaagattattcaggatatctagtacactctgatattagaattgaaagaaatataacctatctaaacctattcttacatcttcattgaatgacttacctatatttccatcttcaattttgtttacaaaacagtacattttcagttgaaatgttggaaaacacagaaatatccagaatcatgaataaaagacacttataataccatgacagaggcaaccatgttggtttccaggcccttttatctgcatagtagatgtcctaccttgtatacaatttggtgtcctgtttttagaaactagtaatacaccactaaaactgtttctaggccaggcgcggtggctcacgcctgtaatcctagcactttgggaggccaaggcaggcagattgcctgagctcaggagttcgagaccagcctgggcaaccacggtgaaaccccgtctcttctaaaatacaaaaaaatagcctggcatggcggtgtgcacctgtagtcccagctactcagtaggctgaggcaggagaatcgcttgaacccaggaggcggaggttgcagtgagccgagatcacgccactgtactccagcctgggcaacagagcgagactccatctccaaaaaataaaaataaataaataaataaaaactgtatctaaacatcatataaatgtgtatgtctaatatgattttatgttaagtatatatacacacagagacacacaactattttatagtattggaggtcatatagccttgattagagcatgggctcaagtcagactgctggtattcaaatcccagcactgtaaccgaccatctgtgtgaatttgggaaagctacctgtccaatctatttctcagtttcccatccaagtactaaccgggcccaaccctgcttagcttttgagatcagaaaagatcggatgctttcagggtgatttggccatagactatttctgtttcctcatctgtcaaatgaggatattaacagcacagacatcaaagactttgtatcagagttttaaaagataatgtttgttcaatgactcacatatactgaacgtttaataaatggcataagtactatgtagtaatgataataatgagtactttcaccagcccagggctaaacaattttcattcaatattatatgtaattctcataacggctctgtaaaatatagtctttctacttttagtcgagttaataagaattagctatcttaagcaaccaacccactcacaccactagtaaaaggcagagtaagaattttattctagcgagtcagactccaaagtctgactccttatctctggaacactctgcctttccaatttattctacttttaatagaccatggtaggctattgagagtgtttccagtttttcactattagaaactatactctgatgagctcctctatgcatcaagctttttcattatttccagttattcttaaaatagataagtagttaggaaattataaggccaaaagatgaatatgtctaaggttttcaatacacatacctgaattgtttcttccacaggctatgccaatttacattcttatcaccaatacaacaaagatggtcacagtcactacactctttacagctcatgtgttgtggttatattccataccagtaatgggtgggcaatgttgtcttgagtgcagatcttgaaaactcttgaatatctcattctcttccttagtgtccacgatggaattggttgagcaatgtgctccttgcactagaaatagttattcaatgagaggccagataaccatcattcaagaaaactggttatttactccaagcatcctttcatcctttgtaaaatagagatatttcatctatcttgcctacaacatagagttatgaaaaatcaaatgggataatgtatgcggaagttatctgaaaactggaaaaagcatacccacatagacactctgaggaatccctgcatttagtgaataactactatgtgtccagtactctgccaggcatttcatatctgttatttcattttattcccaccctattgttttatttacatttatttatattgccagaagtattatatttcacaaaggaaaatacctaagatcacacagctagcaagtggaaagctgtcagtcatggggggttagttccaggagttgatttcatcctaaagcattcctgagatctgccacatggatttcagaatgtttcctcagctctttcataattcagccacaggttagatctttgcttagcaaaggtaaggttaatgatcctcctcttcaccctcatatacctgaaaatcatgtgtttctcagactcataaacatgttttcagttgaagaattagaaaacatcatgagttgaataaacttttttgaccttggatcctaatgtccacttataaaaatgtttctaggagaaaacagcctaatttctaaatgactaacttaaaattataaactaaaattggcaagagccctaaagatcatctggtccaatcaccatcttaatgcatgggttccttttacatgatacttacagcctttgcttgaacatttcattgacaagattttccagtgttatgacaaggcaggctcgagttgttagaaagccatcggttacattaagttaaaactgagtccctaaaacttctatgtaatgattgtatttctataggcaaacacattacatttatgtgtcctctgtctaacatcccttcaataatttgaaaatagctaagtcttctccttccctaggctaaccatttccctagcttaggtattctttgtattatctcatttctaattactatcccctccatgatcagtattcttaaatttgaaatattcccttcataatatggcacctactgctcaaaaggaagtcaccagctcaggggacagtgtgacccctccctcccttaattgttaccatatttctattaatgcacctaagaatgttttaatgtttttaatagatatatcatgctactaattccaaatcgggtaccatattcaatcaagcagaacctcatggaccttcttctctaccactagaacatcctccaggcaggtctctcagcctgtgctggtttggatttttagggataaccctgccagcctccatggatcaccttacttttctaagtacttacacaaactgcattttatagggcctctcaagcacatttttctgtggtatttagagatcacactttttccttttttctcaaaataaagatacttgcccatctgggaatggagatttttactcatttaaggttcttttttttttttataaccttctgttctaatttcgatttccatttcctctcagcagtgtatgttttaacttttccgaaaacagagcattccacttagtagatgagacagaagcaaaaagttgagtagcatgccaaattggttggtttagaaagaatcacagaacattagagctagaagacaccctaaagattccaactcttaacttgcacatgaggaaagaaagccctcaaacttacagcatggcccagggggttacacacatgagcgatagttggcactaaaacccagatatctaaattccaactgctatttcaccttctttttgtttgtttgtttgtttgtctgttttttgagatggagtttcactcttgctacccaggctggagtgtaatgtcacaatctcgtctcactgcaacctccacctcctgggttcaagcaattctcctgcttcagcctcccgagtagctgggattacgggcatgcaccaccactcttggctaattttgtatttttagtagagacgggatttctccatgttggtcaggctggtctcgaactgccaacttcaggtggtctgcccacctcagcctcccaaagtgctgggattacaggcatgagacactgcgcccggcctatttccccttcttttgcacattataattagttatgactgtgtggtcagaattagattttttagaactttccatctctattaattgtattatattttagaaatcagatcatgaagccacacatatcttctgttttaatttgtttcctttcttatgttctttttgtgtgtgtagggggaaaagggtgtcttctttttaaaggttactaaaagttaaaagttttacagtttattttgtaacaaatatttattaagcacctactaagtgcaaagatgaatacgatattatcattgctagtcagagaaaaagagggagagttgctttttctgccatagccctcccacttttattccatgaattctggcaggttacttgtcccttctaaatgtaaaataattaatggacaaataaggataataatatcttccttctaggattactattatgagggaataagttatacattttatgcaaagcacctagcaccatgcttggctcaaagtaacattccatctctctatttattcttttgttagtttaactttaacttctgtgtttctttaacttaattattctagttagtttaacttttcacatttttagggtgggtggcaggtgctggaaaaaaagggatgtggtgagtattcaatttttaagcaattccaaacccttttattggtttgatatgtaatgatgatatatacattgtaatgatgtggttattaaataagtcctctataattttcacttctcaccattttccatttttgtatcagaatttagattctttattttttttttcttgctctgtcacccaggctggtgtgcagtggcgcaatcatggcttactgcagccttaacctcccaggctcaggcgatcctcatgcctcagcctcctgagtagctgggactgcaggtgcattccaccatgcccggctaatttttgtatttttaatagagatgggatttcaccatgttggccaggctggtctcgaactcttgggaagtgatccacctgcctcagcctgccaaagtgttgagattacaggcataagccaccacgcctggcccagaatttagctttttaagagttgttatttaagaactaagacttaaaagttaactcctgaagtgagaactgcctatttatgagctccatatttgtgctagcacagttgacagaaaagatctattctcagtgcccttctttttcttctttacacccatcacacccaatcctgccagcaacttacagcatgaggacaacattcactatactacagggcaatgtaagggtgtcttgagaaagccctgccttgtgaaatggattatgtcaatcttatgattaattcatgttgaacacgctagattaaagagcatttcatgcatattatctcatttgatattatggtagcttgtcttctctttatacttctctcttattctttagcccatcgagagctagagaaaacatttctacatgttctatttgtggatatttttcatggaggatggcaggaggtagaggtagataagaggctgaacttcaagtattacagaaatttgttgacatgtggaaacgtgacaagttctctgcaagtatgtgcactgtttagaccaagtctttttaacaaggatagcctgtgtggatttgtagataatgagctggctgcattcttttacttgaattttattgaagagttcagccgtaaacctcacagtttaaaatgtgaaaactaagaaaaacaatacaagtagccatggagaattcctgtactgatgagctctctttgggatttggggaaaagaagtgagcacagaaggaaagaatagaggaaaggaaagcgatttccctagcagctttagtgctacacctttaagacctaagtacagtcaaggccaaaggataaactgattggatactgatatgtatttaaagagaaaacatacattttccacttatcaaggaatccttgtttagacattaatgtataaatattactgtaaatgcccaagacccaccaaaagagcttaagtgcagtgttaacaataattcagtttctcaataaacatcttgagtagggcttttatattttagaagaagattaaagtcagtgctataaaaagtatcttccacttattcatccataaagaaaatcatgacaaataagcaccagatgtgattttagcccacatttattagagaaattaattattgactcatgaaagaagaaaattatgcaatttctatgatgattcattgtttggtgctttcaagaacaaagatgccagttttgataaatgtaatataaatctctgctcaggacccaggaaattcaagagatgcttatcaacgaatcatacgcactcctgaatctaagaactcatttccaaatgtcagccaccaatctgcagttagttagaaaagaccattgctttattctgacctgaagttaaatgagtgacagtgtgggggtgaaaacgttttggccccgttaccaatttggtgcactatctacttccctaaacaaggctttgggagcatggcttcctccataattattcccaaccacatcactgctctaatcaacaggtgcaccaccacgcgagactccccacccaagtcctgtctgcctacaacttgtaacctgccaagcaaaggcaaatgaaaaacaagcgtatctgtcctcctttcatatcccattttccccattatctatttctagtactttaaaaagtccccacaaggtggcagaattgtaacacgttgagattgatgagcctctactgagactgtgaatttttttttttattattattgttgttttaacacatttgagagattagtgcgtccaaaacaacacaggtaaagcatcacatccatagagatgaggacgccttcaagtatacactagcttagaaaaggatgattcatcttgcaatgaccattctttaaaagttccttaaaattacctcattagatcttttctcttacccttttttcttagcttagatttcagtggcaagcagagttgaaaacatcatccttagtgacaagatcattttatttctgagcaaagcacagggcagtttctattccatctcacttgttccccctttaaaatgctagaaggaaaaaagaagcttgagcagctggatgagcagctccacccactgtgggacatgaggcagaaggaagagaagaggaagcaacaccgggcaaagcaataaactggtgctgccctgaacacatcatgttttttttctttttgagacaggttcttgctctactgtccaggttggagtgcagtgatgcaatcatagctcactctaaccttgaactcctaggctcaagtgattctcctgccttggcctcccgagtagctggggctttcagcatgcaacaacatgcccagctaattttttatttttttaatttttttgttgttgttgttcttttggagagacagaggggggcaggggtcctcactttgttgcccaggctggtctcaaactactagcctcaagcgatcttcctgcctcggctttccaaatgctgggattaaaaacatgagccaccacgcccatcccttacacccatcagacttggtttcagtttacccaaggaaaagtgatgcaaggaagacaccctttaaccaagcaagggggaggtcgagatttgtacaaaacactaccaaattagagggtggggaatttttgtcccatttaaatcctaaggtacatatttttaaaaaccctcttacaccagcacttctcagtccttttccaactgccagtttaataaaggaaggtgatagaagttttattaaaacagtatccatcctgttgcaaatcaatgattgatagtaaacatcaccttggatgtccttaaaaacaaaggactatacaccataatggctttaaactttgaggttacatgttagagtgatcagtttggtacaactcttttccataacattggctcatctgagaataccgttttattaagcactgcttctgcctgcttcttgagggctgcccgttgcagaaacggaggatctaatccaggaggtgttcttcttcctaaatttcaagtggatgtaacctgtaatgattcttaaaagaactttgacaaagtccctgtccttttctggtcaaaggtttttttctaaaatggcttgaccagtgccttgtccatctagaaaatctcatagtatacaacgaaacaacaacaaaataaaaacaaaccaaaaaactgctgcttagctcaggaccagttttggatacacctgtccagtctaccagcaatccaaaagttccccataacatacagctgctaccgggagtgtacaactgccaccttgaaaattttttaaattttaatagagaagttatattgacatttacatatagtaattagacgagtgactgtaaccgcaataatatggacataacccactggtggttctcttttaagctacatgtaattgtttcctaattcctcagcatccatccacctttcttaatccctcaattttcagagctgagggtgtaaagatgtttcagtgaaattctgcccccagtggactcacagcagataggattatcttagtgatttctgaggaagactgcaagctgcgtgtgtttatcgagacggtcctctgtccgggaaatatcgtgagaggctgataaaagatcccaattctattaatagaagtattcatgactgagatcttaagctacagaggcctttccattcgggctctttttgcaggcagcgtaataagaaaggtgccacatgctgcctctaaaagaggccattcagctgtgcgaatgaatagcattttcctgtcctacccacggggttttgcatagctgtgtgaatttcggccacagtctgctctttataactgaccatctcctgggaagcaagaagggaaatacttccatgaagaccaattttacggcatttcaaaacactttaagccttttacctgctgtggcagagtgcttcgtttgactaagatcaagagaaaagagaacaaggcttttcctcatcaagtaaaaatttcctgtgtgctgatgagtcatctctgaggtacactctttgggaagaacactgtgcatcaaaagcctgccttgggctgcttgagaacctctgctgagtcagcactcactggggcagcggcccagccagagctattaagtgcagatcttaaaaacagatgtgttggtgagagtgtgcaggttattttctcatgtactgcatgttctaagagatgtcataagcagcctgtatatcgacctatcttgtgaaaatagagaacagggaaaggaattgtggctttggtaatttaaggagccttgattatttatggagctgtgtgttatggtagccaaatgtgatctactcagccaggactgctgtatgctttgcaaggcccagtgcaaaatggaaaatgcagggcccctcactgaaaaattattaagaatttcaagatggtgacagcagagcattaaaccatgtgactgcacagccccgcacctagctctccccctcagcaccctaggaagctgatctttgaacagtggcagttgaaatggtgtatggtgggttacatttttaaaatgtgctgggttgcctagcaactggcaagggcctgaatgggctgacgtgcaggtttagatacaccatcttgaaagtctacattcatggaaaccttctagtggactgataattttcaagaaaaagtaatatagtgggagatggaaatggggagggcaagaaaaaacacattttgctactcttataacccaagtggctagcttgtcattttccctgttcgatcttctaagaatagagctcttcatatgtgaaggaaaaatgaaagggaaattccagttttctcagaaatatacataaatttttagaggataatgaaactatgagttaatcaataaatatgtctgagcacattcctttagccattccagggtgtgatatgagaaaactgattcacacgcactgagcactcaataataagtacttactatgcagtagactacagagatgaataatgtagtttttattcttaaagaattacgctaatatgtaagaaacaattagacagcatcattacctttttaaagaacagtccataatctcctgtttttctctcctgggtattttacagggtccttgtgctgcagaatcagaaccagctcttttgatagggagcaagcagttcgggctttcaagaaacagtcacattgcaattgcatttgatgacaccaaagttaaaaaccggtatgtatcatcctgagacactgggaaagaaccgataaatgaagaactgagtatttgtgtttaatcaagttgaatctactacacttattaattaatgaagttagcttttcttttattcactgagtacaatagagaatagaattttatttgtctgagcctgaggagcccaatttaggaaatcagtagcctgataaagtcctcatctctgagaaggttttactctcctttatgaaaatgcagccacgatctgataccgctctattttagcatgagaatgctgttatttttctgtttgactttgcatgcttttgtttcacagtctcacaattgagttggaagtaagaaccgaagctgaatccggcttgcttttttacatggctcgcatcaatcatgctgattttgcaacagttcagctgagaaatggattgccctacttcagctatgacttggggagtggggacacccacaccatgatccccaccaaaatcaatgatggccagtggcacaaggtaatagtcccctggatattggcagtaccctaagggaattactgagtggcagccatcagcattctcctggtgccagtatattttgccagggcagacactgactctggcagaagctaaaaataaaataagtgccatatacaactaccacaatcttggaaaatgtgctcagacctgtgtaggtttgcatttgaccactggcatgcctcatcatggttccatcactgctatatggctgtggttttcaaacatctacccataaactgaggccaggtggctgaagacatttccactgctctaagtgagaaacgtagaacagagtgtgttcaccatcaagctcgatgtattcaattttaaggaataatatttattctgagattatattatagcatttttatggtggctaaaaggcctttctattatgaaatagtatttgccaaaagcaaaagttggcaacactaaaatgggtcccaagactccccacctaaccacacagtggtctgtgaaaaccaggaatccaggaatctctggttgatcgtgtttaaagggctctaaggtatcatttctactgacagttatttggaacaactttaaaaacgttggccttacacccagaaactggtactattatgggcacagaaggctcatttgccagcttactgtcctctttggcatgactgcaaatagataatatactgcctgattaaaacaaaatctcaacatttgtctctgcacctgcgatagcctattaaagcaaagcttccctaggtagaccaataaaatttttaattttcagagtacgatattattagatgttagatttggttaatgttaacatactttgacttgtcatattctagaaagccaaagaaccttaaaaaacgcgaagccaaccaatttgttatcatggaaataagaaaaggaatcttcatttttgctgggagcttatgactagcaaatacagatccaaatgaaggagctctcattaagagttcttccatctctagctaatagaataataaatatgacatttgagaaaaagacatattgttgaaccacaatgaggctgggattaagaaagggaacttaaatactataattagtcaaattaataacggattttatttttgatggtttttaaaaattacttcccaaaccagaatagatatgtgtaaaatgaagtgtgaaattactctaatcctgacccagactcatttttaaaccatcatggtactttagcatttcacaggctttcatgctcctttacctaaattcagactcaaggtttttatactccagccagtctttacaccccttatttcattctgtctcagaagataattcactccaccgccctaaatttcagcctcagtcacttctctatcttactcccccactttgtactcatcaggttctgcagaaagtagtgcagcttatttgtgccactctttctttaattctgcacaagaagggcctgttaggcaaagggatgtagcgtatctgaaattgtgttgggagcccaggctctttgctcaatcaaactaatgcacttttaaaactgtgcatgaattttgctacccacttaatttatgaaagtgctattagtctgcagggttccttacaacattcctccctctccacacatatccacatttggcaatctaccgaggagacttcgacctaaaactgacccaggaaaatttggtattcttttggtgatagtagtcatggaaaagacagaatttgagatattctgtaaaatgggtttaactttcccatatataatgggcttagcgcatactaagcactgtgtacattgtttcaatttttcttggtaacatcgttagagtccttatgtcttatactctgcatatgtgaaatttgttcaggattggcattaatgactcctttcttttttgtagattaagataatgagaagtaagcaagaaggaattctttatgtagatggggcttccaacagaaccatcagtcccaaaaaagccgacatcctggatgtcgtgggaatgctgtatgttggtgggttacccatcaactacactacccgaagaattggtccagtaaatatctgatttcttctttattacttaaatatatggctgattcatttattgatatattttgacttattaggtcacatgggcccatgaaaactgataggtgaataggaagtcatcttttctgataagggacagaagggtttgttgtttatttgtttgtttgtttgttttgagacagagtctcgctctgtcgcccaggctggagtgcagtggtgcgatcttggctcactgcaagctctccctcccgggttcacgccattctcctgcctcagcctccctagtagctgggactacaggtgcctaccaccacgcctggctaattttttgtacttttaatagagacggggtgtacttttaatagagacggggggtttcactgtgttagccaggatggtctcaatctcctgacctcatgatccgcctgcctcggcctcccaaagtgctgggattacaggcctgagccacctcgcccagctgacagaaggttttttagatagattagattatgagagacaatgccacggaacactgagtggggaacctggagccaaactgtcttggtttgaatacctatttaactattgactagctgtgtgttttggagcaagttaatcttttttaacaaagatttctcttttgcaaaacagggtaatgataatactaaacaaaaaggattgcataaagattaaatgaggtaatttatttaaagtgattgggttgggcatggtggctcacacctgtaatcccagcactttgggaggccaaggcaggcagatcacttgagaccaggagttcaagatgagcctggccatcatagcaaaaccctgtctctacaaaaatacaaaaagttagccaggtgtggtggtgtgtgtctgtagtcccagctactttggaggctgaggcaagagaatcacttgaacccgagggtcagaggttgcagtgagctgtaatagcaccactgcattccagcctgggcaacagagcgagaccctgtctcaaaaaaataaataaataaataaataaaaataaaaataaagtgattggaagagtagcaggcatataaaaagcactgaaagatgaaaatgatggtatgtattcatggtgtttcaggcatagagatttagcaaatattgagaggtgcagtagttacagtacagttatccaattttggattcagaatttaaagccctcacagttttgtaaatcaatattcacaaaataattttttattagaccgtgtatcctagtttgctttggaaagtgttactctgagagaagcacgggggattgattggtgcttttagagaacacactagatacaaatgtgatacatttctatactcaaattagaacacatgataatgtagatttgttcattcatcaaagacaatcacccattatagttgtaattctcagtatttggcttctcttgtggatgatcagtattacttttctttcataggtattggatatgctttttaggtctatcaaaaactaaagtctctgaagtgacactggtacaagcaattcacttgaatttctaaaaacagataaaatataatggaccagagtgtgattgagttacttctaaattccttgaacccccaatgtttcatgcaaactttcaagttttatgcatatttgcattttcttaggggagggtctgctgctttcattagatattcaaaaggaagaagcactgaaccaaacctaattaccttttcaaatagaaattgaacataggctatgacaaaatgggtatatagtaaggttaataaactattaatagaaacataaaatcaggaacgtaagagaccaattaaaacttatgataccaacatggggcccatagctctgtcaaaccaatggagacatagtgtgcagtatttagactatgagaacagtcatattccaggatagacacatccaagttgagaagcacaacacaggattttctgcatccatgccaggaggcctggtggtaacagagaacccaggcagctttgggggatatcccatcctaagacaactggataactacacacatagagcaccctgcaaatgactgtattctacataaaggcaaagttctgctaaaacctgacatttgtttcttctgatctgaatgtttaggtgacctatagcattgatggctgcgtcaggaatctccacatggcagaggcccctgccgatctggaacaacccacctccagcttccatgttgggacatgttttgcaaatgctcagaggggaacatattttgacggaaccggttttgccaaagcaggtaaggctctttcatttccttcctgttgattattaactagatacaaatactaacttcttgctagtaccaaataataaaagttcctagagtcctaaactagtatcctttatttaagccaaaaagaaacttatggaagtaatttcaaaaatgcctcttaaaaattcatgtatctgatcctgataagaattaatagaagaaataaagtaaaaggtctatttagagaatttattccatctccttcactggaggttaagaacagcaaaataaataattttgcaagaacactcatatgtttatactatgttgtttttctaccttccagtttctggagatgagatatgatttttttcttcaattccctgcaaggctgtatttcataatctcctccccatcaacacacacccatacacacaatgcacacccatgtctgtttcttgttgatagtgacaatgactggcatctttcctggctttctccactccgtttctaatgaacatttccagtatggttttatatcactggtcatgaaggtacagttaggaaaaagaaataggaaataacctctacataataattttttaatcctttaatttttaatttttgtgggtacacagtgggtgtatatatttatgggtgacctgagatattttgatgtaggcatgcaatgcataataatcatatcagggtaaatggggtatccatcacctcaaacatgtatcctttatgtttcaaacaatctgattatactcttttagttatttttaaatgtacaattatttttttttttttactgtagttacccttgtgctagcaaatactaaatcttattcaaactatttttgtatcattaaccatccctactcctccctgccactaaccttcccaacctctggtaactatccttctactttctatctatctccatgagttgaattgctttaatttttagctcccacagataagtgagaacatgtgatgtttgcctttgtgtgcctggcttatttcacttaacataatgacctcaagaaccacccatgttgttgcagatgataggatctcattcttttttatggcttattcatatccagtatgtatatgtaccacactttctttatccgttcatctgctgatggacacttaggtggcttccaaatctattgtaactagtgctgcaataaacgtgggagtgcagatatctcttcaatattcttttgggtatatatctaagagtggaattgatggatcatatggtagctctatttttggtgttttgaggaacctccaaactgttctgcatagcagttgcactagtttacgttcccaccaacagtgtacaagggttctcttttctccacatcctcgtcagcatttgttattgcctgtcttttggataaaagccattttaacttgggtgagatgatagctcattgtagttttgatttgcatttctctgatgatcagtgatgttgagccccttttgatatacctgtttttcatctgaatatcttcttttgagaaatgtctatccaaatcttgtacccatttttaaataggattattagatttttttcctatagaattgtttgaattccttttatattctggttattaatcccttctcagatgggtagtttgcaaatattttatcccattctgtgggttgtcacttcactttgttgattgtttactttgctgtgcagaagctttttaacttgatgtgatcccatttgtctatttttactttggttgcctgtgcttgtgggtattactcaggaagtctttgcccatttcaatgtcctggagaatttccccaatgttttattgtaatagtttcatagttggatctcttagattcaagtctctaatccactttgatttgatttttgtatatggcgagagatagggatctagtttcattcttccgcatatgaatatccagttttccctgcaccatttattgaagagactgtcctttccctaatgtatgttcttagaacctttatggaaaatgagttcactgtagatgtatggatttatttctggcttctctatcctgttccactggtctatgtgcctatttttatgccagtactatgccgtttggcttactatagttctgtggtataatttgaagtccggtaatgtaattcttccaattttgttccttttgcataggatagctgtggctattctgggtttcatatgaattttaggaattttttctatttctgtgaagaatctcattggtattttaatagggattatattaaatctgcagattgctctgggtagtatggacattttaacaatattgattcttccaatccattaacatggaatatcttatttttgtgccctcttgaatttcttgcatcattgttttatagtttttattgtactttcctctaagatctggaacacgacaaggatgcccactctcaccactgttattcaacatagtattggaagtcctagctagagcagtcagacaagagaaaaaagtaaacggcatccaaggaagaagtcaaattatccttgtttgcaaatgatatgattttgtatttggaaaagcctaaagaccccaccaaaaaaccattagaactgataaattcagtaaagctgcaggatacaaagtcaacatacaaaaatcagtaacatttctatatgccaacagcaaacaatcagaaaaagaaatcaagaaagtaattccatttacagtagctacaaataaaataaaatactaaggaattaaccaaataagtgaaaggtctctacaatgaaaactgcataataatttttaaaatctgcaattaatgtactttaagatagaatattcagtcccgtggtatcatagaaatacgtgtatgttcattagaaataaactaataagcacataatatgtggagattatgatgggaaacagaaataagtaacatagttctttctatcaagaatatattatcaactggtaagaaattgaaagaaggcaagtaaaaatgattaaagacaaaaaaagcacagttctgtagatacttagaaaaaaagattaattttgtttgggggatatcaggaaacgtttcatggaggaatcagcatttgagcaaggcttcaggtgattttaacactcccatacaaagtagtgggtgatagaagagtaggaccctccaccaaaatataggtaggaaaccccacctacagggaagcagaaaacagaaaaacacaggatatgttaaatattgaaacgttacaggttatgctgaaccccgaattccatgtgctatgaaagtctaaaagcttcccccaagatttctgcaaattcacagatggctggcattctcttagtcaaattttatgacaagtttcagcttcagcttttgcacttaatggattgacttgccatcctgcctgggctcttataattctggatcaaacaaaaccagaaaattactcacttcctctgtttctaatgtcccttgccatcccctgaacacacagtgtaatacaatttacataagacttgggtggtcagaagagatcacttcactggaaaacatacaattcatcttaacctttgacatctttgttcttaaaagttttccagcgacccaatcactggggcttttttttggcctcttcattccttctgtcctcagccgaacttcctcatgtcattcctctcttctccttacttctccctttctgttttattttgcagagcaattcagcttcttctaccctttactttattttttcgtttatttccagaaggggtgtcactatgttgcccaggcgcaactggctagcttttattcataaaatctgctataaacccacctttgccaatccaaacccatcaaggttctcagtagaacaaaagtctttcatgtaacagctaccatccttcattgcagacagccgtggctacacatagcatttatttcttgcctaataaatagaagacttggagaaaattcccctgagtatttctctgatactcagttcagttggtgtggtctagacagatcttaacatatcactttgttcctaagtgatgtatctatcttaaatacttgctcaaagattaaaaaaaaaatcaaagagtcaaatatggaaaatcatagaggaaagaattaactggatgaacaagataagtctatttatgtcccagaagcttcccatcaacattgtacttacagtttctctctttattaataaaatgtgtggcaacttttgaaacctttcagatgattgtggcaccatttagtgtgccccactaaaactttactgaaaaataactgaaatgtttttctttacccaacagagagacttctaagataataatacctgacagtgagattctttaagtcaatctcagtgtgtatccatttattcaaataatacatagtaaaccctcatgttgtgccagatactttggtaagcacagggataaaatggtgaaaaatatagacaatgcccctgatctcatagcacatacattctaaaagggaaggtagcccagaaaataagcaataactaactatggagtgtgttacatgatgcagtggtggaagataggccaggcaggatctgaaacttatagccctcattagaattagctagcatttgaattgaaatataataaaaagtcatgcattgtacacgtttgaattaacaatccccatcctctaatccaaaatattttaaaatcttcattttacagttggtggattcaaagtgggattggaccttcttgtagaatttgaattccgcacaactacaacgactggagttcttctggggatcagtagtcaaaaaatggatggaatgggtattgaaatgattgatgaaaaggtgagtgtcagcaatgcaaacatttctgatttcttcatgatattgttgatgtgtagatatcatccatgtgtgggaaactcgaatattttgaagcccggctgtattctttgttgggagaaagctaaattgtatgttttcatccttctggattacttcaatttgtgtatgttttcagcatgttgtaggccagtataaattttaaatgcattaattgtacagcaagccaatcgtgttgactaataatgaaccaaatagtttgagatctcgagttcttactgtgttgctataaacacactcttattctcctcttaaggaacacacagtctatgagactatggactccagtgggagaaaaggcagagaggtggatcatctaaaattagtctgcctcttttaacaggctaggcatctcttagaagccaaggtagccaactgacgcatcagtttctcaatttgtttaaaaaagcatccagctaccatttcaaaaaacagcaaatttataaaagtagtgtgtcagtttgataataattgataatcaaattctaaacacctctttcagccctgcattaagacaactttgcactataggcagcaggtaaacagagaagggaaaacaagaaatttcacaagttttctatttggttattaaataggaatcgtacttcaactcagttcacgtttccacccttagtgttgcctcccaagaagaaaaatcacacagtgacctaaaatagttttttcttgctttcttcctctttctgctcaattttcaaactgtcctccaacaaaggtaatataggaaaaaagatccaccagcttagaggtaaaaaggagtgaacaaataagtaacactcaatagttttaccaaattttcaaacatacttttactacatctttttcaagtaacatgctcttaagggcagttaccatcgatatgtcactatcatgtgcgtttctcaccaagctccttttacatgcaaaagcctgttatgcaaactccacccaatatagtaaacatttcattaataattacatcaatagagtttacaaacttttcacctatttacttgcatttttaatctttcttcttaagacttcatttcttttcttttaccttgtcgaatgtcttgccaaactgactaatgtttttagtgtttcaatatgtttcgtttcttcaccagcttcaaaagaattctgtcatctcaaatttcaggggcttttccacattactaaaaacagatttttctcatttagaccagaacttctagtctaagttcttcattgttaggaatttaactggccttctggctcaggtctttggcacctgtgacatgaaacgggctccaaaatgtaatttatgtaactctcaatcttgtatataaaatgaaatccatgaaggaaaaaaatataattaaaacatcaaaagtttaaaatttaaaaaatcctttactttgaatttgtaaaccaaattaatgagtcactttaaacaatatcttttaagaaaattttataaggttcagtcagaactctcacattctaaaaagacgtgaggtagaatttttccctgtgtacactaggtccttttcttgtcacctggcctcaaatttttctgaaagcagaattattaccagctttacgtatcttgcctattaactcccaacaatgccccaaagcaaagagcataatttgtggctcctggtgattagatttatactttaatttgtcaagttttaaaatttttttcaatatgcccagttacatccatttcaaatgattctggctgatgtctttcctagagacctgatcatttgtatgtgtgaaccatcatgatacttctttaatgaaaccatctgtgactgttctatttcctactttccagttgatgtttcatgtggacaatggtgcgggcagattcactgctgtctatgatgctggggttccagggcatttgtgtgatggacaatggcataaagtcactgccaacaagatcaaacaccgcattgagctcacagtcgatgggaaccaggtggaagcccaaagcccaaacccagcatctacatcagctgacacaaatgaccctgtgtttgttggaggcttcccaggtgagtgttggctaccccagcaacaatttctttgctctcttatgttactggttttgaaaacatttatatttacgtgtgtctaagaatgtgtgcttatgtgtacttgcttcctagctttagaatctgcttagaatctgcaccttacctaaaatttccagtgtgtaaaatgaacatattacttatataaaccacatgggactgaacttttcatgagagcccccaaagtttccttcgtggagagattgaagctggaggaaatgaatttggcttataaaagatatgaggcatttaacagcaattggagccaaacttggtgttctttctgatttttttaaaattaatataccagaggaatcaatcataaaatgttatggaacttatttcctcaagttctggaaatcattgggttaaacatagctaatttcccccttatgttattatagagtttatatttatattacaaagaaacgcaagcaataaatcctcattcagaatccttctctagcacattaaatatagcatgtgaactgtagagatttacctaaagtgcccataaacaagagtggccaacttgatgagaagtaagccaagtgcctcttaataagtactgtaataacatagcctcctggaatggtctttcatcattttgtcaagaggaacttttatccctgtttatataaagctcctttgctaaatgaaacaagcaaaatgtatattcagcaattgttgacagagcaatgttgatagaaatgcaatgggggcccaacgacagctcctctttccaaagtggcttctgtgttttaaaaagatcttttgcttcaatcaggataaattccaagatattatgaaggaggtaatgtacttctccattcagtctatgataatgggatcctaattaacacctagtaggcctactgaaacaagcacctctataataagaggaagattctacatgaatatccaacctacttaacctttagggatttatttttacaatgtaagaaagtgataaagtcaccttcaaaaagttctaagtaagtcagtacttaaaagtatttgatcaattgctttgtttcatgaagtaacattttacaattttaagtcacaactataaatttgttcatcccaaaccaagttatttcatgtcttaagatgtataattctagatgttttcatatgttataactattaaaaagttgaggctggacatggtggctcatgcctgtaatcccaacactttggaattacactttgggcatagatggggagatctcttgagcccaggagttggagagcagcctgggcaacacggcgaagggaggatcgcttgagcccaggaggttgaggctgcagtaagccttgattgcgccattgcactccagcctgggcaacagagcaagaacctgtctcaaaaaattttaagttgatctttctttctctacaattctattagtaaggctaaaaacaaaaccactaactttgcataaaacagcattccaatttaatctcaagctaacagttgactttgaaacatgctcttaatatttggtgcaggacatttcaaagctgagccctcttgcattgcctttttcagatgacctcaagcagtttggcctaacaaccagtattccgttccgaggttgcatcagatccctgaagctcaccaaaggcacaggcaagccactggaggttaattttgccaaggccctggaactgaggggcgttcaacctgtatcatgcccagccaactaataaaaataagtgtaaccccaggaagagtctgtcaaaacaagtatatcaagtaaaacaaacaaatatattttacctatatatgttaattaaactaatttgtgcatgtacatagaattctttctgtattcagatggtgctaattcagactccagactgaattttaattcaagttctttctcaagtctataaataatattaaactgattatttcattctaaataattgcctgttttgtgtgattttaaggataaaaggtaactggccataaattgttgagtttgcaacatgccctccagtcatctcaaggaaagagttcagatgtaatttatggaggcaattttttttaacttattcctatcaatacttcttctttcttttatcatcctttaccatgtatgacagctttggccttctgtccaagccactgacagcaagtgaatttggcatgtgtgattgggaggaaatcagttcccttactctatttatgaaagaattattagcaaatcattgtcctgacccaagttcattattagagagtttaactagccgtatgagtgaatagctttttatgctgaaggtagagggtatagaccagattcaggccagaaagcttaattacttgattttcttatttgataatgatttatgggctttggggagatgccaaaaccaagcttatgaatgacaaccaagcacacatttgatactacagtactaagaaagatttggggctctctaagcctacagtgaatatcacaatttacacctaggtggagaggaataatgctgaaatgcatttgtacttatcaggaaacaataaaccagaaacttaaaaggcatacttcattgagtcttttggagctgtaatttgacctaacaaattcattttctataaacgttctgtgttttgttctcctttaacccatgatttcagtcatcttcaaagagctctgtgagaagactggccttgattttattcaccagcttaaaaaggaaacgtttcatttgccatctttagtagacaatggttgcagtctaataattcagaacatgtaaaagaacaggaaactcctttctcctatggaaattttagcaacaaagaataatcctctctgacaatgttgttatccactaggggaaggaaggtgctgtttccaattgaggtgatggctgacatactcactatttcaccaccgtcctgttgcttaatacaatttgtacacacaactttattctacagaagcaattctcaagcttagctcagtgtttttaaaaaactgcctatgctttagaaaagtgcctagggagtttttaaaaatctagtacctggtccagtgattctgattttgtctaggacatagccagagcataatgattttttttttttttgagacagggtctcatgttgtcacccaggcaggagtgcaatggcaccatcttggctcactgcagcctcaacctccccagttcaagtgatcctcctgcctcactccccaagtagctgggactacaggtgggcaccaccacacccagctaatttttatatttttagtagagatgggtttcaccatgttgcccaggctggtctcgaactcctgagctcaagaaatctgcctgcctcagcctcccaaagtgctaggattactggcatgaaccactgtgcccagtcaagcatgaggattcttaaaaacattcccaggcaattctaatgtgttgtcaaggatgaacctaagaaaaataagcaatagggaaaggattccctatttaataaatggtgctgggaaaactggcaagccataagtagaaagctgaaactggatcccttccttacaccttatacaaaaattaattcaagatggattaaagacttaaacgttagacctaaaaccatacaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccagcagagcgaacaggcaacctacagaatgggagaaaattttcgcaacctactcatctgacaaagggctaatatccagaatctacaatgaactcaaacaaatttacaagaaaaaaacaaccccatcaaaaagtgggcaaaggatatgaacagacacttctcagaaggagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggccattcctcagggatctagaactagaaataccatttgacccagccatcccattactgggtatatacccaaaggactataaatcatgctgctataaagacacatgcacatgtatgtttattgcggcactattcacaatagcaaagacttggaaccaacccaaatgtccaacaatgatagactggattaagcaaatgtggcacatatacaccatggaatagtatgcataaaaaatgaagagttcatgtcctttgtagggacatggatgaaactggaaatcatcattctcagtaaactatcacaaggacaaaaaaccaaacaacgcatgttctcactcatagatgggaattgaacaatgagaacacatggacacaggaaggggaacatcacactctggggactgttttggggtggggggaggggggagggatagcattaggagatagatatacctaatgttaaatgatgagttaatgggtgcagcacaccagcatggcacatgtatacatatgtaactaaccggcacattgtgcacatgtacccttaaacttaaagtataataataataaaaaaaagaaaaaaaaaggatgagaagcactattctaaaaagaaacattatcctccatgccaacaaagagttttatagtcatttgagaattctactattagctttgtcttggcaatttccacacccattaaaaataataatattataggccaggtgcagtagttcacacctgtaatcccagcactttggtcgctcaggcaggaggatcagtggaacccaggagtttgagaccagcctgggcaacatagggagaccctgtctctaccaaaaatttaaaaattagccaggcatagtggcatgcacctatagtcctagctactccaggaggttgatgcaggaagattgcttgagcctgggaggtcaaagctccagtgagctgatgattataccactgcactccagcctgggcaacagagcaagaccctgtctcaaatgaaagaaatatctttttatatcaaatattgaatctagtgaatttaatatataaaacattgaatctagtgaatatcttttaaccaaactttaagaaataaaactttttgaaaaccaatgtgttttaaaagtggaaacatacatctgcactaaacgctgacatgactttttgggcttaatctggacactgagtgggataaacaggaataaagatgttgggttccttagattaaaagctaaagcctttctttcttgagtcctgcacagaaagatatgtaacaaaacggaaagcaaaggcagttaaattggcactcctatcagaataaagtcctgcctcagtcaatttgtaggtagatgccttagaatgatagaatgatagaactggaagtgaattgagatcagcgaatacagtgattctcaagtctagctagatgtttaaagtgctttgggtgcttaaaaaatctacatttgggctgggcacagcagctcacgcctgtaatcccaacactctgggaggccaaggcaggaggatcacttaagcccaggagtttgagaccagcctgagccacacagtgagaccttagctctaaaaaaaaaaaaaaaaaaaaaaaaaaaaaaaaaaaaaaaaaaaaattagcctggtgtgttggtggtgcatgcctgtgtggtcccgactatttgggaagctgaggtgggaggttcacttgagcagggtaggttaaggctgcagtgagccagtgatcgtgacactatgctacagcctgggcaacaaagcaatatcctgtctcaaaaaagaaaaaaaaaattgacatctgggtgtcaccccagcccaattaaactataatctctgggtagggcccaggcattggcattttttaaaaatccccacttgattcaaatgtgaaaccaagactgaaaacccctgggctcctgtcacctccacattttatggggaggaactagaaggaactcaaggatattttgataactgtgctcaaagtcccaccttagtaaagtttcccaatgtagtccagacagttgcatctggatccaagcagaattcactgaattaggtttggacaaaacttgtcccatgcaaaattcatactccagagtgacccatgaatttggataaccaaaaattgtccacattttaaggtcagaaataaggacattttggttgggcacggtggctcacgcctgtaatcccagcactttgggaggctgaagcaggtggaccacctgaggtcaggagttcaagaccagcctggccaacatggtgaaaccccatctctactaacaatacaaaaattaaccaggtgtggtggcaggcacctgtaatctcagctactcgggaggctgaggcaggagaatcgcttgaacccaagaggcggaggttgcagtgagccaagatcgtgccactgcactccagcctgggcgacagagtgacaatctgtctcaaaaataaataaataaataataaataaggacgttttatgaaagggaaaagtttcttctctagtattttttaattaatttctgacctcaaaaatcaaattagttcttatcccaaaacaagataaaatatttcctctacccaaccttgtcccctcaatgatttcctcacctcctgccacccacagcaattatgaagaaagcagaagacttttcacttattttccaaacacccactcctaccaggttgtcagccttcttctttaaaaaggtgctttgcactttagaagaaaaacatttgtgaggggacttttattgaagttaccatggtgaacaccactgactaaagaacagagcagatttcagccccaaagcaccagaacactggcagacacttaaggcttcaattagcgctttaaaaaaagtcatcactattttctcccactttgatttaacctattgtccccaactacagaactcttctaggtttcctacttaatgacagaggaaaagaggactttgacaaattgaaaatctcttgatgttatatgaattatttgctgaattattttgtgtataatataatctatgattaacatgaaaacaaaacacaatatcgtaatccatttttgcaaaccctgagtagtcttttttactaccacttgcaaagggtatgacttaactgctaatgccagtttttaatctcatttttaaagtcttttaatctcagttaaattaagagagatataaaaacatatgcacttttttcctttgctcaactgagattaatacatacctcacacccaaagtgaacctggagggaagcaatgccccaggctggaccctaagttccaacatgatttaggaatcttgtcatgcagggtggtggctcagactcattcttttggcctttgtgccagttacctaactgagcatgatgtttgtgccattattgatatgagggtgttatgggctgaactgtgtccccacaaaactcatgtgtcagagttcgaaaccgcagtacttcaaaaagtgactctatttggagacaggacctttaaagaggtaattaaggtgaaatgaggtcacatggatgggctctgattcaatatgactgatgtaagaatttgagaagagattaggacacagataggcatagagagaaaaccacgtgaaggtgaagagagatgacggccatccacaagccaaagagagaagcctccagaagaaactgacctttccaacaccttgatctcaaacttctagcctccggaattgtgaaaaaataaatctccattgtttatgccacccagtctgtgttgcttcataacgatggctccagaaaactaatatggagtgtttcttcactaaaaaaatacaaataataatattttaaaattttaaagtatcagcacatttcaggttctctaaagagtgacatatagatcatagaaatccattattttgaacagtgaccattatcacttatataatgattagaaaaattttgagaataaaaaaataaaggcacattcataacatgcttaagaaagttgttttatatattcttggggatattagaaatagctacattcagttacaaatcagagaattaataccatcactttttgaatgttttggtagaatgggctctcttgagagctagttttgtatcttcaggtttgaagaacggctcattcacccttggacaaattaaggccctgttttatttagaaaagttatctccctgaagcactacacttctgcaggaatgcacctagagatagaaaaggtggtagcagtagaagaagtgagaaatggttagacactgatttattttgaaggttgagttaggctatttttgcatcactataagtaaatatatgaggctgggtaatttataaaggaaagaggtttaattggctcacagttctgcaggctgtacaagaagcatggtgccaacatctgctcggcttctgctgagggcttcgggaagcttacaatcacgatgtaaggcgacaggaagccaacccatcacatggcgagaatggggagcaagagagagagaagacggaggtctcagactcttaaacaaccagatctccatgaactaactgagcaagagctcacgtatcaccaacggggtggtactaaagcatgcgtgatggatctgcccccatgatccaatcacctcccatgaggccccaccttcaacattgcaaatcacatttcaacatgagatttgaaggggacaaacgtccaaagcatatcaaaggtggactagtgcttcctgtaggatcgcctatggagtgcgacaaaataaggtactgataacttgtgatcatctggaaggatagagtaggtattactgggggatgtgagtggagtaggctttttatggaaaacataacacagaatttagttttagacatgtttaatttaaactccccagtaggtatctaagtgcatcatgccacaggcagttgaacataagggtcttcaagaaaaagatccaaactacagatataaacatgggaattatgagaatattgatgttatttataaccacaagactgagcgagatcactaagggagtgagtgtagagggaggactatggatacactaccacattaagagtattaagagtatgggtataagaaacattattcagaacttagaaataggcaaaataaatgtctggatattctttcagtgcagtacttaccaggcttctctttctatcaactggtctgttttacaactccatacgggcaaaggttaacttgtaggtttttgtctagcagggatgcaaacaagttctttctggcggagagataaccccaaaggtaacagttttgtatcgagaaatcttatcctaatattcttttatgaaatgtgtgagagtgtgtgtgtgtgcatgtgtgtgtatgtgtgtgtgtgtagcttctcaaattcttatacaagttttaacattttatgggttccctcatggattaagttaaataaaatctttgacatgagttcacactatctttgcctgagagtcataaattttttaactttgaaaactgggaaaaagggaaaaggagtaaccagctgaatttgcccaggttaattcaaaactaaaaaccagttcacacaatgtttttatttatgattgaattttctaaacatgccaaccttatgtttccactgctacatttcttatgaagtaatgctaaggagggaaaaagcttaagcttaagagaagaattttggctttttatttcacttttatgggcaattaccctctcctgttagcctcagcttctagacacacacacacacacacacacacacacacacacacacacacatccagtcatctgtttagtaatgttggagccaagaacagattacctgtagccaaatacaccactgatttttatatttctttacagaagtgtagactgactttgacactcaaactcttgaataataataaaggattgaaaaaacagaatttttaaatcattttgttacttttgaattacataggacaaaacaagagttttaagtaaaaaaaattatgtcagcatattatttaagatcattttatgtaattaatttatataatacctaaagtctattatcttacaggtaacttaaataaaattattgacttcaacatcataaaagaaatatctgaacagactttcaccgaatttggagaacgtgttttggattagctgaattaaaatgcaaactatacaacactatgggattcattggggcaccctaatgggcacctcagggagatgggcaatcatccctgaaactgaagtatccacattagaaactgttaactgcttatggaggaaaatacaccacacatattaacacatggtgaacagaaaagaaacacaatatcaagtacgagtttcaaatcaaaattcaccaagcagatgctacaaattttaggtgctgatgagtcattgtgctatattttgcactggcaactctgtagaatatgttccagggttagaactaccaaggactcatttaaataaacaaatgatggttcatacatctttcaagaggtgtagaataggccagttaacttctttgtacataaacagatggagatggaggacagaagggtagaaggatgggaggaagaggcagaaagaaagagatatttaggcttttcccattttaaaggtgatagtccctttcatttaaatatgtaaataaaagaaaatgtatttataaattacttttgtttggtcttataccaaatgaatattaatattttcattgacattttaacaatgtgttgtggaatcaaaaatggaccaaaactaacttcatgatctgatgtttgtaattcttatatttttattccttaaaatatcaattggattatttagatactcttcattttttgattcttaatgataattaaaataaatgtttacactactatgtatagacacttctcaaaaataacacattgttgctatgaagtgtttagtcccagtaaataaaatataaactgaatacaatttaaaattttattttcttttataagttggtttttaatgtattagtggtaatcatgatgcctcatataatgagatgaatgtaaattatggatctggtgagggagctgaatgtaaattatggatctggtgaggcagatgtgcagaaattacttcataacagtcaaaacaatcaaggtgttcatcatcactgtgttgggtagttaacaaaatgagtaactgaatcatataatttatctggttttcattaattggcatgcatactcacttgatgtgcttccagtgggctctaaacagtgcagctattaagtggaaactcttaataattttattttgtataatgctcttttagatggaaatagacatatttgccatttttgccttacaaagacaagaattctcttgaacacaatcataaaccctggatgtacaatatcactagtgagaaagtacagtttagcaataattttcaaatggtatgttgagacatgtcagtgggtcataagatcaaattacagatttgtaaaagagcaacttttataacatagtaggatggaagaaaatgaatagaatagaacacaataacaacaccaaagtgcactgtacagaggaagtattgtttcgtgaaacttgttttctatatgaatatgtttctgtgagtatacacactgggtcataatgtaaaatgtatttctttctatggttataattttttaaagttgaagtagaggatatcacaaaatatgggaaaataaaatgggggaaaaagaaagggatcaataag

SEQ ID NO: 357 - DNA, 156898 bp, Homo sapiens
tctacatacggcacagcctccctgggttatttgattctagctttcattgcccttgaagcattttgcaactctgtaaattgcagataactaatagcaatgcaaaatgcaaattctgtcctatactgtagaagttacactgacttcactgccacactgcagaaaaagctacttctgtatccatttgccatttgtaccttcattgcaactttttttttctttttttttttttgagacggagtctcgctctgtcgcccaggctggggtgcagtggcgcgatctaggctcactgcaagctccgcctcccggcttcccgccattccctgcttcagcctcccaagtagctgggactacaggcgcccaccaccacgcccggctaattttttgtatttttagtagagatggggtttcgccgtgttagccaggatggtctcgatctcctgacctcgtgatccgcccgcctcggcctcccagagtgctggtattacaggcatgagccaccacacctggccaacatttctttactcatataaacttgtgtggttttttggcttctcctttgaactggttataacacccttaccacttgcctcattaattagttaagtaaaatatttaccatgtactcgtttttatatttgagagtcatgattttaccttcgttttttaaaaaattatctcttaatggaattatgaaagcatgtcaaaagtatcttgcttgttactttctgaaggaccccaggcatgatctaactcaaatgaatgacttcaggcgtaattggataactgatgatgttctcagttgggtcctgagaagcacagccttgtcctgacaacttcctttcaaacactctgctctatccgggacaaagcatcatggccaaaggccccggtcccctcttcctggctggtcttctttactgttgattgaggaaaagtaattggcatataaattatatgattatgtcccattataatgtttccattatttctaacttctgctatgtctcgtagtttatctcagagctatcgccattaaatagctgagaaaaggcttgagaacatttgttttaaaaataataataaacatgtgatgtgatggttaatattgaatgtcaaattgattggatcgaaggatgcaaaatacttttcctgggtgtgtctgtgagggtattgccaaaggaaatattagtaaaatttgagtcaatggactgggagaggcagacccaccctcaatctgggtgggcaccatctaatcagctgccagtttggctagaataaagcaggaagaagatgggaaggacttgacttgctgagtcttccagacttcaccattctcccatgctggatgcttcctgccctcaaacatcaaactccaagttcttcagcttttggactcttggacttacaccagtcgcttgccaggagctcttggcctttgtccacagattgaaggctgcaatgtcggcttccctacttttgaggtttgggaactcgagctgacccaccactggcttccttgctcctcaacttgcagacgaccaatcatgggactttaccttgtgatcgtgtgagtcaatactccttaataaattccctttcatatataaatgaaatgcacgatatatgtctttatacgcagagcaagagcatgacacaattccatctttttaagcaactgatacacaaagatctcacagccaatccctactatacttggcaaaactactttttgttgtatggactctgaagtcaaacatcattcaagtctcattccaccacttactacagtatgtatttgggcaattcagtaacctccctgagcctcagtttcccctgggggaaatcatgctacatcataggattcttcctaaagtgtgaatgagatcacatggagattctggcactgtgcaggcactttggacgctggctcctgaattgttaactcctgacttttaggcctgcctaggaaaaatgatgaaccatgtcagcaagataccctgtcttcagaaaaatgatgactcattggcagctcttcagaacttgaaacacatcattgggaatgaagagaataaaggggaattaattccaggtttccggcagccatggatcctgtgtgctgaactcagcaagcctttgtgagatgacgacgtggcatcctgctgcagggaggcttgggccgttgcaatctgaccagtgcccagccgtccctgatacccagggtgaggactgtgcccctgaacaccccatggttggcagcactaggaccaagagacacagccagtgtgctggtgcccccctccccaaactgtccttgcttgttgcaagcagctagttcagttcatggcttgcggggagtctccctcaggagccagcatggtcaccagtcacaaagcctggccagcaccccagcagctggaggaagcagacacagagtagacacttcacgaattctagtctacactccccctcttccccacaaaggggaaaaccctgggcaaactttacggagccaacaatactcactatctacctggtgttcaaagccaacttgaatctttatttccttttgcttcaaagcataatacaaagagtgaaaataggttttccatcctactggaatttctaagatcataaaatgcattgctggttccacagtatctagtcataaaaaagactgctctggttctagggtgttgttgttgtgatgatgattttcccaattgttctacaatctggcagctgaaatcctgataaggagagtccgtgggccaacacagaccaggaaacataaaaataagaagaaaggggatctcaactctttgctccctggctgcataacttgagactctgggaatcagaatattagatcttccagggacctagcgtccttatatccaatctatatcaattagatatgtgaccttgcgtaaggaatatccgaacctcagttttctcatctgtaaaatggggaaaataattcctaccttatttgttaagaaaatcaaaagaggcttgactatgcagagagttgttataagcattttcatgtgataataatttaaccttcataaccccatttgacgggggaataaacaggcagagataggttacagaatttgcccaaggtcacacaacaagttggagacagagctgatgcaaagacacccctggtcaccaggagtgataatcttggatgaataaatacctatttgaaatgcttgaaacacctaattcttccaaatagtctaaaatgtcctctgcaatcttgttttcacccttcctttgtttatcaggtctttttttttttctaacacagataaggaaaaggttaaactccagtccaaccactttccaaatgaggacgttccaggctaactcaaattaacgaggtttacctacttgttttgccatattccctcatggcgcaagaatgtccacacagatcagtgagtgacccaataaaaacttggtcattctcctcatggcaccctggccccaagcaggagtataagaggatagagtcattttcctataacatgatccaaggaaattcatttcatcttggaagtggactaggctgatgtgcagagaaacctgattcagtcccagggaaagccagatacatagggattaaggatttgtggttgttaagagaacagaacttggcctcagatcccctgacttctcctctctctgtcttttactggtgagatacagtttggtaccagttcccaacctcttaaatctcaactgcaaaattaggaaataacagtgtcaaattttattgtttaaagtattattttattataacaccaacaaaagcttgcctttctcaggtaagatatcccagttcctgaagatgaaaagaagaaaacctgattctgggtataaaattctgtttctgtcatcagtgaacttcaacttggtcccctggcctcttcctcttgggatttgcttgctttatccttgtaaaatatctgtttcttctctcctaattaactttcttatcaccatgacactaaagaaaaaggtcattctcaggtcatcaaatgccactctcttgaaatctttatttattcaagaagctctgtaaattaagacagagcaagaactgggcaatgtttaaaaacctaattataaaaccattattactttagatagaggactgcagaccagagtgcaatgtcacccaaaatagaaacgtctttaaagaattgcaaaggaagaggccaggcatggtggctcatgcctgtgatcccagcattttgggaggctgaggcaggcagatcacttgagctcaggagttctagaccagcctggccaacatggtgaaaccccatctctactaaaaatacaaaaaaaaaagcaaaaaaaagccaagtgtggtggcacaccctataatcccagctactagggaggctgaggcatgagaatcacttgaacccaggaggcagatgttgcagtgagccgggatcatgccattgcactccagcctgggcaacacagcaagactccatccccccaaaaaataaataaataaataaaagaattgcaaaggatgaagccacagagctctgctaacatgcaccatgctgatcactccattggaggctccaaactctaagaggctcaggcttgcctcctctttagctaataggaaatgaagaggcctcaagaaactgctgggcttccttgggcatggaaatgaccaaagatgctatgaatggatctattgactgctcagatgcatggctggagtcaagcacatgacagtcaggtctggcagccctgggagccattctgtctctctaaggcagaggctttacccattttttgacaacacatcttatccccaatatctatttatttgtttataaataatatagcactagtatattccgtagtaccacctgcaaattatatagtacttatatgctataaacattatacgtgcacaaacatgaactgtctaaggaaatacaaagaaaaatctgaaaggtctatattattttcttcttttgccccagaagatctctcaagcaccattctgaggcaatggttctcaaactttgtgtaaccaagaattacttggagatcttgcttaaaatgaaggttcactgggccttgaccctagtgttgattccattactcagtattcctgggatgggcccataagttgtcattgtctgagctccccagctgactcttattctcatgctcaattggattttgcagccactgatccagacccttgtgttttcctgccccttacattttttgctacaattatatcactgtggtcttattgttatctacctcctggacaccttcgtgatcccctcagtgaatttaaacattaaaaaaaattagctaccattaattatttcctgtggcctaggattgctgagggcttcacatgcattgcctcacttaatcagactagggaggtattattagtcccattatacaggtgaagaaaactaaagctcagtcacaatgtcttatccaagttcactcagctagtaagcacaagtgacagactaggaattcaagcctgtatctgtcggattcccaaggctggactctttttttttttttcttttagagatagggtctcactctgtcacccaggctggagtgcagtggtgtgatcatagctcactgcagcctccacctcctgggttcaagtaatatccctgcctcagcctcccaagtacctaggactacaggtgtgtgccaccataccaggctaattttttggtttttatgtttatatagatggggtcttgctatgttacccaagctagtcgcaaactcctggcctcaagtgatcctcctgcctcagcctcccaaagcactgggattacaagtgtgagccactgcccactgcacccagcctcaaagcatggacccttgaccactaagtatattgcccacaaaataggtcattataatttattgaccctctactatgaaccaggcacttggcttgacaccttacacacaaatctctaatattcatggcatacctcttttcctagaggtattaatttcagtccagagattctgatgtgcaataaatttctctattctctgtaacccatctaaattcctgactcttaacccctattttcaggccttctggatttcttctccccaccccacccccaaccccagtagttatgccatagttctggacaaatacaatagccaggcatggggtcaggggagtgtgacctagtcctctgtcatcagtccacattggtggccactgaggggcccatcctcccatcaacatgacctgctggccccagagactcactgctctcccaccctacatcaagccaggtatatcttttgcccatgtgccaacacagccatttcctccctgggttcttctcttccagcaggatttctgggaagcaaggtactgtcccctctgctctcagacccatagacaaacctcccccttccacaccacctgcaaagcccaagagaatgtctttctagtgatggcaaggtgaggggttccttctcccttcacatcccctcaagaaatgttagtcttttgcttttctttgttggctagaattcacctgcccacactttgggaggccaaggcaggaggatcacttgagcccaggagtttatggccagcctgggcaacataggaagaccctgtctctaaaataaataaaataaaataatataaaataaaataaaattcacttgccctaaggtcctatatttttggaagacaaaagatttgtagccttctctctactttgcccctcttaagtggaagggagacagtttgggagaaaaataagttgatatctcaaaatattatctcagatacatgttgtccccattttataggtgaggagattgaactcattaaggttatataatattatatacagcaagtagataggcctaggacccccccagttcaggaaatctcatactctgtgaagtcctcccctcttccctgccagtagcctccctggtcagcttcaagaaaacacaacagagcttgtgcattaaaaccaccactggaaggtcagacccggtgatggggcaggctggaagagcttaggtagaggtgaaagcagacaacaccctgaaaggggacaggtacccactcctccttgtcattttccaggagagccttatagaatttgagttggcatgagatgatgttagaggaatttggggtggtgcaagtaaaggaactacaagagctagaaacaatcttgaaggcttcttcccatgttgaaagtgttcttaccacgtagaaagtggtaagaaagtgtactctgcagaaatttggggggcgggtgggggcacacggttggtatttcagaggcacttggattcactggtgtcttttgatgagtttgtgtcccgaataaaatggggagtggcggtggttactggcagtacccagaggagaggagatgagggtgggcacaggggagaggagcccgagatgggtagccagctggtcttacgtgccagctttataggaaaaaaagtggaactttcagattctgcttaactgtgcaggagccagccaagtatccaaggcagaagtccttgctcagaaattgtatatctgatgggcacggtgactcacgcctgtaatcccagcactttgggaggccgaggtgggtggatcacaaggtcaggagttagagaccagcctgaccaacatggtaaaaccccgtctctactaaaaatacaaaaattagccaggcatggtggtgggcacctgtagtcccacctactctgaaggctgaagcactagaatcgcttgaacctgggaggtggaagttgcagtgaaccgagatcgcgccactgcactccagcctgggcgacagagcaagattccatctcaaaaaaaaaaaagaaaaagaaaaagaaattgtatatctgacgggatggtccgcaagcttcggggcttgggaggaaggtacagtcataggacagaacacagctttagactgggtcaagatcgtccaagtctggtggtggcttcagaaggccctttgaatgaggctcgtccaggcaataattaccatgttatctaattttgcccgcttaacgtttccacttggatgtctaagagccatctcaaagccccacgtggccaaggctgaatctctaatcttcccccaacagacctgcttcactcacagcttccccttctcagctgacagcaaccccattaatctgcttgttcaagccaaaaaacctggaagtcatccttaactcctctctttctcccacatctcacaactcagcagtcagaaaatcctgtgggctctaccttcaaaatatatccaccacccatccaccactccgcagttgccctttaccatgctgggccacgccaccatcacctctcactgggccactgtaatagccttctaacagatctccccactgcaccctggctcacttgcaaaccagagtgatattttaaaactataatacaaatcatatcacccttctgctcagagtcgccccccatgtgtcaatgcataaaagtcaaagtccttacaatgtctccccattcattggcctccttgctattcctggagcacaccaggcatactcctacctcagggcctttgcacagactgcccgaagctctcctccccaagacgtccacaggggcaactccttcacttccttcaaacctttgctgaaagtttaacttcccaatgcaattcactctaaccactctgcttaaaatccctaccttctccccaaccccctgcttttcttgtagtggttcccattacattctaccagtctacctaatttttttttttttttttttgagacggagtctctctgtgtcgcccaggctggagtacaatggcgcgatctcagttcactgcaacctccgcctcccaggttcaagcgattctcctgcctcagcttcctgagtagctgggattacaggcactcacctccacgcccagctaacttttgtatttttagtacagatggggtttcaccatgttggtcaggctggtctcgaactcctgacctcgtgatccgccctcctcgcctcccaaagtgctgtgattacaggagtgagccaccgctcctggccagaaatctcttctttattatgtctactgtccgttatccaactccagaaggtaagaacctccactgatacataaggacttgtataccccacgtgcctgcaacagtgcttggcacctagtaggcataccaaaatatataaatgttgaacaaatgaagaaagttaaagtaaaactagaggtccaaaaatatcacaaaagccatctatggtcgccttttccctacctgattttgctgagtggccttacttttcagtcctctacacagctggaacattaatgaacacagagggggaagaagtgtgtttactctaggatcacctctcaatgggtcacttggcaagggcatctttgcttcttcgtcagctccttttgacacgggggtgaagggttttctgcaccacactttgaccacaagcatcaccaatttcactgaacccaacagaaatttggaccctctgggggctctctgcgtggcagggcccttttctttttctttgggcttaggctgcaatttgaaacaccactttcctgagccagcatcccccttgcagcgctgtcacagggaggcttaggcagccacgtggaagccacctaccccgacctttggcagaatttccaaacacaacacagtagctttaagttgattaatttggaactctgaccttggccccaaaaggtaagaatacataacaaggtattttattctcaaaatgtgtcaggataagaagcacttctgtaaatcgacctttttaaaatagatataattagatttgcagttgggggcagtaaagaaagggtctgaacagtggataacatgttgagaggttaattattaatgggcagtcttccctaacaaagtatctaataggcattgtggtctctttggcttcagaaattaccaagaaagcctggaccccgggtgaaacggagaaatggacacaagtcccctgtgtttctccattctgttggttttatgcatctttatccaatcaagtgcccttggacaaagcctgaaaccaggtaagagcctgacttttctccagagatgggcatgaacttttctttttaaaacgtgtgtcacaaagaatccaggggtttctgactgtatgggacagagcttgcttcagagcgtgccaggtggttctatacacgacctcacaggttcacagggacacgtagccgtttgtaaacagaaatgaaattttagaaaatcatcctcggattaaaagtcttctaagagtgcctgcagctagcagtgaagtctcttgcgtatctgatatggaaacagtcatgctaaaagttattcagcggcaaatgatatgaaagcgattcagatcttcctgagagttaatgtggcatctaatttgcaaccggggagccaggcttgcaatgaaatgctctgtcgggttggggttgtctaattgcctgcctctctcagaagagaggggaatttatgagagttctatttccagtcaggtctaaagtagagatatcattgcacaatttctagactttgttttgctgccaaaattttagtctgaggctgaagaatccaacagccgtcctgcctgttttgtttgtaaattcacaaactagattgatggcgaaagacagatcaaatgccttatcaggaaggtagtagagtggagcccagcttccaggctaagcagtggaccaataaatgacggatcagttaattgaacaatttggccagactagacaggtgtttgggaatttgttttggtactggttactggtcaggagctagtaacgctaaggtagagtctgagatttttcttttctctaagactagccttggagagagctccgacaactttgagaattagaaattccctaacgggatgtacctaaaaatttcagaagcttttttcccctttaagaaaaaggctgttcctttgtatttgactattttacttcataggccagttaataactgagtagcagtattaattattgccattcactaagtattttctgtgccaagcactatactaattatttttgacacatcatctcatttataaagccacatccaaaaatgacccttacataataatttagagccatacaggtaaaattgctggtaatctttattcccttggttcatagtgattttgctaaagggcctttcctgccctttgccccggaatgttgtatttgtttgtttactttttaatgaagtttataacacacttctagaaaagggcctctatcataaatcctcaatgagttctcacaaactgaaccagtaccccaaagccttccttgtgtgccccttgagccttaacatatatgattttttcctttggggagatttttcattaatagaaacacatcagttgctcttttgcgtctggcttctttcgttcgacattatgtttgtgaaagtcaaccatgcagtttcgtggagttgaggctcattcattctcactgctgtagcattccactgcgggaccatgccacacttcctttatccattctactgtggattggccaggactgtttttgcaatggagccatgggaattggaagctgtcagtgctgagatagaggttgaagggagggatggcctcccccaggcttctgggtattgtccagattttccttgagcaatctcattgtcctgatcagcctgcttctttccccggggcctagtttgtgcaaatgctgagagaagtggccactattagcaagagggttcctcagaaaagaggatccaagtcaggaggcctcttgttctcttggaagcagaatctcttggcagaattctttctgcaatgagtgagcccaatctgtgtgcatgtggctggtatgatgtctttctggggaaaccgcagggaagccggtgtcctgtggtggagcccttgtcaggaaagtttctacaccaatggttctcaacaggggcaattttgccctccaggggacacttggcaatgtctggagacatttttggtttttggttgttaagaccagggagagagtgcttcccttccagcatctagtgggtagaggccagggaagctgcttcacatcctacaatgcacaggacagccctcacaacaatgaattgtctggcccaaaacattattagtgcagaggctgagaaaccatgatctatgccaagcttcaactgtcactcatcgagcaccaggaagtactccctcaaggacccttcctctttagcccctcctcccagcctacttcttttgagtatttattattaatgacatcttactaatggagtcactaatgtgctgcacacccagcatgtgccaggcactccacggacattttatctcatcctcaccatatggttgagtaagctggcagttaagtgccttgccggcggtcgcatagctggtcagggcagagcagggagaggtacctgcagcctcaatctgtctactgaggccgcagtgctctgtgtcgagcccacacccagtgatttgacagccagaggtttctagaaaaacattctgctcagttcctctcacagagagggagatttagacagttgttcctgcccttcagcactaagggggactggatagcgtgagctgcttgaagcccacatggcacatcacacttatgcccagccccaatgcctgagacccaggttccccagtcggtgttgccatgagagccaacgctgctcctagaccctggcaagtcccaccttcccggtactgggcccactatcaacaggcaccttctccctcccctccaccccagcctcagcttgcaaatcctaggagcagctgaaagctacctattcagtcagtccctcatgagtgtcacaagcatacatgagcacctgccatacgtaacgcagtgcctgagtacaactcacacactctgttcacacgtttcctctcttaaaaatcactgaggaccccaaacagtgtttattatgtgagatatcaatatttccttcattagaaattaaaactgagaaatctttaaaatctgctaacactttttaaaatgataataaacccttgcatattaacacatataatgtaattttatgaaaaataacttgtattttccaaataagttttaaatggagaagagtgacattgttttacaaagaaatgttgcaaatctctctaatatctggcttcccaagacagctggattatcttacctgtttctgtactcagtctgttgtgatgtattgctttgtttgaaatgtaggaagaaaatctggcctcccatagaggaaaagggaggacatcctaaggcgatctccctggggccttggcctgcaaaccactgcgcttgtgcagtgggcactgtacaacagggggctgcacagccgtccccaccttgcaggaatttacagtcaaatggggtgggagtggggtggggagggaatagggggccatgggactgggtggaggggggatgtgccatcaataaaagagcaaccgtctgtggagaatttaaatacaaatataaccaaaagctgatctgcctgtcattatcacaattataaagaatgtcagccgggcgccgtggctcacgcctgtaatcccagcactttgggaggccgaggtgggtggatcacctgaggttaggagttcaaaaccagcctggccaacatggtaaaatgccatctctactaaaaatacaaaacattagccaggcttggtcatgggcacctgtaatcccagctacttggtacgctgaggcaggagaattgcttgaacccgggaggcagaggttgcaatgagccgagatggcgccgtcgcactccatcctgggcaacaaagtgaaactccatcccaaaagaaagagtatcagcgataaaggcaaagctctttccagaaaaaaatggttttatggcctaagttctaaacaatctccgtggttactgttggattttatgtagtaagtatatgtaagcttcaaattcatcacatctttattatttatcctttcataaatattgtgttctacattgacattaatctggagaactcccggttatgcacttggccccaacatgcacagactcaggggcgtgttcttgttgcaagagtaagtgtgcgatggttcagatcctttgacgtccttatgtctccaacctcagtggcacttattacctgcttctgcatgtaaacagtagatttgaaacaaaaaatgatagcgtagtggttgtacaaacaaaaaaccagaacttgaattatttcaattctctcatcctaggtgacccctgtaagcttctcatatgtgtttaaaatttaaagcaacaaaacagattgtgaacaatgagttgtaacatcttgtttgataggtaaaaatttggactcatacgaaaaatatttttactgcatttgaatatcttaaagttaaaatgtatttgtctttttaaaaattgttcactgctttataactaaagaagaaatcgagaaagtagtgatgattgctgatttttacataaatatgactgaaaatacttttgtcttatagagcagagggtcattaaaatgatccgttctgtgtgtcaaatacatgaggtataccactgagtcacatatgtaaatgttatcagctagaacagaacatggcatgagatgaggaccatgagagaggaatgagtagagaagcagattttacttccaagtggagggaagaaggcttcttggaggaggcggcatttgagtagggtgttgaaggatggtatccggacagaagagaatgaggctttccttgtacaatagcagaggtacacagctgataaagtacatgtgcttttcaagcccaaatacctttcaaaaaagaccatctaggaagaaaaagaaaaaatatcccatagaacggtgttgatagcaacacttgttaaactgcaacaaactggaaacaatgtgaatgcccaagtgcaaaccactgaagttggggactccagctactgctaagtccaacttcgaacaggcatggttttgaatacctactactagaagtcacagaaacttttgggggcaataatgatgaagttcagaaacaaaagcctattgctggcccctaagcactcacagtttaacaccagggatcttagcacagaggatgggtttccaagagtcgttgagcctcctgagatggtgcccaaggctgtgtgtgtgtgcattttgagtggggagcaggtgtcataactttcagcaaattatcaaagggacctgtgacctctgaaaaagctcagtaacaactggtcttgcagctttgtaaaacaagtataagaaaattgtatatgcaataatgtagggaaaaaaaaacaggactaaataatctacatgttgaatcataattatgaaaacactgtagacacatgctgtatattgctagagattctaagtatatttaaagatatataaagggttttaaggtttggaggatttaagtacttaaatgtacaagaaaaataaaataaaaaggccctgatcagctacagttagattggtcatcccaagacgacccccgggaaagggattttccactgtccttccgacctgccaccagcacccaactttgcaggttcagccacactcaaaatcactaccccagcagggtctgtcagatttctgagaggcctccacagttacatggaatgtcacccatgactaatatttgagatagagtccggagatgaaactcattcttccaagagtgcgtactattctggaatcagcagagggccagcccccagcattccagggaaattctatctttcccatgcaagagaccctcccatccatggccatccttcctagccctacagctgagcaggtctgtggtcctgctgaaaggtccaccctggagagacgggggacagcagcctgtcctccactctgcttgcctctcacagagacccaggactggaacccatattctttcattctgagctggagagagaaactgcagggctgacggttgaaggcatggggtctgtaagctgacccgaaaacatgaatcgccaaatgagtgcgcagccaaaagccaagagaatctggtacctggctacccacgatggccctctccctgccctcctctccacatcagctgccacagtgctgcgggcatgctgggtcatcacagttggcacagcagggagagaggcagaaagaggctgggccccgagacagggcagaacagtccccatttcatcatgaggggaatgcaaccacccaggcctcagcctgggtgtccctgacagccacgggctccacgtagaacagaggtcacagcgattctcacagccaggaaggtactgtgcgctggcccccaggacagtgaccagtttcgagtggggcgctctcagctgggaaatggggtccaacccaccagggaaaagggctgactaggggccaataggaccctccagatccctgcccagcaggctggacttcagtcccaaggtgataactagaacaagggggccgagcctagtctgtccagcagcgggtggaggagccgcggtaagaaaggcagtcgggtcttacattcaggtacctacttggggcgagaagaccaaatccagtcactccagccctggaggagtcagggcgcccacccggctgccccacagaaggtgcaattcctaaacatggtcacaaagtagcgcagtgacatctcagctgcttcggagttccaggagagggtttctggctcaggagaatggagtttctgggtgactggaagatgaggctgttggctaacttccctttccttcccacttaggggtctatttccagaagcattcctcatttcattttttccccagtggggcttggctaggggtggggaggcatggggaaaaagtgaagagaagagaaggaaatgcatggaatgcaagcggaggcctctttgtctacagcgttttcacctccacttgtgcaggttcatattcagggcctggtgaagtcagttctggcacggctctccagtggactggcagtggcccttaaaaatagttctcaggaagatgtgtaggtggcgacgctgagtagtgtttatgtcccaacatgaagagcaggcctcattgtgtgtgtcctgtgattacaactgtgtgaaaatacatgtgtttgagaaaaaatgctggaagaagatgcatgaaaatgtttatacgtccgttgagtttgtatctgaacttttgtctcttcccctctttatgtaatgttatagtatgtatatggtatattgactttcatgatttaaataatcagaaaataaatttactacgaaatgataaaataaaggagtttgactagatcagtgatcctggaactgtagtgggtaatgaagcacctaaaaggctgctttttttgtttgtttgtttttcctgagacggagtcttgctctgtcgcccaggctggagtgcagtggcacagtcttggctcgcagcaacctctgcctcccgggttcaagcagttctcctgcctcagcctcctgagtagccgcgattacagacacacaacaccacgcccagctattttttgtacttttagtagagatggggtttcaccatgttggccaggctggtctcgaactcttgacttcgtgatctgcccgcctcagcctcccaaagtgctgggattacaggcgtgagccaccgcccccggccagggcttattaaaataagattctggggccctaactacagagttgctgattcagtgagcctggggtagacttggatatttacgtttctcagcagttcccaaatgatgctgctggtgtggggaccacagagaaccactagagaaaaaacaaaagaaccaagacttgaaactaggttactgacttccaggctagggtgcttcctacagaaacaacacgaggctacagggcaaacctcacttcacttctaactttctagggttgaaggggtgagaatcaacatccactgctcctggatactgacttcttccccagtagctacaaccccaaaagtatttaaaaccccaagatatttgtgaaaatgtatttgtccaaaataaaatatctacatgctaaaaagaaagcagtccttgaaatgaacaaaaattcccaagctgagcattacttgtaattggtagaaaaataatcattgcaaaagctaattaaccatccaccctgagcggctccttggcaggcctgaaaatatgatcaggaaaattcttttcctatgagtgaggcattatcaaagcagggcagagcctatgggttatccgttgactaggactgacctttccgtgactgccaaaaactttccagtgacaaatgttccagcttccttgtcccaagagaaactaaagtggtaagaaaacaaactgctttatactgaaacataacaagatcaacagcagctgtgacagcatttattaaactgtccgctgtgtaccaggccccatggtcagtaggaaagtatatccctgagggtacaaaaatgaaaaagcgtacatccactcaccaaggacttcccactgtgccagggtctctagccccttatggggtgtgtgtgggggcagggaggttggagattgggagaggcgcataatttcaacacaatgcaattagtttgtaaataacactacatgcaaaatgttacaagagccctgaggcagcgcaggttagctgagaagcctttacagaggaggtgatatctgagttgaatcttgaagtttccttcaagaagtggaaggacattgtaagcagagggaaaaaaaacatgaaccagccttgcttgactcagaggctggaaaagggagagtgaagttgggaattcttgagattttggggtggccctggatggggtacataaaaagaagtggccagagggaaggacaggaagggccatcctcagaagttttgtcctcatcctggaggcagggcagaccactgatgaggggggttgtttttaaaaggctgcctttcccagatggattgatagacttatctcagcctggctaaaaccctggccactccctgatagagaacaaggttcccagcaggcaagggcaggggtggggcccagcagggaccagttttgcaagctcacctggccctacacccgcaaacactcagcttttcctccaagacaagcctcaaggcttggagcaagtctctttgaagttttcttatgaattgctatgcttaacactaaatcatgggaaagattaacacccatgaaactgaagcaggagcacataacaggagcttaatatgaatcttccatcttaaaaatatcttattctacatctgaaaagagaaccatttggaaattccacgtcatactcacttatagacttaacagcaatttcaactttaaaaattcattcccacctgcattatatgacttgattcttacagtagccctgtaaagaatattgggtaggaattcttattcccattttagagacgtaaacattcaccatccgcggaccatggggaacacagctgacatcaattgcaagtcagtttctgtggtttactgcagcaagggagagctcactccagacttgggcttgtgctggttgagtctaaggaaggggtggaaagcaaggggaattctggattggattctgtcaaaaaggagtccaattcaatgattcggcatcataataatttaatagttatcactaattattatttaatataatcaataaatgatctagcagatgggaagatgaaaacagggctgagctggctttgatacagcaacacaagtcattcctgttagtcagaagagggaaatgtttagtcatgttttttgattttggagtggcctcctccctgtcttgatgcaaacacagatgtggagggtctgtgctgcacatgtttctgttcggtgggcattgtctctgttcacttgtgaatattatggtctggctgacggcagagctggtttttgttgctgtgctgtgttttcgtgtagtctctcccaaagggacttggggaatgcgtttgaggtctcttaatacctatgccctagctgcacagctttgggtgatgccctttacctccttacctctgatctctcaggagtaatagtgtcccttccacactgacattctgggtgtgaatgggactgattagaatggtcatcgtggtgccaggagatctgcagtggtgaccttccctggtatcagctatttaaatattatcaggaaagagaaatgtggaagcaaagttctatccattttaagcatgtgaccttttaccctaactgaaccttaattgactcatttgcctctagcaattcaaagattcccagacacccggaggacaaagatgggattctgtaagaacagcccacgcagtcaatgacccttatgccatttcttgcccggaactgttttattcagggcctgacatgcagcagtgtttgattaagtgctgacaatgaaaataggtatttgatgctgtttggaagaaaactcttacatttcttgaattgaactaagatgtacagaacaacagaaaccattatttttaagaatatttaaatgtgccaagttctttgcctatttatgtcaatgaatccagaaaaacaccctgtgagataggtattatccccacttcacagatggggaaattgtggctcagagtgttgcaaactctccttagaccactcagctaataatttcctctctggtatagctgaaacatgggcttgcctgaagggcagaggcagaagaagcctccaaacctcccaaggtcctgtgattctcattgatgcctacttctagtggttctggtgtccctctcagagcccacatgggtatctgagccttcagagatatctcatttggtttggggggttgtttttggtttttctgagtctcgctctgttgcccaggctggagtgcagtggcgtgatctcagctcactgcaatccccgcttgcagggttcaagcgattctcatgcctcagcttcccaagtagctgggattacaggcatgcaccaccatgtccagctaatttttctgtttttagtttagtcggggtttctccatgttggccaggctggtcttgaactcctgcctcaagtgatctgcccacctcagcctcccaaagtgctgggattacaggcctgaaccactgtgcctggccgagatatcccattttggataggggagcctgggacatattctcaacttccgtgggtctggccactacttatcagaagtttctgctcaccttacacaactgtgagtgatggccaggagcagcctcagtggcccaaggggaaaaacctctggatgaagccctggacccctcacatctcagcctccatcactgcccctggctacccaaagtcaagcccagaaacacagatgtgagcacaaacccaggcagcccatagaaggcacagccctgtgatgtcaagcttaaaaattctgggctacttttaaggtcaccagggatatttcgaaagagctgaagctttttcctccatccaagaatcctctatcttccaggttgtttttatgagctgaagaggaccctccacggctcctcggtgacttagtagtatcaagacaacacctgagaaagctcctttcatgcaaatctctgtctcacgcatgtgaagagaccaccaagcaggctttgtgtgagcaacaaggctgtttatttcacctgggtgcaggcgggctgagtctgaaaaaggagtcagcaaagggtggtggattatcgttagttcttacaggttttgggataggcggtggagtttggagcaatgttttgcgggcagggggtggatctcacaaagtacattctcaagggtggggagagaattgcaaagaaccttcttcagggtgggggagattacaaagtacattgatcagttagggtggggcagaaacaaatcacaatggtggagtgtcatcagttaaggctattttcacttcttttgtggatcttcagttgcttcaggccatctgggtgtatacgtgccagtcacaggggctacgatggctcagcttgggctcagaggcctgacagtctccttcctgcctgcgacacaggtctaggaattattccacagttgggcactcttggtgtattattgttcatgccctggcccccacctttgtgccgcatagagggactccccttcctgaggttaatgattgggaaggtgttaaagcaggaagaactgcaagaaggcactcgtgagtgagcctatccactcattcctggaagataaacaaacgaccagtgtggctctccatactcagagggtggtttctggatgtcagagatttcgccacacaccagctctgtgccaggccttgtgctaggaccccaacatggtcactcgatattcacacagtctagcagtctgccaggactgccaggacagaggaccacagactgggtggcctcaacaacagaaatgtattttctcacagttctggaagtgagaagtctgaggtcaaggggtcagcagggtgggtttcttctgaggcctctctccttgtcttctgatggctgcgtctcttctgtctgcacacagtcttctatgtttctgtgtccgatctcctctttttataaagaccccagtcatattggattaaggcccaccccagtgaccttatttcacccaaatcacctctttaaagactctggctccaaaagcagtcacattctgaggtactgagggttagaacttcaatgtatgaatttgagggaacacaaagttcagcccattacacccagcaaacactttgctaggccctgctgtgacccgggtcctgggcttggcactgggcatacagtggaaactgcaaatctctctttgttctatttgagcttcagcaactctccggaaggcttccgcgttagaaaaaaggcttacaaatacacaggaaatttgaaagtgagtagtaagtccacaccaggcccagacagggggcctgtgctgaaaggtgcaggaagcagcagccctgctgagacacacaggagccggctggccggccgctagcagggtgggatggggagtgggggctcagggagcctgggctggggagaggcatcctccctcttcaacagaatgattgggactttctggcagcataagcaataaccggcaggagaccaagaaggcgccgtttagctggctcatgtgtgagtgagtgatgaaactcaccctctggcttggcgccttatggaactatcaactctgcatgggtgtgctcagtgtggaccccaaacctgctccctctggctttgagaggtatttctcccatacaggctggcttcagccagggggttgcctagactcgcccaggcctcagacgaggggaaagggccaaggccggctgccactttctcatcatgtgcctgcctcccttcccacatagaagggtcaagcccaaattagaagggtgggatgatggctggtgcctgaggacagagctggggctaggaggacaaactcctgggctcctcttcatgtctgggctacaagatcctggcataaacaggggctcctggcacagcggaaataaaccatgggtccctgagggagactctgggtgagaaaagagacccagatttggagttgaaagacctgggcctgagtcccagctccatcacttcccagcacgtggccttgaacaaatcactcaaggcctgcagacctcggtcagtcattagtaaagagaagattactattatagagaccccactgggctgttttgagggtgaaatgagaccacgtaagtgaacgcactttgaaactatccattgctggtcacaaaactaacgtgtgtacgcatctatttactaaatagtcatataatactcacccgattcatatgctactcccagtgtttttctctactttttattacaaaagtgttcaactacagaaagaagtttaaaggatacaatgaatttccatattccctccagatagactcaataactgtttgcattttcgtatatttgctgtatgtgcatatttatatgtgtgtgacttgtaaaaccagttgagataagagggggaaaggaagagagaaaaagacacacacatacatatcccatatgaaagttgtggacatcatgatacttcaattctaaatatttatacgctagtatttctttctttttttgagacagagtctcactctgtcacccacgctggagtgcagtggtatgatcttggctcactgaaacctccacctcctgggttcaagcgattctcatgcctcagcctcctgagtagctggaatgaatgcctcttactaaggacattctcctacatagccccagtaccatcaccacacctcagaaaattaaaaataattttatactatccaatatccagaccttactccaattttcccagttgtcccaagatagttgttgatagcgtttttcagactgggatccactcaagatcctcctgttgccctgtttgctgagcttctgccatgtctccccagtgtctgaggttgtgagcatcttggttacttgctgccaattctcacactcatctgtgctgcccaccgtcccatggcctcttgcggacctctctcccatggcgctggctccttgcacccagctatctgcttgcacacctctctccctgctggaggataagcaccccaagggcagtggccagtcttagctactgttgtttccccaggacccacacaggcctggcatggagcaggcacgtggcaaatgactgttgcatgtttgaatcttcatcagagggctaagcaacacacacctttaaaaagtgagtgagttttggccaggcgaggtggcttatgcctgtaaccacagcactttgggaggccagaggcaggcagatcacttgaggttaggagttggagaccagcctggccaatatggtgaaaccccttctctactaaagatacaaaagttagccaggtgtggtggtacgtgcctgtagtcccagctacttgggaggctgaggcaggagaatcactcaaacctaggagggtggaggttgcagtgagccgagattgcgccactgcacccagcctggacaacagagctagactccatctcaaaaaaaaaaaaaaaaaaaaaaaaggaaatgagttttaagtaatttcatctgacaaattctgtacccctgccggagctcatggaaagcatcccagagacccaggtgacctagctcaggccctgccctacttccccatctacaagtggccactggggctctgaaatcgcttggactctcgactagtctgtgctcgacatctgtgacaggaccatcgactgagagggagagctgccctccagaccacaagtcttctctggaaaacacacacgtatatgagaagttggctgtgttcccattataggtcttacagaagtgattccaagtcttgtgagtttctgtggaaccagaaaaccacttccggaccagcaggagtgagaagaggcgcatgcatatcatgtttgcattgttttcttgcatgtgtcacttcaccacaatgctcaggacctcaatgagagttttaagttctcccagcttcaaattgtgctttccaggccagagcttctcaaaatttaatgtgcctttgaatcatctggagagcttgatacaatgaatgtttttttaaaagtagatttgggatgggctccaggatcctgaattcctaacagttggtctgggtgacgccagtgccactggtccctgaactacactttgagaagcgaagttctaaaggtcacaaaacaacttctcatttcttcagtgaactggtaattagcacctacagctaaatataaggcagtgttctagcactggaggaacaaggaaatgggaagaaatacaaagaagaataagacacaggcctttgactcaaatccaactggatatccctttatactacgtctagcattttgcttaagtgggacctaaaaagttactccaagctgcctcccctagggtcttctggctgtttctggtaatgtgtattcctgctgatgctcaagccctttgcaacaagttcctaacatggtatcaaatactgggcacactagcaaacttcagccataaattagggcccaaatgttgtcaccaaatggctgtgtgactttggataaatcactctcctctcacgtggactagggttgggagctcttcaagtcccttcctgtctgccaaaaggtttctaagcagtttccaagccgtttcttgcagttttcccatcaagccaggtgaaggcaagtgttatgtccccatcagggtcccccagccccctcttcttagctcaggactggggctttctggggctcacctacagtcttcctcctttccttcctaacttcacacgcatttatcaagcacatactctgcatcaaacctgtgctcaaggacagggaggcaaaggtcaataagatgcactccctccctggggaggagacctaaaacagaccgcaggtgccctgctgcgtggctggctcaggctctcagagtgtgaaggagagcacctcactcagcactggcagaggccggcaggcctaagtgggccttcaccatatgccaggcctggctaggagcttccctggaagattccaggtaacgcccagcaaccctcaaaggaaaatgctagtattgtccccattttaaaaatgggaaaacaggcttaaaaagtcagatgtctggcccaacatcacacagctaatatggattcagtgaaatatatgcaaaaatactcagcagagtggcaagtagtaactaaacggtaactaaaatacctttttcaaatgacagaacagagagtgggggccagtaatctgcactctcagacaaaactgacaagtgggagaaaggcttgtctaccctgaaggacaaaaaccaggcttgggactggccacacatgacgagaaaactgtgagaaaagaagcaggagagactttggaagagggcttggcaggccggaaagcgctaggtgcacacgacgggcagtgggggctcaaacacaggtgggagcccaggggaggagggagcgattagtcatgctggggaggctccaagggccctttgtccttcctagatggctactcagacgccagtctgcgagcaccccacgctcagctgctccatgcttcagccaccatgcaacccatctggataatggactgttatgaagcatgttggcagccatcgattaggactaaactctatgctcattgggttgtatttgcaaggatgctctgctaagatccacagcagaggtgcatctctctccttctcatttgatggcttggaattaaaatgccacccaacattctctgccaaagacatgaagatttatgggtcactgtcaatatcaacacatgctggccattatttgagtctccttgctgcttgggactgattgctatttactttgaaagataaatgtggctttgtaatccatgcaggttgctgggaggaatgggttttaaatgcatttgttcttttttttttttttaagacagagtctcactctgtcaaccacgctgtgcagtagcacgatcctggcttactgcaaactccgcctccagcttctcctgcctcagcctcccaagtagatgggattacaagcttgcgccaccgcaccctgctaatttctatatttttaatagagacagggtttcgccatgttggccaggctggtcttgaactcctgacttcaagagatcccccctcctcggactcccaaagtgttgggattacagacaggtgtgagccaccatgcccggccttgggttttaaatgcatttgtttcttcccttggagacctttctattccactccattctgctttgtctggtgatgttggtcccaccctgtacccaccatcagatattctaatgtcctccgaggctctggaacaaagaccagagggaccagcctgtcctctgtccagagtcatcagtatgacagtatggagagacccttagcaccttagtagaaaaattgcccctgtcttatggggtgacaccactcatatatgatctggggcaagagtcaagacccccaaggagcttacttaaggagcaataggttgtcccctttgcctcttctggtctttcgcgtttctgagcgtggtgtggaaactgagtcaggagctaaatcagttaggtcactggttctcaaacttgagtgtgcatcacaacccactgaagagctttttaaaacacagattgtggcccccactctagagctcctgattcaataggcctagggtgcggcccaggaatgtgcatttctaacgatgtcccaggtgatgctgattctgttgctggtcctgcatcccacctgaagaactgcctcagaacaagagtgggaagcattagagaccaatcatgggagagatgaggctgctggcagtgtttggcacttgggaaaaagaacagcaccgtctaaaggagaattttattaagtttcagtgaacaatgtgcaatttaaatctttttgtaggaaatcgtcagttaaaggtcaatttccataagtatgtggatctatgtattttggaaatgcattgaaatgttacatgggtctgggaccacacaagctacccactggtggtctgctatacctaggtactaggaaggtcaaggtactgagtaggtcacagtcttgccaccgggatgctttgctaactttattgagtgaaagtagtaagaaatgcctggtattgataagagcccaccgtgctagtttttaccaatggtccctaagcgattttccctgcagcagtcagggtttacaggtaaaactgggcccagggcaataaaggggtacagtctaaggactctgggagtttcctgatgaatactagaggtctttggaggcagacaactttttctttgcagcgggacttcacattataagccatgatgaggctgcaattgcgatttatcagtgctgccttccttccccaggcaacgtactaggaagaatcatggtttactgaaggcaggctaccctccccatcaaagcctagtggactgggcaagcaatcggttgggattcattacttggaggcatgtatccccagagcaatcaaaggccctgaccggcacaggattgggaggctgttgctgagacccaggcctcgagtgacaggtagagcagtggggtggaggaaagtcaacatatttggagatacgaaaaaggcaggtaagtaattgtattcgttgagactttgggtcacaagaataataatccaaaccaaattaacttgtggggaatttatttactcatgtaacatagatgtccaaattataagcttcagggacagctggatctatgaccttaataaagtcaccatgtttcttcattcgctccccacccccttctcccttcataacacttcagagtgccagattcctcagtccttggaactcaaacttccagagagaccacacttcatcacatacctatggcacatgttccagaaatgattctggccaggtgtccacccctgaatagatggccacaggcaggagaatgggatgtctgattggtctgatttgggaaacatcctatccaccacttggataggatcaactttacccaaacaggactgatcaggatccacatgggaggttcgctcctttggaggaggagatgccagcagaccgtggaggactggctgtgaggcacgaggatgagcgggaggcaagggcggctcctgcttccacagaggcgagcaggaggatgctcctgccctgctcacacagctgtggctctgcaccttgctccccgctagaaggtgggctatcgtagctaagctacctgggcagagcagacctcgtgagtgtggggaaaatcctgggcagcataacagactcatttgtagggcaaagggattttcagttagttctgtaacacactggagaaccaacacaatgctcaagcatcgttcctcccagaggaagcagatgggtgagataaataaaaccacactttcattggcatcctaggatgctcggggccctattttcaaggctgtgtatgttgaatacacatttcagtgatgctttagtctattccacagtgattctcaaattgtggcccccaggccaacagtatcaccatgccccgggaacttgtttgaaagacaaattctccatcccactcaagacctcctgaatcagaaactctgggtatggggcccggcagtctgggttttaacgcaccctctgggtgattctgaaacaggcaccaaagtttgagaacgtctgcctataaatgtatttgatccaatccatcaagttcaaagggaccacctactataaaaactaaggcttatgttcagggtttattgagcagtctgaatttagaagagtgtgaacgtgaaacagttttctatttctcccattccagccttcagccacgcactatcaagttatatgcttccatccctttatagcatcctgggcagattcctttaacttttggtcagttcgattattaagttattttactttattctaaagcctcaatctcacatctgatttgacattcttcccttctctcatgagctagactcaaagaagatggaatctgcagtggggaggggataggatagttctgctctttcactcctcttttctctggagcaccgtggggtagggtggagtgggatggggtgggagggcagggtgaggcctggtcctgggattgctgcccctcatttttcagagcccaacccccatgggactgggagctggtagtgagggtacagctgggggacacagaggtcctcatctcttgtgagtggtctgctcttgctctggttcactgtggtcccatctgctgctggtggccttggcctgtgaagatgtggatgtggttttctgagggccctatcggtgtgagcccagcccatttgtcactaaggacagctgtggccccttttggcttctccaaaggtccatgcccctcctactctgtcctcctgtacaaagtctcagaaatgacttcggtcttcttccccgcctctgaggattgatgggagctgaggtgtggggacccatcccctcaggtacactgcctcatagtatttcttctccccgcttggctgagcctcctctcttcagatggctaaaacaggcacaacccccacgttgccacacagtcccataaactcctatggatacaggtcagtctctctccaaaactccatcctcatatccccagcaccacatgggacctagaatagcaacgtctcagccagcatacagcctggaacaatatgaccatttctgcctcctgcaggcaccctcattccgcattctcggtaagtgattctaatcggtcccccaacttgaactctagagactaacaatgggaagaagagaactaaattattctcccagcaattcctactctccctctcccacttgtctgtctaacatgggctgggggaaggtggtgatgggaatagagactgcttctttgagagccctggagtttgaagaatttggccccagttgctggcaactctcattacagagtgtgggttccgtacattggcgcggtggcttatgcctgtaatcccagcactttgggaggccgaggcaggtggattgcttgaccccatgaggtcaagaccagcctgggcaatatggtgaaatcccaactactaaaagtaaaaaaaaatcagccaggcctggtatagtcctagctactagggaggctgaggtgggagaattgcttgagccacagagagcgaggctgcagtgagccatgatcatgcacagcaagaccctgtctcaaaaaaaaaaaagaaaagaaaagaaaaagaaaaaaaatggatagaatgtgggttccttagcacctgttgtttcagcagatgtcctggtgccacatttgctatttgcaatgcgtcttcacatacattatctcagttgaccccacagtgattctgtgaggtgtttaacctataaggaaacaggctcagagagattaagtgacaagcccaaggtcacacatgcagaggtgatggcaagatgggaacccagcccagtgactcctgagcacctgttctctccctgctgtttcatgcaggtgcctcagccacacttgtcttccagctctgggtgaacttggagcaaataaccagagaaatagcttgtctccaaggccacagagcagctggcaggggagagtttggggcaagggatttccttagggaaaacaccaattcgttctggtcatgcccagtcacatgggtcccaaccatcaccttcccaggccaaggtcttaggttcccctggaacccctttggctttactcccttcctgggctgggggaaagggtggggatataagctggtacttccaaagcagaaagctggggtttggggctgacagagctgaccttgagcttgagctccatggagtacccagcccaggtcaaatggggtcaggaagccatctgtgccttctggatggctctgtctgaatgattcacttctgcctatggtgggtggaagttcatggttttactcccacatggtgaccacagtgcatggcaattttctagtcaacaggtggggttggggcctctgctacacacaagaggcttctttcttcaagtttaagacttctgatgctcacaagaccctcccatgcccttaccacgtgcagcgctcacccccagggcctggggtttggtgagatgtgtcgcccacatgggctgggatcatattttccccagggaagatgaaagccctcaccctctcacaaagccaattgctaaattttcaagaattttgcaagctgatttttaaacatagccattattttaaaattacattatagaacttacaatgaaacaaatgtttaaaatgacagtaataaatactcaaaactcctctgttctcattttactattgtctctgtctgtaaggttatttccgtctgtcgtactgtgtggtggaaatactattcaatgatacaccaaagtgaatctcttcccaactccgttatcagtaacatcacagtgggagcttaacagcagccatgatggctgtatttatacatggacattggcaaacattatagattagggtttgatgtattgttttgttgactgtgtaaagcaaggttcagcaaacttttctctgtaaagggccagacagtaaatatttttccttttgtaggccataggtgtctgttaaaactactcaactctgctattgcagcacaaaagcagccacagacaatagacacacaaatggacctggctgtgttccaataaacctaattcacaaaaacacatggtgcaccagatttgtcaggccatggattgctagcccctcatctagacttaagagagccatagaaaaaaaatgttagtaatgaagattaaatttagaactgtcccaattgtaactagcacaaaacattaaggaaatattcttccagtgctcaaaaacaatgatttgattgagcaaagaattcatgtcattgttgaatgattgagtttcaatgtgtccttatttcatttttgtcttcttcattaatgtaaataaacctgtcagccaacctacacttgtcatttgccaccataggttgactagtgagacaagggtccaacaaacatcagcaaaagtattctgtgaaaatcaattgctatttggagtttacaataaagaatactgtatatttcattattatttataaattgtataataccttgatagcaatgaaatgcacaatatatgcatgtatgcgtgtatatatatatgaatatattttcttccagagagccagttgctgagtatccaccaatgcaccactgcctgaggggtgtctacataaaaagagacctaacagcccagagcagcacttgttaaggacccaaggcatggtccagaccccaaggaagggaagggggtcagggatggatagacaatctggaaagttctccaaggtggtctgagaaggcttcatgggggacagagagccgtaaagcatggtaggactcaatgacaaatgaagaatggctgtacttcagacaggcacacagcatgagcgcaggaggcgaggctgaagtcagggacaccgagacaagagggtgagcatagggaagcagaagggaatgaagtggggtcaaatatatgtaatggcatggaaacatgctatgagatcaagccaaaagaaaagaaaaagtagaatgcaaaattttacatttgcattaaggaaaaaacacgttagaagaaaatgcacttaaataaattgctctgtgtgatagtatgatagctgattatgtatttatcctcaatgctttctgtaccttcctgttgttctgaagttgtattactttgatattcatggggaaaaataagcttttccagtatgaagggcaaaaagcactgagccaaacctgaagccatagctaaggacagggcacatctcccctgatgcagcccagaggcccctggagggaggtgctggggggtgaatagagactaggggtgtcactccctcctaggaggactgcaggagcacatgggtagccaatgctaaggcctcctgcccccatgggcctaagtagccctgtccacactggggatctgcccgctacctcatagcctcaggtagatgtctggtctctctttgcaaatgtcccccgcaacccatcacattcataaaggcaacaaattggggaaaacgagaggtcctctgtctttttagggcttcaccactgctgttttcccaactaaagaaatatgtacatatgtttaagtatactttaccatgcgtagaatgggaaaaacagaagttattctagagaacatctcgctcaactcgtttattttactaataagaaaatagaaactatggaggtcaagtggcatacccagggaaacagagctaagtgagaactaggctccagcagagatgatgcccagggccgggcacctcctttgtcagcatgcaggtatcatcagacaaggccaaaacagcactgggcgatgtgggctgagcagcccttggcttcgaaaacatgatttttttattattttttgagacggagtttcactcttgttgcccagaatggagtgcaaaggtgcgatcttggctcaccacaacctccacctcccgggttcaagcatttctcctgtctcagcctcctgagtagctgggattacaggcaggcaccaccacgcctggctaatttttgtatttttagcagagacagggtttctccactttggtcatgctggtctcaaactcccgacctcaggtgatctgcccgcttcagcctcccaaagtgctgggattacaggcgtgagccaccgcgcccggcagacatgacgtattctaagcactcctcaaatttacctgtggacagcaagaaggcctacaaggcaccccgtttacgatatgccacttggctccttcagggcagagctgcagcagcagtccttgtttctctgtgccccacatcccctcagcatgtaagaccacttctgccccacccattgctgaatgggaccttcagatgctatcttctccataaagctttctatgactcaggccgcatcattttgtggtcaactactttcactattattgtgtttattctccctaaaccagccaagcaatcccatttggtaatcgaaagagcaagtagcactggcttggtcatttccttcacataaacctgactgaactggatatatggtaaggatttccatcttgtacataaacacttgtccacctccgtgattcacacaattccttttccactctatcccgggcccatgtctccatcctgcccctgatgctggctctgcaggcattttctacatggctgtctgtgtacatgccgtgtggttagtcttaaatcaagggctcctagagtgcataggacataccagtttatactttttctcatcaggaatatgtgtagctggaggattaagaaatacattttcatgagctagacaataacaaaaattaaatggcaaaagtccttgctgtccttagtagctagggagctttaaaaataaatacataagcacctgtttccgtttttttactcctacagaagcagggaaattgctggagaaaaaaaaaaaatgtaagtccatatattctgtactgtgtcccttggaagaataaaattttaaatgaggtcatcaggaagtgcttcctaaatgtgaagttcacagactgaactttgaagtttagcaatggacttcccctgagcaaggtcggcttatgctattgttagaccagcagctgagcctcccccaccacgtccttctacctcttgcaattaaagcacagcccaggcaggtttttcttaaacaggatttttctttatgttggtgcatatgctgctgttataatagcagggacattgtcctcattcccagctctttcctccaagtcaaaacatttagaatgacaccacccaaagaataagtcttacttgaggctttgcaacctctaacccttcccacctctaaccttttcccatctttatccccgttatcttgggtgctttcagttttcagagaccagctttccaacagggctaaataacactctatggtttctttccccatcagaaaccaaagaactccctgtttctcagcccttgccagcagaatctggtcacccctctgcccctcaaaattacacatcttatacaactagctcctgtccctgcaccattcctgtcccttgtccttgatcctggtttcccagtggaacaggaaaaaggttttacagagggttttttgccaccatctctttgttcctcaggagatgattaagttgtgcgttaagtggggaaaaagtacattaggtcaaccccaaaatctgccatcgataacatcagagtatgtccatggctttattagttttctagtgaatatttaagagaaaaaggtgctaggtcatagaacattgagaaggctatacatctccccttggctataggtgcaatacattccaagagggagagatggtagtcatgcctcctatttttttaggtgaggtatgtattttgtagttctgctgggacaaaaacagctttcagtcattgaaaaccaaaggcccagtggacatcaggaggagatggcctccctcactgcaagacgacctctgggtcaaagcctagtgaaactttggcttttcccagcaagcaggaagtgacatagacagtgtctttttagagacctcactttggagaatgctcagtgaggggcaaacatttgctggtgacattgtagttctgtcctttgctaagcttgagtgaaaatcttttggagaatcgacttttttctttcttttttttttttgatgtcccttagagagctcacaataaataaataaatcaaaacaaagctaaaagttcataaaaaagtctcaggcatggtccagattttcaggaaaccagcagtttctggaggaagtcccacccgctcctgaaaacagaaaaaataaacgagagagagtccaccagcaaacaggtgtttagtcttctctggagtcatattaagcaatttttacatttatggaaaagcaaacactccccccacatagggtgtggcccacactgggattgaaaatcagcctcgtgctctgcaccgtgttctggtggcttctgcagctgtcacaggaaggaatccacacccgtccccaaggacgcctgcacgggaacagatgcccgctcccttaccccttgggggaaggacagaggtatctgagggattcagccctgggcactcctctcagcttcctccttcacaggcggggccctgggaggccctgagtggggccactgcgttgctatgagatcagaacggtagccagttggtgggtgcagcaggctcacacctagcaagaacctacctctccctttttcctaagaagggaaaacaactctcaaggctcaccctggaggcccaaagggaaggctgtatgggtcccgtactgcagcttccaagcccacggtggttacgtctgagcaccctgtagggctctgctctgaaagtcttttcagctcccaatgagcattgttcaagccgatgaacatccccaaaacccttccactctcagggcctcggccccacccaccacctggcatctgtctttaaggatgtttataacagagttctgaaataaagttttggctttttcctggagttctaactctgcaggagaagcagtgaggtaggactttgaggaattcaggaagtggagaacagctcatggtgagaggaaaggctggggccgacttgggatgtggatgtgcaaaaggaaaggtgaaggctggatgggaggcagggtgggcacagttaaggtgggccctgggccaggatggcctcccaaccagagagtagccttcaacatctcagcctcgtactgcgtgccagacactctaccaagccctccacttaggtaataatcacgtcttccaccctcactctcaccctgtaagggagctcttagaataacgctgctctccacggctgggaaacccaggctctgatgggtgacatcacttgttcaaggtcactcagccagtaagggccaggctgggctgcaaactcaatggcccactgcagagctcacacaggtccatttcctactcgccatgatgttttccagggagagtttagagaagctctggagctgggaaaagagggcagctgttagagaacagccagcgagaatgggaagtcaggagacccagagctcaggaacagacttccttggcaggtggcgtagtcccatggcctctttagctctcagttttctcatctgcaagaggacaatgggccagattggtgcttctctgagagaaagtaccagtggttttgaccaagggactgacccgaacatggcatgtaagaggggtttgtttggggttggtccacaggatggttacagaggaaggaagaaagccaccaaggccaatttgaagatgtgcagaaacccagaagtgaggtgaggacggcagttctcaagtgcagagcttgaagtggtcactgctgggagggagacgtcataacaagacccaggaaacacttcaaaggaaaaactaacagcatttaaagattggctgcaatagtaacaataaaaaaagctaacatttactgaaggctataccagttatcccaccaagtgctcaactaccaatcctcacagcagccagctgcaggaattatcattgctcccactttatagataaggaaactgaagtttatagaggcagagaaacttgcccaaagtcacaaagctggcaactcccagagccaggatttgaacacagtctcagtacagagcctatggtttctttgtttttgagacaaagtctcactctgtcaccaaggctggagtgcagtggctcgatcttggctcactgcaacaattgcttggctccctggttcaagcgattctcctgcctcagcctcccgattagctgggattactggtgtgcaccaccatgccaggctaatttttgatttttttttttttttagtagatatggagtttcaccacattggccaggctggtctcgaactcctgacctcaagtgatctgcctgccttggcctcccagaatgctgggattacaggggtgagccactgggccccgccacctatgttcttaatccccgtgcaactctgcctcctatctatgtgccgaagaaaggaacaacactcccctccagacctctgcctttcacacccattggccttggatgcccttgtctccccccggttccgattcccttcaaattccagctcctttaaactttcacaccttactctgtccacccctccacacctgcctcgtgctgtccccccgcccccacatcccactccacccccacagttcaaacctgctcatggaagtcctggaatgtgttttctccctcatcctcagtcccacccatcacacagcctgcactggatcatccaagttacatgccaaatgtctgtacccctctgtgtccaagtgaggcccaccttcctctttgcttctgtcatctattttcctgtttcttgcatgcattgcactgtgttcattatgtctattgttgactgcttgttcatatttccaccttccctataggatcgtgagtgctttgaaggcagagagaggctgggccttagtacagtctgtttgcagcacatggcatatagtggatgctggagaaatgttgatgactgaattgacatgattgattgattggatcaaatgaatgaacacaagaataaatgaacatcgggatccaggaaaggggtccttctggcaccaaccctattctgtccccctaaacagtattacatttagtgtttatgataaaggctttcagcacctttttgaagagttggtaccactggtccactttctgccctgcccttaatccatccaattggtttagatactcacacatacattctttctttctctctccttcccttactggaccccagaccaaagccaaagaaataaatgtcccctctcctgctctgtttccacttagataaattaatcctcagcatgagaggaaccaaagccagcaccttagaagtcaggctcctgtcagctcggtttgctcacctgcacacagcccttgacttcctcctcctgtgtgggaggagcacagccctgactcagaggccactccaggcaatcctctcctcccaggcaatcctataaggaacccactggctgagctctggcctctcggcagagggggcaggcctgaagaaccctttccaagaccagctgagctctgctggtccgctgggccctgcctgcagagttattggcggagttattcttggtgctcattagcactgcacaggctgtggattattcctttattgctaagtggcccccagaacactgcagactcatccctccttttgaagtccttgtaaaagactccaagaagtcgattccaatctcttctctcccagcgtggactgcccctggagcagcactgggggtgtgtggctgttagagtggcagccaagggccagctccccagtgaaaggtgatattgtgcttctaccgcacacctgcacgttgggatggtgtttgccttccggcctgactgctctgttctcatcttccatggacatggaggtgggaggggaacttatgtgtcattcactccagggtcctgatggccacttgcgtagagcaaagaatgttggtagggcctgcagtctaggttctagcttcagtgagctctggggcctcgggaaaagggcttgatccctcagaacatctgcaggagtctgtgacccagaccacaccaagctttcagaaactgctctgctcttttactctcccactcctctccaccctctcaagctgtgctatatccacaatgcaccagcccaggctgactcaacttcccgcccactgctcccctttaagctacagcacccaccattttgccccaaactcgtctatcctacctgagctcctgcagccagactgggtcacccatgcccctcctctaaccaggaaagaaaggaaagaatccatcaggtcttttctgtgtcctgagattgcgcaggtattcacccgctccactcccatctccttgacctctttcttgccctgtttctcggcgacctaggcattgggtcctggtcagttttccacttttccatcactcccttaggacccctcaacctctctgctcatcaaaaaagtccaataaaggcattcatctctttgaatacttaattttacagtacctcttgcataactttcaagtttgaggtcaatacaaataaaatcatttaaaatgtctgatattaaacacttctgacccgaaaagcaaaaagccttttaacagatagttacattgatacaagagtccacaatgacaggtttcaaagatgaaagtaatggatcagtaaatagaacagtagagaaaacacagatgaaaggcaaataaccccacctgaaaaatccaaagctttcattttttttgaaaaaaaaattgtcaaaagcactgtattattttttaaaatcatgataaaaggagcatgcacctgtcaccctcccaaccccctctatacttgcccctttctatctttaagtgctgtggtctttgtggtgactttattggctcaagtttcctaggctggtactctcagagcctggtttcctaggagcagtactcataacgcaggtgcgatggacacctgtaggtgggtagtgccgcctgtgtgaaccaactcggctccaaagagcctaactccctatctgcatggttaatccaatcaaagcccaacctgctttcccacacaacagagttcaacagagcttttcattaaagcaacacatcatagcaaatacttaactagtacaaataaagcattttatttaaagcaaggtttaaagacatataaacattaagcatcagagctccattctttagttgctattcatcacagcttatgccagtccttgaattctgtctaacttgggtagtagccaattttctaactcaccttcaacttcttgggatgagtccttcccgggctccttgtttttctagaaatttcagtggcttgaccacacatcaaaacacacagggtggccaggcatggtggctcacacctgtaatcccagcactttgggaagccaaggcgggcagatcatctgaggtcaggggttcaaaactagcttgggcaacatggtgaaactcggtctgtactaaaaatacaaaagttagctgggtgtggtggtgtgcacctgtagtcccagctactcaggagactgaggcagaaaaatcgcttgaacctgggaggtggaggttgcagtgagccaagactgtgccactgtactccagcctgggcaacagagtgagactctgtctcaaaaatggggagcgaggggggagcccaccacacaacaaaacatatagggcttctcatctaaagtccgaataaaagaataatactatggctggtttgcactggaggaaagaaaagccctatcactgctaccttacttttctgatgttttgggttcctatgtcttatcccctcaggaaccaggggaaaaagaagattctgtgtcaagtgcaccctacatctgtccatgtcaccccccttcttccaatcagaacaactcatttcccccacttgactgctcccctaatctttgcaccttggagcaggatgtgtttattgattgatggatatttacttataattggtacctcttatgaaagccaacagtttttacatctggcttttaacacagactgtgctcttcaatagtcttagtgtagactgaaggtttttcaaattcacatttttagaaaagagttccattaaattccacatgaacaacagaaaaaaatttaaatgggacattacagtgatcaattatagattgtaggacatgactgacatgtagggctgggctgggaggaagagacaaagaccaaatgctcaaccaagggcagaggtgaggtgtagattacgggtcagaaccgtaacataacggatggagtcccaagtgaatccaggaagttggaggaagcaggtaagtacttgggttaggcattcacaggcctaggaagtcagctggggcaggaaggctcagacaaggcaaggggaccaggaagcttggacccgtcctgggaagatagagtccaagagggcagtcatcaccggtcccacactaaaagcatcaaagctctctaatcttctgtcttctctactctctctggtgtgttgtcaaggaaggaataggtacgtgggaaactagggagacaatcatagccctcgatgtctaccgtttctaattaatacagggcagaggaattagatcttttggtagagatctaaaattcctctgaagttctatcaagccccatctcctgatgattcagtgctagttctaaaataggaaaacttacttccaaaaccaacagatgtttgggctgtcatcattatgcctgtactaaactcacttgtgatttcactgtgaagtcctgtctgtgtaatttattaggaatcatttatgtaagattatgtagaaaatgttactagtcgtgagatatctatccatctcaatgatttgacttttacagcaatgcgatgggacgtgctgagggaccatttggtcaactttccacctaatggtggtgtgattagaactcctagcgggtgactcatagagagtgattagaagtaaaaaggttctggaaattcccccacactctttaaggcagcctttgtcaggtgtcttagtttcgtgaaaggtagactgatgttttccatctggtatacaaaacattttctaagtagttatagaaccttgaacaagccacttagctctctgggcctgagttttctcatcttataaaattaaatccatcaatagatcacatgatctctatggcttctttattctaaggatgtatggtaattttaaacacttggttagccatcttgaccaaactagcatcacaggtaagaaacaagctgcgaagaccaaaattcttctctggtttatacactctgggtcagaggcaaccactttctatgttgtttgggctacttttccctaaacacataatggctttgtctgcatcaaaggtcatcttctattttcctgcccattcatatgaccccataagaccttccagcatctcagtcagctgagcattttacctcctgcaaagcacatggtttccttcttctctttgcaggtcatatgaaatgctcacacagtacttactgtaatcacttcgtaaagttgattttcacatatcttcatccagaaaattatcccaactgttatatataactttattctaattgaataattccagttttcaagacacttttcagacacccattgtcttgtctgaatcctcatgacaacctcatttttttatagattatacagcattcctacttatatataatagttataactttttattcctaataaactttggcatgacgtttcatcagattctgatagtttcttttgtttttcattcattgcattcccatccaaatgtttactgaccctgggaaataaatccagtagaccaatgaagcatgaatccaactcacagagggtggttagaactaaaagctgaaatggacttccgtgatcacctgacccactcatccctgaccgtaggctcttgttcacagcggccaaaacgtgcatgtctctcaggggcttcctgcttgtggagcagaacctttgcttgcgggctccttgtgtctgtgagctcctcagaaccgctcttgagctcacagtgcctgatttgcacgtattggtttccgctccgttgcttattctggtcccctcatagaagcaatgttatcctttcttcaaacccgtcctttcccagagagctttgcagccacttttaccgggtttaatgagtcagctgcagagtttatgatccggtactaggccttctgggaagcagctttcctgggcttacgtcaggctgttaaagaccctcctggccttcctgccgacatttgctcggctactttttcctcctaattaatgcctctatcttatcagagtggcccattctcaaatgcagtaaatgagtccttgatgttctatgttttattttggaaacttcccactctgctcatatctgaattggtatttgctcactgttgcgcagtggtttgcctaccaggtatcccttacatcaaatcctgtccgccgcttagaaaaaccacagctaaaagttgtttggcaactcttggtgttcacagggttttcccactgagggtcagggactgcacagcggttgagagcttggactccggggtcagctggaactgcttctaacacaaggaccgctcttaacaaagaactgaggcttcctaaacttcagtttctgggtctgtaaaataataggacccacttcctataaatgttgagaagattaatgggaatgatgcatgtaaaatgctcggtacatgataaaagcccagtgattactcattatcccactcaatgcttggggaaaggcaaagcagctaatattaccccagattatagataagaatactgggttcaaaagagatcacttggcttacccttgtctatactgcacctgcatgaatcatggacctgaacccaggtcacggccacctcccagacccttgctctctctgcttccccagcagcgcctctcagagtgaacacctatgtccatgacagtgattcccaaagtgttgtccccaaaccagcagcatcagcatcacctgggaacttgttagacatgttagggtctcaccccagacctaatgaatcagaaactctgagaatgagggcccacaatctgggttttagcaagatctccagaagattctgatgcacacccgtttgagaaccaaagctccatggaatactaatttgcctttggatctagccctgccgcccactcgagatggatggtccacaaatctcaatgtgattcctaacatgagttaagctgtccaaccctgtgacgttatcaggggatttgtgattaatacatagtgacaccatttaactgtggcagaggttcttacccttggaagctcattagaatcatctagggaacttataacagaaaggcccaccccagaccagttcagatctaaagacagcctggactgacaaccacagaactacagagctgccacccagactccatggaactctgctaggctggtaatatttttaattcattaagggtttatgtgtttaacaacccaggtccagtaaattggctcctttcctccctatgaaccttggacactctggctggtcaagcctccacctcatgcccacttgtttgcacagctactaacgtttatgaagtatttgcttaatgtacctaagctccactgcccagagctatcccacttgatctgaaaacgtcatgatgaggtatggtaagcattaaacattagttcaccatagttctatttttttctaataacttaaacggcttcagggaacattttgtgtgtgtgtgtgtgtgtgtgtgtgtgtgtgtgtgtgtgtacgccttaagagactggatctcactctgttgcccaggctggagtgcagtggcatgatcgtagtttactctaacattgaactcctggcccaagtaatcctcctgcctcagcctcccaaagcactgggatcacaggcatgaaccaccatacccaccctaaggaatatagttttttgagcatgttggagtactcagaactctcagctcagctcttggcccacttgggtctcaaccatttagagtactgattaccaaaggaagagcacaaaggaagaaaatcagcttttctcctcttcctcagtgtgggagaggggatttggcttgggctcaaagccatagtgatgctttctgctccaccccctttcaattaaagatcaccagcttcccaaaaacaggccaccctcattttccaacctggctcaggcagggaagctgagaagcttggggctgcccattcacccagtcaccaggcagatagacaggtaagagaactgggaccttcaggcctgccctcgggaggactggccaccaggctttacagcccagagcagagaaacactgtggccgttgcaaaactccttgagtgaagtgaccctaccctctactaaaaacgtggcccagtggattccagttactaacaaagctcgttgagaagatgcaagaaaggaatggaacaatggctaggacctccccgcggcagcacttcccccaagagaatagaggagctgatgggcacgtcacatttttctcaatgctggatgacattccatcaccttcctcatcttcatggaatttttttttttttttttgagacaaggtctccctttatcacccaaactggagtgcagtggtgcaatcatgcctcactgcagtcttgacctcccaggctcaagggatcttcccacctcagactcctgagtagctgggactacgggtacataccaccacacccggataatttttgtaattttttagagataaggtttcaccacattgcccaagctggtctcaaattcatggcctcaaacagtgcttcgggttcagcctcccaaagtgctgagattacaggcatgagtcaccgcacccagctggaatgcattctttgaattttaaaagactgtaaatgagagatttgttcagagaagagggtgtttcctatgtacaaaaccaaagaccagcttttattttttattaggtattatagtcacaaaggtatgaaagggtatatagtaataagtctaagaaatttttatgaagtttttgaagtaaaaagcatttttataaaattttaaataaaaattttaataaaattactcaattgttaaatgtaacttaaaattactttttcataaaattactcattttataaaacacatttttcctactttgaaaagtagtacatgcttaatacagaattggaaaagacaaaaatacagaaagaattgcatttaactccttttttttttttttttggtagagacgaaatctcgctctgtcacccaggctggagttctgtggcgagatctcggctcaccgcaacctccgcctcccgggtgcacaccattctgctgcctcagcctccccagtagctgggactacaggtgccagccaccacacacagctaatttttatatttttagtagacatgggatttcactctattagcagccaggatggtcttgatctcctgacctcgtgatccgcccaagtcaaaacttcagattttgccaaacaccttgaaagtatgagtagatagaggaagactcgtccttttgtctgcctccttttcatcttcctaatacctaacacctctctaatctttctagaaatgggtaagaaaagcttccataaagaaaggtggagagaattgaagcatggtagtatttttgcaggagaaattataaggtttgaaatttatggaggcctcaggacatacccaatgacctaaggtctaggccagagatggtaagtaggattttttttttcttttctcttttttttttttttttttttgagatgcggtctcactctgtcacccaggctggaatacagtggtgtcatctcggttcactgcaacctctacctcccagattcaagcgattctcctacctcagcctcccgagtagctgggattacaggcactcgccaccatgcctagctaattttttttgtatttttagtagagatgggggggggtggtctcaccatgttggccaagctggtctcgaactcttgacctcaaatgatccaccagccttggcctcccaaagtgctggggttacaggtgtgagccatcacacccagctgataagtagctttaaacacaagtgaggattctattccatcaggaatggctgctttatgcagaagaactctaagattacatcaggctaagggtgacagaatgctgtaatccattagccttatctgtcatggtcatggcagcagcaagaggcagtctgagtgccatacactgcagtaatctaggggtgagctgaatagtgaatggagatttgcctaaaagaaacttctggagtcagtgctccaaaactctgaatcaaccaaatgaatgaattgagccaaatagaaatgcatgactattcaatatttattatgtagagaggcttagaaagggcaggcacctggagttcctccaccctcctcacccaatcacaactgcccttactgccctaccagtccagccacgtgccctttcccacccctctcaatgacccttgggctccccagtgaagctccctgagggcaggggacatagctctttggggccataaaggcattagctcacccttctcagccccttacacatttactgggtacttagatcaggccaagtgtggtggctcatgcctgtaatcccagcactttgggaggccaaggtgggtggatcacctgaggtcaggagttcaagaccagcctgatcaacatcgtgaaaccccatctctacgaaaaatacaaaaaattagccaggcatggtggcacgtgcctgtaatcccagctactcgggaggctgaagcaggacaatcacttgaacctgggaggcagaggttgcaatgagcaaagattgcaccattgcactccaccctgggcaacagagtgacatttggtctcaaaaaaaaaaaaaaaaaaaaaaagaaatcttagcaggattacatctgtaaccccggcactttgggaggccgagggaggtgaatcacatgaggccaggtgttcaagaccagcctgaccaacatggtgaaaccctgtctctaccaaaacatacaaaagttagccaagtgtggtagcatgcgcctgtaatcccaactactcaggaagctgaggcatgcgaatcacttgatcctgggagatggaggttgcagtgagccaagatcctgtcactgcactccagcctgggcaagagagtgagactcttgtctcaaaaaaaaaaaaaaaaaatcttgccccttccctcaaggggctcacagcctgtgggagagggaaaatagatataattatatttaaagaattataaaacaaattgtataaatttaaaattataattaaatcattgtaataatttagatcagaaaaaataaaggcaagtaagtgccaggcatggggctaagcattgtactcacccactgtattccatgttgtcttcacaacggccttatgaggtttgctagtattgcccccattttaccaagaaactgaggcttagagcattcaagctagccaagggctaagccatgactcaaacccaggtgtgtctgactacggctgttactaagaggggaagggaatcatctgaacttgggtttcactcagaaaggggcatggttttgttaactttgaaaacactaccaccctaccctctagcactggcagaggggagctggacgcctggacagctggggagggggaggacggcagccagaagcaacagcctctgcagtcccagcagctgggacctcatgcctcaaccaaggatcagcactgggtattggctcagagtagtgaaggctgctgggggcctgtgtttcctgcatttcctatgtttatgctgccagggtgggttttatgtgaccagagagaagcagggaaaattgctgagaagtcagagatctgccagggaatcagtgatgagccccaggaaatgctttttgtctaaaaatatgccatttccgaaaggaaaacagtcattagagggtgtgagaagccctcgtggtgaggaaagcaaaactgtaagactcaatgggaggccagtggaacaacagagaagcccattacccacccacttcctgtgcgattaacaagacgtttggaggatgaaaggcaagcagacaaaatgacaacccacagacacaactccaggggaaatgtctggggacagcataggaagacgcagcagggaggtaggaggagaaaaaactgctccagttaatatctttctggcatcggctggttcagctatagatttggctaaaattacctgtgtacttactagacgccaggcagttagggggctttgcttaaatcactctcctgcattcttcacacagcacttgatgaaggaggaaagtgagtcttggaggttaagtgacttgtccaaggttacacagctgggaagggagaaagacatggctccatcccaggttccctgatcccaaatctccccctcattgcaatgtaccaagctgcctccaataagatcaagagtcttgacgatccccaagctagtccactcagtccagttttcctgccagactatagctgttttgcattccttatcttgtgttgaagcaaaccaggtaaggaaactccccaccttttttattaatgactcattttcagccaaaacacattgcagccacatcaggtacatgtgcccactcagcaaagacgtactgtgagaaagtaacatctaagttacttggtccaaagcccttctacatcaatcatcaagcaaccaaccctcctttgctgaaatctccaggggactaggccctttggtgggggaagaggggacggtttcttcaggggcatctcacccctgggaagtgcatcctctctgctgggggcagtaaaaaggctttacgtgggccactgtggctcatgcctgtaatcccaacactttgggggcccaagcagggtgattcacttgagcccagaagtttgagaccagccgggcaatataaagagaccccatctccacaaaaaaatacaaaatttagctgggcttgatggtcccacctgtggtcccacttacttacttgggaggctgaggcaagaggatcagaaggtcaaggctgcagtgagccatgattgcaccactgcactcaaacctaggcaacagagctagaccctgtctcaggaaaaaaaaaaaaaaaaaaagaggcttttcacgaatttcacattccaccctccaccatctttgatgtaggtaatttatcagcattttgtagaggaggaaacaaggtctcccctacgttgagcccaaatcagtttgaccttggggaacacagtgagcatccctgcgtggaggtacgcaggatccctgagggtgacaaccttcgaggtcgttccctggcctctctgcccagggtgagcatcctcagagacctcagctctcctctcagcatgcaattctcctccactcatggccctcccagctgcccctggcttctcaaagctactcctgcatggaggcaagtacaactagccaatgagcctcctgacctgccccatcccagagagcaactgctgctaggtcctcgtggattctgggcctctgtccagtgaccaaaggagaggacacatctccagctaccatccctccacctattttctaaggaaaccaatgagttctcaaatgccacctgtggtggccccttctcagccctcaccctgagaggccttccccaagtcagaatttcccacaggggaagttactgtgggcttctctctccttcccccacctcatgtggtcaggaagtccagctggctttttctcctgtctgtctctcaaatgtgtcccctggctcccctccattgccactgccctcttcagtgtctggcctgtgctcccacaacaacaggcttgaagctggctgccctctcccctccatcttccacaccataatccaggtgatccttctaagaggcaaaggtaatcatgtttcttccctgctcaagatctgtcaaaagattctgtggcctccatagaaaaggcagacagcccggccacccaggcccttcaccatctgcctcttgaccatctccagtgtcctgcagtgtcctgaatataccttttccctgcctctgcccaacacactcccgttctttcaacacccaactcaactattaccttctctccatcagatcttccctgaaccaccccccagaaacaaaggtgactgtcccctctggttccccacagccaccccaccacttacccctgtgctcaggcactcctggagcactgcattgcaaccattggctcacacatctgtctctaccagcaaaccactaaaccgtgaataagtggcttcctgagccaggccttgtgcaatgaatggatttgcaacaaagggagccactgagagattacatgagccaagtcatggcaattagtccccatggaagcagcagctcagggcagggtccagacttgggcagacttaactatgcaggacattccattaacaataagcaccactctgagcatttcctatgtgccaggaactacgtgaagctctagattctgtcattagaaaggactgagttaattaatggaaagcaggtagcacagtgcctgacacagtataagcactgaacacacgttagcaagaaaagtgacagatcatttacgggatggttcttacaccaggcagcgtgccaagcacagtccatacattgtctcactcttcatgacaaccttaggaagagagcagtcctgtttgtccccattttacagaaaaagatactgagtcttggctaggctaagcgatctgctcaaagtcttcagctcggaagtagtggatttggtcttccatccccagtccatctgctctggcacccaggttctcagagtctctggtacagcagggtgccaaagtccagttgagaagaaagcaggccaggtttttcaggcacagcctgatgaaatatccaggggaaacacatgggactagcaggcttctttttctgtcccatttagtctaatatcacatttaacacaccatcctctaagggacagaagtcacaggaagccatgcagtctggttcctcctgatttctcctgtgtgccacatagttatgcttccttctgggaaggtgtgagttggagtcagtcccctcctgcatgcagctggggaaactgaagccaacaccattttagttactcacatggagctaagacaatcatacaaaactcaggcatggggtcagcccaccagcagtgtggacctcaccctgccggctgcgttccaaatgacagtggcatggtgccacagaaaaaacgtgaggtgtgcagctggacccccagaagccctgactctgccaggtgctagctctgggacatcttgggcaagccatttggcccgagtctttttccccacctatgaaacaagccagagagctcattcctcacaaggctgtggtcagaatgtgcctctgtacttgagaagctgtaaaatgttcctcagttgctgcccttagtagggagctcagaggaaagctagttttgcctgtgcgtttctgtcggattgccctgtacccagggcacgtcctgctctctgacaacaatcagggtcattctaactcaaatcaaacaacctggtctcagaactggtcttgcaccaccatggtgttaagctgccttcccacttcatccatgtttgctaagccgggtgggatctttcccctacaaactcctataggcggccacatttttcttttaaagatattttcccttcgactatagtccacaggcatcagaggatgaagctagcaggttgtctgtatgtagactttcttccagggaggaaagcagctttgctatctcctacctttttaaacaaaatctgccttgattttgtctgccaagatatgtctttggatggggtaaagcacttctgagggaagctacgtgagccacgttgtagctggagagagaattgaaagaggaagccgagctgagaccaccacagttccggggctggagcccagctttgcagaatgcctgcatagcagtttgaccccaacagatgaggctgttagggacagaaatgaaaagcactgagagaggggaagtgtgggtggagcttatggacattctatgagccaaagcaattttgaagtctaatcatttggagggaaaatatttgtcatgtcattttaaagggtacaaaacaacacagaggaaaatgaaagggttagaaaataattggagcgcttctccctttacccttgtagaagacagctctccggttttcagctccactcattctgtcctccattggaagctcccccagtgtcttagagatggatgatgtaaaagttagaaaatgcctgtgtttcctgcttgccttaatttaagaaactgcttgactgaaaagtgactgaatttcatttataggataaaatacttgatctccagggaagccaggcctcaatagatggatttttaccatgtcacttccccctagacctgtgggaactgacctgagtcttggggaaaatttgagccacatggcagtccgcaggtgcccacaagtccctctatgatctgagtacctgtcttcccagtctcatctcacctccctcctctccagccagggggacgtgcaccctatacccaccccatgcacacctgtcccaggctctggctttcagctcctaccccagaaatgcccacctccccccatagctcagtgtacccaagcttggcccatcctaaagccatctctgataactccaccacaacctgtcttggtccaagctggaagtgatgagtgaactctcagaataaataatagtagctcacatttcttgagctaagagccagacacttcacaaactcactctcacatttctttttttgttagtttgtttgtttgggagacagtcacgctccatcacccaggctggaatgcagtggcataatctcggctcactgtaacctccacctcctgggttcaagcttttctctggcctcagcctcccaagtacctgggactacaggcgcacaccaccatacctggataatttttgtatttttagtagagatagggtttcaacatgttggccaggctggtctcgagctcctgacctcaagtgatccaccgatcttggcctcccgaaagtgctaggattataagcatgagccactgcgcccagccagctcactctcaacttaatcctggaacaaccatataatataggtattactatgatttatccccatttcatagaggaggtaattaggacttagggaggttatgcaagttacccaaggtcatatagttgataagtatcagagccaagagttgaactcataccacctttcccaagagcaccttgagctactagaactactgcacgcttgttttgtaacatttacagaactatagttcagtgggcaaaggccatgcatgattcttcacacctcccacaatactgagccaccagcaatcaatgcatgaataaatgaatgaatgagaaaatacccacagactagagagttaaggcaacttttacaaacattaaaaggatgccatgtcaacaaaaacacattaagcaccaaccgtgtggtccacattctgacgggctctaggcctcggagttgaagccagggtccactggactttcagatgttcaatgaattcccactttccaacctagaagacagtcttctatcgaggactgcttttcagtctcctagctgctgctttgttcattattgctcagcaaacagtgtgatttatgcatgagacacacaccttaagatgcaatgtagttcttccaactgtcataactactaaattgaattgaatggcaatctactggtagctcaacttctgcaggaaaaaataatcagcctgaaaataatcaatgcaatagcactgtagtgacactgtcgaaaactgtacaaacagtaggaaaggtaatgttgtgactgtcatttattaatgcagagttctagtgttcctaagataaagatcattgaaatgtgaagcgcatttgtccaaacagaatttctaataaatacctttgattgttcctttgtctctatcctttactaaagtcaggcaattagcagtgtttgcaatattacaggcaaatgaaattgggtctctgcctggtccgcctacagaggacttctatagcaataaaaataatcaactggattcttcgttttctgctgggtccatgtgatttccttaataatgtcaatgcagattgtaatttgtaggaaaaaaatactgcttgcatcaggcatgaaatttaagaccacagaaatgccatcttttcttacagaattgttttgttacaagggtatgtggcttggacgattagaagagacctcaggtgtggtgcccaattcatctttcatagaccaatattttgtttcccaaatgtgccttgtacatttctccaataccttcactctctagctgttggtgagggaaaggacaaaaattagagtcataaaatcaccattaaccccccagcttgaccactcactagctagtcatttaggctccgtgggcctcagtttgcttctctgtaaaatgaggcagaaaactatgaaagtgcctccaatctaagttccccaggctcctaagacaaggcctggcccatagaaggcacacagtacatgttgcttgagcaaataagtcagtttcttgtatggtatctggcatgtgatcagcataattaatggttgcttaaaaattaacagtctgttccccaccagtaacattcatcttcttcctcttggcctggtgaaatcttacgcattcttcaaagctaacatcacattctgctttgtctgagaaaccttcccaagaccacaccaactagaagtgatctatctccctaaactcctaagacatgtgttgtccataagcttcattcattcattcattcattttatgtatttatttattttcgaaatggagtctcgctttgtcacccaagctggagagcagcggcgcaatctcggctcactgcaacctctgtttcctgggttcaagcgattctcctgccttggcgtctcaagtagatgggattacaggtgcctgccaccacacctgactaatttttgtatttttagtagagatgaggtttcactatgttggccaggttgatcccaaacccctgacctcaagtgatccgcccccaccttggcctcccaaagtgctgggattacaggtgtgagccactgtgcccggcctataagtttcatttaaaacaagcttgtccaaccttcagcccaggactgccttggtccagaagctttgaatgcagcccaacacaaattcataaactttcttgaaacgttatgagattttttcatgattttctttttgtagcttatcagctaccgttagttttagtgtattttatgtgtggcccaagacaattcttcttccaatgtggcccagggaagccaaaagattggactgtcctgatttagaacttgggactcatggccttgtactgtaggttcccctctcaaaggatttcttagctgttcagttatgtcacaagcttctcggaggcaggtccagagacttcggttcctggtgatttaaacagcccctagtcaagagcatggcacacaacagatgttccataagcatccacagattgactgggggaaatgtccaattcccatggagatggtcagatgccctggagaggccacagtgattacaagccctacagccctccatgggatacactgggccaaagacactggtacagaagacttgtcttctgtagaaagtttgctccatttcgctaaatatcttcccatttgtaaggaaactgatatcctcatgacttgtggtgggagggaaattgtacaacctcttcaggggacagagtgacaatgactctcaaagtttaaatgcacatacaattttaaaagattaaaaaaaccataaatgtcctttgacacagtaattgcacttataaatgtttatctcacagactgacctacacatgtatgagaaaagtcattgagaagattcacttttgggttatctgtagtagcaaaagactggaaacaaatgtctatcaacaggtaactggataaataaatcaggatatatccatgtacaagaacactatgcagccttttaaaagactgaagttggccaggcacgacagctcacacctgtactcccagcactttgagactgaggcaggcagatcacctgaggtcaggagttcaagaccagcttggccaacatggcgaaaccccatctcttctaaaaaaatataaaaattagccaggcctggcacctgtaaccccagctactcgagaggctgaggcagggagaattgcttgaacctgggaggcagaggttacggtgagccgagatcgggccactgcactccagcctggccagcagagcgagactccatctctaaataaatagatagaataaagtagaaatgtatgtacttgtgtagaatattctccaagatataagtgaaaagacaaggtgccaaccagtatgcatggcttcatccagcttatgtaaaaagggagatgtacacatgtgcacttgtatgtgcctatcctgtctccagaacaatagcaacggctgacttggggcagcagggaaagagcctggggtcagaagcaggaggagacttgtcactatattcggtattctcattcatatggactaaattttttagcaagtgcatgcattatctttcttttaaattttaactttatttttaatcagatgatgaagtcacatgcacaaaatcatgaaaggtacaaaatggtacatggtaaaacgtcttcctcccagccctgtccccagccacccagtttccagcctagagacacctaataggaaccctttcctctgccctttttagagacagtccatgcattgcagagattttcttttaaaataatcacaatgaagtgaactgggagaaagcttccattgacctcaccaccctctccagctcatgctctgttctccagagccaagctttcacacagggttgtctacgtgtatggagtggtgaaaaagagttccttgggctttggagtcagacaaacctgagtcttcaatagttgacctaacctctctaggtcttatggcttcatccataaaatggacaattcatacctggctcttaggttgttataagggtaagaaacagtccatgaaaagcatatgggtcacttagccacagccactctaaatttctgggcaccagcaccctccatggctgggaccaatcctcactgagcagtgttcctgggcacagccagagaccccaagacccctggatgtccccctaatcccctgagaagtacatcctgtatttctgaggtaacattttacggtaaacttctacagcaagcaaaaaaccttaaggagctcatgatcaagaccagtcctccctgggtttgggggcttttgaaagggcccaggtttagacatcaggaaacctgtatttgaggcctgactctgccattaactgagcctcctggagtgattcgcttctcatcccaagccttgcacagactgggtggtgattcctgaggcccagaacctggccagccttatagcgtcagtcagggatgtgttagtggagcccttcactcagcgaaagcatagctggctgagtctctagacagagagtgtgttgttcaggctaaactatctccctaccatggacataaaatgacatgggtatagaacacactaaattcttcaaggtaacaaatttaaattcttcaaaaagggagtggctatttaaaatatctctagttcatttttagcattactgaaattcaatgtaaatcacagtggccatatagagttgacatataaccctccctctgtcaaacaccaggttactaaagtcacagggattaagaaatgacccttggtaacaaaagttaccaatgtagaccagttatgtggcaggtggggagagctattctaaggttccttctaactccaaggggctcagatcggatatttggcaagtaagcaattggcacactgaccctgcagtttacaaagtgattcctacgatcctgagggtagaagaagattttgctcctggcagaggttttgcaggatgtgggtggggttggagaggaggctgctgtgagggtagaagggggtaacctctgtcccttcaccatgtttatcttgccatatcaccatccagcattcacagtccattgcccaaaataaaccacagatacaaagtagaaagatacttcatctattttctaagtaaatctaggaagttaaagatcacagctgtctccaagaccatgcccgttgagtaaaaatatctcttggcaagttgtcctacatcaattttttttaatgagacctcttttttcctacctagtattgataatttaatagctctgcaaaaagtgcttctgaagcaagaaaacttagtattttctaatttattctctgggagatttgactgctaatcaaatatcttaattccctccatacttaaagggggcattttaaagtgactttcccagccgttccaaattacttcttgaggtttattgtttgcttttaaatttatgtccaacatgggctctcttcttggggactgagctgtttcagaaaatgatggaaatttggggtgaatctaccaacagtgttcagtctttccaaaaagacagttcattaaaagctgaaaggtttgaccctctggctctatctttttggcctaacatcctaacacaggtgtggacagggtcaagcatgcaggcctgtctctgatacctggttatagcaaggctgtccttggcatttcacctccacctcttctgcatcatacattgtttattttcacctcattattccattcctactccatttggtgataatccactgtgtgctaggcacccttctgggcaccagcatatagaaaaatgccttagcattcgtccctgccctcaaaagggccttgggatcaagaagaagtggacacgagcacatctgactaaacacaacatcatggagggtgtatccaggatatgagcaaaatgctcagagacaactctttttatttacgtcacaaatgcttctacagcacctactatgggccaggcatcatgctaataagggctttaccaatattaattcatttaatcctcacagcaacccactgagatgaatactattcttatcctttggtactgtggggaaactgaggcacagagcagggaaataacttgcccaaggttacacagccagtcagctccaggtggggctcatggggcatgggccctggagcccacacactctgactccagggcccacactcctaccgtcgggccacactgcctcacaacacactttctcgccaaattcagagacacataactaaaaccacttacaaatggagtatgccaactgagaatgctacagaacacattgaggaagtgacatttacactaaaatctgaatgatgaacaggagttaactagactaacaggggaggaagtgggttgcaagccgtggttctgggtggggaaggagtgcaatgtgttccaggaactcaccaaggccaccagaaaaggagggtggaaaagaaggaagaaaacagctcaagaagaggctaaaacatgagcagcaaccatagcattcagcaccctcactacaggccaagggtcattccgtagttgggttccgcaagaatgataggaacctaacagctttggcaggggtaatagcatcagttatgcatcatccactgatcacttgggctgacatgtagaatgcattggaagaggacggcggggttaagcagggagaccccgggggaggcagcagcaaggagagagttgatactcccttggatgggctggaggtggataaaaatggattcaagtgagttttaggagacagtatcaacatgttatgctgcatgtttgcttatgatgggtgaggagagggaggagtcaatggtggctctgaagattctaggtattcacagggtcgggaagcacttgtttgtcacaggtttgttgggtgccggaggggaagaaagtcccgtgcaacagccacatgcaatgttcatcactcccctggctctcaggctgcttcagggctccagaccctcgcacgtgctgatctcgggctaagggctgtttccttccttcgactgaagacctttcatactgtaagattcagcttgaaagtctctccctccatacacatcacacgctgacactggaccaggcacttatttggatctcacaacatctctgcaaagaagatattgctatgcctgttttacagactactgagaatcagagaagttccaaagctgccctgtcatttgtggcataagcgagagagcccactgacatcccagcgctgccttcccagccacactgagggagaggtgggcttggcccttgaggccccttcttctcaaaggcattgaggttactttccatgtagattacggttgagaacaatgagaacttctggagcacattctgtgggctgtgtgaggacgtcggcaagggaacagactaagatggctagaaaatgcccctctttcatctctagaattcatctagtgaagcacttcccaagcctcaggtatccagggtctccctgttcttcctagaagtaggttccagtgaacagaaagcccacagcataactaagaaaaagctgtgtgtctctaccatgctggtgaatccatgctgctccttgacctgccactccttgacatggacggctctattctaacagtgccactctctcatgtcactgtccctctgcctggttcctcctcctctcttatctgcctggagagtcccactccttggatgagtctcacccagagcatccctcccccatctcctcaggctgggtgtagggtgaccagctgtcctagtatgactgggcctaacggatgttctggtttgtgggactttgggtagtatatcagctcaatcccatgcaaaccaggatggttggtcaccctagttaggcatgtggattgcccctgcttatggcaagcccagcaagtatccaagctgtcttgcactcattggttctctcctctgctctttccccaaaagtagttatgaccctctgagatgaagccctgtgccttgttcatcactgtattctcaacatctaggcctggtacagaccaggttgtgtggtcaatgtttgtgcaatgaacgtacgagcccagactcagcatatttaggagatggctcctaccacccagcaattagagaggggaggcaacgcaggcggaggacatctaccaatgcagcacatgagcaagacacagggcctgagaataactgaaccctggcccacagatgccaaagaactggttttgcttgtttgtttcatttgccagtcagaagcgtgggggataatttagtggaatcccttcacagataggttttaacttgaaataattcaactataggtgcttggcaaacaatcaaatagtgaacaggcccaagagagaaggaaataatttagatggcagatggcagttggctccactagaagtgccacctggtgagcacgggcccacagtgggtgtgaggcgggacaacgggggcacacttccctcctgcgtgtgtacctcacactgtgctaggatgattatggttctggcatacaaagtcacttatttttcatgcaacctggtccctaaacttaagaaaatgcctttatctggtaatcaactgggaaaaacattggctgaaccccatactttcaagtacttatgagattttcaaaggtggttcttacacactaacttaagagtccccagatggtgagtcccagctgcgccacttcataactaaatgatcttaagtagctaatgacttaaccttgtagagcttccattctcatgggcaaatgaaggataacatctctccctcatgggctcacagtgaggattaaacgaagggaaggtatgcacaacagttagcagactgcttggtacaaagtaagcgctcaataaaccaaagctattatttttagtggtggtaatagcactgcttttctttggcatttaaagctgtgtagctaatctgggcattccaccaggttgctgaagcaatagacggccccttaataaatagcttccagacagcatgtcatttaaaactgaatgcatttttgcttctcagttgttggacatattatttactacctgatggtcttgctctggcccaaacaagctaattattgcaattccagagtacatgccatcatccagaaatagctttctgtagagtggggactgaaattaacaggcaattagcaagtttaaaaggatttcctttccccatccccacccctggcacctctaacacattaaagctcatcacagcagttattttaaggaaattcagcagaggtacttgcagggcccgaggtcatcttgtgttggccctggatagatcatgaaatcctgttgccaaggagcatggtgggaatgtggcaggaaggctaaagtcaggaaagccacctcagccactaagtagccatatggcctggggcaagccactactcaactctgagcttcagtttcttcatcagtaaggaagtggccaggcacggtagctcacacctgtaatccagaacttggggaggccaaggccagtggatccctcgaggtcaggaggtcaaggccagtctggccaacatggaaaacccccatttctactaaaactacaaaaattagccgggcatggtagcaaacacctgtaatcccagctactcaggaggctgaggcaggaggatggcttgaatccaagaggcggaggtggcatgagccaagatcatgccactactcccaagcctgggcaatggagactccatctcaataaataaagttaagaagttagactgctcaattcctgagactccttccaacccagcaatctgacgtccacactggggctgaccactgaactacatggaggcacatgcctcagtttccttatctacgccattcatctaacagctatgtatcaatccctgttaggcactaggcactgtgctaggtgtttggaagagtcattctcaggcctatcctatctcagcaacctgtaggaatgtcctcacctccagagttagcccccttggaaggaaaatatttagtcccacattcatttctttcctatatgaacctggaatcactgggggcagcctctctgaactgccccattttctgaaaagtgtccgaagtacagcccaggcatggggcattcagcacaaagggcccaagtcttgagagggagtagtttaggagtgaagaaatcccagcctcccactatccagtcttaaggtaaaaagaattgtacagatgagcacctttcttccccttggtatttccctttggcatgacccaaagaccactcccataaagggccataccctagtgttttctgacaatctagggatgaattccctattacatctcaggatgggagaaaaacaggatttgggagttctggtttaatcactaaatgaacttaatcttgacttctggttttgtcatctgcaaaaggcaagtggtcctgatggctacttaataaagctgtctgtgagccaaatgagagtgtgcatctgcaagtgcattgtaaactgcaaaaataattgtggttctctctgggccgccttctacttcacaacaatactgagctgaccttacagataagctgaacagatggttgcctccatggtagtatttgaatagcaccagaaagtttcacctctccaaagcatctttctgctggcctgaaattcaaccattagggattcattttgttgcgggggcgggggggcggcttacaagcttcccagggttcaggagcactctattaaatagctgttgtaatcacccagcaggttcttcctattcgctgcatagacaaaaccagttcaccaagaccacgctattgtagtagagtttaacacaaagccagctacgcagaagacagttattactccaatcagtctccctgaatgctcagcggttagggtttttcaaggatagtttgatgtacaggggattagggaatgggtgctgcagattggttggggatgaaatcatagggttatggaaaacggtccttgtgcactcagttggcctctgggtgggggccccaagactggctgagtcatgagcctcaagtccggatgtagtcagtctaaaaaacaactcaaaagatccatcttaggctctacaatagtgatgttatctacagaagcaattaggcaagtcacaaatcttgtgacctctggccacatgacccctgagcagtaagggatgatagaaaatttgcctatatcttagcagaattcaggcccctttcataatcctgaccttctggcctttcactggttttgcaaaagtggttgagtttggggagtggctattatccttgctgtaaggttcaactataaactaaattcctcccaaagttagcttggcctacacctaggaatgaccaaggacagcttggaggttaaaagcaagatggagtcaactatgtcagatttctctgtcatcatttcacaaaggcagtttcactgtgacctgctaatactgtggggaaaagaaaaaaacagtactcattgggccttaggcatattctaggttctttgcaatacttaattttgtttttaatctcaaaccagtctgagacaggatttactattcagcacatttttgaaactgggaaaatgagtctcgagatgtttaggaaacttgctaaaaggtcacatgagtgacagggttaggacttaaacatgcgtggggtcgggaagatggcaggcacagggtatcaggccaggggagatgccctagagccagcgacactcagcctacttaacttcttctaagagccggtcacctccataaggacagccagagcttctgccaggaaagaaagaacgttgatgctattcgttttccaaaagagcgtatctcctccggctaatctgaacatatttcttacagggctcttgaatgcccctttgtagctgagtgggtgaaacggcatcaccaacatttggccctgctgctccactgagagccggcgccgttcgcgggataattatcctgtagtcttctcacctccggagagaatgcaaggcgccctccttccaaatctggcccgtcacgccagcaccacttatttttagaagctgttttcccctcatagtttcacaacctctaatctgccactctccagtgaatataaattaaaacacaacaatgaaatatggagaaatgttttctcccgtcatctccagctctctgaacccggggctgggagtgggtggagcgcctgatttgtctcccaggcgacacggaaagggaggcagtgagacgtgctacctggtcgcttccggctctgatgaaccactgccagccagttattagggaggagggcagcacttgcaaaaatttcaggtctctgagagcccagagcctgagaagtgtggaggatactaattacacccaggtggaagcctggccacagctcacctcctaaggaaagagcgagcccattaaatagccaggaaggaatggagttcacaggggattagatttctagattatagcctcagagtcattctcaaatttatctcctaaaatctggaggtcaaggaacaaaagcacccttgaagaacaggtaaagggagcctggtctgaattcttagctcctgacagccaggccgcaagaggacagacatcccgtgcacacacgcccgccccatcgccaaagaaagctctagagctagacacttagactggcctttcatgaaatgacagcacctgccaaacacaatagggaaatagttagtccagccaggcagtgccatagagtggtcagagcatgggaatttcaagcagacagcagcaggctttaatcctcactctactctccccagatgtgtcaccaaggcaagtcactcagcttctctgaggctcagtttcctggcctgtagagtgggaataattataatactatcttggttgtcaggtttaaaagaccaaatgaatgtcactgcctggcagactacttaaaacaataagaggtgctaaagttactttaaaccaaccctctccaccctctccttccccacctcagtttcataccccagagaccaaattcctgatggattcctaaatgatatctctgccaaatactggtgccaggtgctgggcaaggcacagttttgcaaccagctgtcaggcagcaacaacttcacagtcgtacttttattcagtgtgtggtaaaacttctgggacaagagtcaaagtcgtagggctttagtgggaaactgccattgcctgaccagaggtacaaagcactggcccttccctcatccctggcctgacctaagagggctggggtaccacaggactgttgaccccactgagagctcagggtgccagaaacactgcctgccacgtgattcctattggtccttccagagatgctaacaggcctggaggctggaggtctctctgcccacactttcacacatgacctggagcagggggtcccagctctgtagctgcatttctgacccagttggataccttgacatggtcccagcaagcaacagagcacccattgtacagccttccccagccccagagagggactgtccctgccaagaacagaggtgccacccagaatctgacagcaggggaggctccccaagcattctacccagaagaacaagcaccctccccagatggcctgtggcccaccctgccctcagttcctagcagatcctcaacttggcctgctttgatgtttgtgaatggcaggtaggaaaggtcaggcaagtggaagaaacctaaaaccatgctctctatggccatggaagcttcctaggtattattacatagctgtagtatattaatattactgtcattaattgatattattgtaatgttactataatatacatagccataatataaacacattataaagctgtaatagcttatctttattctactatgtggcaagtctgtactaagcattctcctactctaaacccccacaaaagtattagctatgaactatcattgaatttcgttttacaaacaaggacaatccaaagaggccaagttacctgcccaaggccacacagtccacaagagcccaagttcccactcaggcccattcttttagctctgtgccacccagctctgcaaatgtagccacccaaagccaatcaagccagtggtagagttctaaaaccaaatctagggctctgtcccaccaatctccacctggtgcctggaattcctctatttttgttttttgttctgttttgttttaaagtttcactcacccccctccttaaacccaaatatccctgggacaggatggaaatccataaacaggtgcctgagtaagacatcattcacagagccttttcctcctgacagctggccaagaacaggagagggggccctgggcaaatctgcaggattacatcagagcttattttcccccgtatgcccctaattttctacatgctcttccattcctgatggattcctaaatgatatctctgctaaatcctggcgccaggtgctcttccattctcccagtgatccagaactttcttgctgtcatgaagaaaactgatttaataagtaaactcatacttaggaagcttcccatccaccctggccccccatggtatctcacatcatcatcagaccaaaagaacccataccctcatcagtgatgactcagcaaaatcaacttcacatgattaggaagctcacataactagcaaggcgaggaggttctctctgccggccacctcctcccgccagcactccaccacagcctgcctactgtctgcccgtttggactagcagctggtgctgtgggatctttaactccactgaaattatgtcacaaaactggggcatcgtagggaacctaggaaaacagacaagaaataaagactccatatgtgcctggcccacacccgagtttggctcactatgcacacattagatcctgccattcacaatttaaaatatatatatatttttttgtgtatatatacatatatacacacctagaaaaaaagtatgtattttgtatatatacaaaatttattacatataaataaaatttatacaaaatttattacgtataaataaaatttatacaaaatttattacgtataaataaaatttatacaaaatttattacgtataaataaaatttatacaaaatttattacgtataaataaaatttatacaaaattttgtatatatttgtatatgtgaaatattttttaaatgttaatatatctataatatttatatatttgaatatataagtttatatatatttatatggctcactataaaagaaattgaaacctccttaagcatgaacaactcccacgggtgttttcttcatgagacgcacaggaagatggcaatgggtactgaaaggaatgaattgcttgtgggggaactttatttactagaacaaccccaggtaggaggagaggttttaagaaatgagagtaggggttctggaggaggtcaccttgcctcctagtacagaggtaagactccactgaggctggagaataatgctcatgaggagattggcaggccccagatccctgcagctactgggacagaggcttcagttccttgccatgggggcctctccctaaagctgctcacaacatggcagttggcttctcccacagcaagagagagaatccccagagagagcaagaggctccacaatggaaggcctagtctttcacaatctaatcccagcagtgacatacccatcacttctgctctgttattggtcagaccaaccctggtgcaatgtgggagaggaccacacagggtacaaatcctgggaggcaggggcccttgggccatttgaagggtggttactccagcaggtacagagtatggtgagcccacatgaggaggtgcccagattgcagccatagatccttgggcaggtcatccaacctcatttacgctgtttgcacttacagaaaatgagaataatagactcgtcagggcttggcaatgcctatgaaagtgcattgaacaaagggaagtatgctgcagatataagacaacatggttttgattgtaattactagtaccagtagcacatagttgtgaggactcctattctgttgagctaacagccctgacccacctgtatcaatcagtgccaatgtatatttcacattgccaatacccagcgtcagataatgaagttttgcaaaatacagcttgggtgggatctctttaatgacctgttaaaactgatttatagttagctttttacctgaatgcacataaggaatctggagttcttgctagttcttgcttggaaatgatctgtttcttcatctgaatgtcctcccttcatctgatttccttagcaaccctggtttttctgttttgattgacaatacaaaattaaatattagtccagtccctcactgggctatcacaggttccaaaacacccagccctcatgtcattgatccaacatcaaccgttccaccggtccttccctcccctgcccccttaccctgccctaagggctctcaagacagacctgtttaactctgggcatttagaacacagaagactttctcaccagggaatctctctttctaaaatccccacagagctggtcaagcaagaagagcactggactacgcatcaagacctggggtgctgatcccgactctcatccttgactgcagtgtgggctgggcaggtcacttcactgctctgagcgatttagttctggttttgaaagactgggtgattctacccattattcactgagcacctctgggccttctattatggcctcctccctttcctgccctgcagctccctgccaaaaacaaagcctatgcaaccttcgtagatactcttcatagaatctgtttctctccctgtgggctctttccttctgagcactggcaggacttaaccatatgctctaggcattgggtgtgaaaccagcaaggcttggtgctggaaatttagcctcatcttcccaaccaccatagctaactcttgtcaagtacttgctctgtgtgccaggcactgttctacctcattaaaacttcacagcaacgctgaagtggctattatcatcttcattttatagatgaggaaattgaggctcagagagagtaagtaacttattcaaagtcacccagcccacatgaggcagagccaggattcatgcccaagcagtccagaacccaagcacgctgtcttgggactggattttctttccccatgaagaatgtaaatttcttaatcacaggccctgtttattttacacacagtcagcatctacaagtctttgttaactgattacaggtttctgtaattctaggcatgttaagcgtagggtcaagcataaactctgtccctacctttccagaacatatgctctgatatattatagcagacaaatgcaaaatttccaagactcgtgggatttagaagggatttttctcaactcttcttttccagataagaaaagggaagcttgaggagattaagttacttctgaccacatagctccctgctgcagaaccaggacagaaacccaagccttctcatccctatcacgagttggatctagggcagtggttctcagtggttctcaactgggatggtttcgctccctcaccccatgggacatttggcaatatctgggggcatctttgcttggcacagctggagaagaggatgttactggtatctagtgagaagccaggggtgctgttaaacatcctacaatgcaccagacagccttcacagtagaatcatgtggcccaaaatgtcaatagttctgaagttgagagatccattctgtgggatttaccacttcctctaaggctctttgtttctgtatctttacaagcagtcatctacagttggacaccttgtcttattcatccttggctccagtgctcagagaagtgcctggcacgtaataaaagctcattgaacaagggagggaaggagagagggagaaaaggaagggaaagaatgacagaaaaagatatcaggctttcctggcaggcaaagaaagtccaacactataaatcaagacctctgttcataaaacagaagatgtctgactgtttgaaatcaattcttgtatatcattccagagagaagactaactccgaataccttaattatgcgttagcacaatttagacgaatactcacaaaattaagcagagaacccaagccctgctacagaagtcttccccctcaaaaaaaaaaaaaaaaattaagatggagtctccctctgtcacccaggctggagtgcagtggttcaatctctccagggattacaggtctgcgccactgcacccggctcatttttgtatttttagtagagatagggtttcactatgttggccaggctggtctccaacccctgacctcaggttatccacccgcctcagcctcccaaagtgctgggattacaggcataagccaccgcgcccggcccttttaaagtaaatcttgattgatggacatgatgaagtccgtgaggtacaaatgcactgccttttacaaaagtaactggttccttggaggtgtccattgggaagatggcagtagttagagctgccactgaggaagacataataggcagctctcattccaaggcagctgagccacgaagaaggctggcctgagtggtcagtgtgcagtaaatccaaatctttaaatgcagttcatgcttcacccccgaccgaatgacaaatggctcccccgtcagagcaagctggcaggtgatgcaccactcctcccctcccctgccacccgtggtgggacaatctgtcagcagccactaattctcaggaatggatggggaagtgggggaagtcaggctgtgtttattgggcaaggagaaggggtctctgagcccaaagaccttcttgggaaatgcagctcctgccctccacagcaaataatgctcaatgaccagtcagggagagcttgtctgggctctcttcaagctatggggagcatctagaaaatgccttgaaaccgtcagatggaaacatcctctcatcttcctccctcctggaagcaatgtgctccgccgctcttccaaacccttcctgtctctactggtacacctctccaaagccctctggatacctcccatgatatgcctttcccaggctccaggtcagcacaatgctctccccactctattccccaaatgcatacctgtctccatcgcagacaccttcacatgcctggctggcaggagctcagccctgcccatctgcctgtctttgttgtgcgaccaccttcagggtcctcccttgggctcagcagtgagctgacttgccatggagccaatggagcttaggtgtcaagatccttcacttgcacaagcccctttcaacctcctctcccccaacacacaattatgtattcatgatgtattttttttcttaaagaggacctccaaattatatctaagattcaggctctgtagaacctggctctttccggccaaaatatgatctttacagagctcaacatgccttgcacacactaggtgtttaataagagctgaaggatcaaagagaatggatcctgaccatgattacaattaattaagaaagtgattaacaggaaagggaagattggtgtttctctcaggcgagctttcctaattcttcctctaccatcaaactgaaaaaagccaatagtctcccctatctcaaatccaggatcctcggaagggtttgttaagtcacagccagctggaccccacctcgcaaggatgtggttcaataggtctagagcgggacttacaatctgcatttctaacaaattcctggtgatgttgccgctgctggtccgaggccctcactctgagaatcactttgagcccctgcgttatcaataggggccatattgcccccaagagggtgaaattgtatcttgaggtgggtgatgaaaaaagtttttattataaagcagatatatatatatacacacacacatatatatacagtacacaaacagggtgcagtatatccctggtgctaaaacttcacgggtagacaattagggggtaaaaatgtctagaaagactctttaggggggcaatcatgataaaacattgagaaacactgacctggcccaagtgcctacttggtgcttactccccagcagctgagccagaagccctcacctgcagagacctgcagcccacaccatctgatactgtggaagaagcattagactgggagtcacaaaacccaggttcaaatcctagctctgcagtaacttcaggccttcccagccacacccacttcagcttctgtactgaaagagacaaagttacaaccaaaactgccagggaaagaatgctgtgcgtgcttggaagagatacatgagggggttgtttatacaaataggagtgagcaatactccacagggcattgttgagtagcaaaagcaacacattaaaccatctcccaaggaggctgggcctgtcaacggccttgcttcgctgagcatggaaaagcacgtgtcaggcagagcaggattactcggcacaagagaggccaggctggggtgggaagaatggagagacagtgcctgccagtgacaggctggggcagggcgagaacaccagggaacatgcacatcgatcctgatttgagcaagtgttctcagaggcagctctataaattccttcaccacccctaagaattttgtactttgtcgcctgcctctaaacaatgcctttggggacagcagattctttgggggtagagccaaaagaggctgagtctactttaatgttatgctggctcaaaaacagactcacacatagtgggaaccaccagactcctgggttacaagtcttgtgtctctgttaactatgtgtccaatctcccaggccctaaactaggattctttaggaatgagtatgtaacaggaaagggaagatctgtgtttccctgaagcagctttcataattcttctaccatcaacctgaaaagaaccaatagtctcctctatctctaaaccagattcccatttcttccttagaaactatgtccagtcagccaccgaaccctataagttgatcccagtggatcaactcttccgctccggtttctctgagcacctaggaactggtccctgtgtctctcctggggggatccatttcttatccaggccccagctctgcctgtccagcccaggagccacccgaaatgctaaatctgtcttcttgctaaacaagttggattgtcataactgtatagccctggtctaagtgaggttggataacagaagtggtctaggaaaactgtgtcctggggaggaggtaaagtgataaataggatgtggtcacggtgtcctaggcagtagcccctcacaatgccagtggatgtcaggatcacgaatcagggaggtctgtttcggtagaagacatgagttggggaggtctgatttggtacaagagatccagaacttgtgtccagctggagtaaggagagtaaggtatagcagagacaggacaaagtaaattggacctcagagacagggcacggggcagagtctgattccaactgaaacgtaaggatccccacatccctcaacagtccctcagatggtgaggtttaggacacagtaaggaggggtggaaagagcatgggtttgggtatgtcttccctcatgaaaaccgtggagccagaagcagtagtgttacagtgatgtcatcccctgaggctcagtttcctcgtaggtaaggtgggaatggaaatgactgctgcataggctgtgagatgattttgtgagatgtaagcgcccaacagatggtggtgatgacgatgttggaatcaggtgactctagcctcttcactgtcacgcttgctctcgtctgaacgtgcttccatgtctccatgttgctcttgtgtccacaagcaaaagcaataatccattgccatttaaccagcacaaaactgaatgaggctgtcaccttccttttctgaaacacatgcttcagacagcgcagtctacagtcacttgagggctgggagaagatgctgtacaatatttactcctgttgaaaattataatcaataagtccctgactgttttcatatgtgctgctactaagctaccactccctgaccttgagcagatagatttgggatccacgtgtagccctgttaaattttgtcttttcagatttagtctctccctctctcttctccccccaccacccccctctccccccaccaccccccttctcatcctttttgacacttttagatttgatatctcttctagcttcttgacatctgaaatgtggtgaactcatcctctatattatccaaatcaatgacaaaactcttgactaagacaaagccacgtcaaaacacaggaacccctacccccttggaagacacaccaggccattcattgatacttttggggtgcattgctcccattagtgacacaaccttaccattctcgcagccaatccatatttctcccatctttcctcatgggcatcactgagaaaccttagcaaatctgcttcccagacccttctgttctcctttcactccctcatttgatcagcctctgggtcctgctgactccaccttaaaatgcctcctgtgcaccctttcctctgcgtctctacaaccgcacgcctcacagggatttgtcatctcctcccagaacattgcagtgatttcctaacaggccccctcgcctatatacctagactctttctgggagggatttaaggtggctcagcctatgtatattcacatgtctccacctactcccaatgtgatcattacctagaggcctctcatactttttttttttttttttaatgcctgaagtttttttgtttattcctttttgttttccagctctacccaccagtatttttttgttgatgacagatcttctcctaaaatgacaaagaatttagaaacattttccatgtatttttaacatctgcgtcagtgaacaaagaaatcatagttgatgatggggtggggagggagaaaagggaaacttaattagctttagtttttataagaacttccatcagcgctgaatgaactggaatatgacatctgattgggcctaatcacaaggaagagtacattaacttgccgtgaatatatttaccagtttttacaataccatttttaaatctctacagaagccaattttcttacaagaaaattaccctaccaagattttttttagaacaagcaaacccaaatttctttcttaccctaacccagttcatccagctctgacactgtggcctgaggacagacactgatgctatcttggagcctctgcctctccacccttcaggaatgttctgcaccctgaaggaggtaggaaaacttgaggatgcaaagaaaaaccagacatctgttatgtctcttgatgttagggagtgggagtgaaattccagctcacccactctcctggggaggctagaatttaatgggatgcttgagatgcgtgggccgagggtgaggctgcagccaaagatgcttgaggctggacctgaaggtgatttagtgaccagagggcaatgccagggagagagagccttgcacggagttagtgacactacagttcccagagtggggcaggaagaagcaggcacaccatgacatcttctcattttctttccttctctgccgttccccagatgccccctcaccaattcatcagccctttctttccttccacacaagctgctcagcactttggctctgctctggaaacatttccattcctgtgctgctacagaacccaccctccccaccagattggatgcacctggacagcaggattgtgacttagctgccatcccgagttttacctggcacacgcaggtgctaggtagtattccttcaaaacaaggaaaaggtggtgtcgcatccctacttagctcctaccgttgggttggtttgcaaattttgcattgaattccatgtaattttctctttttttttttttgtttgtttttatgaaaacgtatcatttagcctgccttaactcttgctttgaggtcacaaatgtcaaagtggttaactccaagtcacctccaagaacattattcctattgggttaaggctccacccttttgagctctaattatctccttaatgtgtgagaactgggggaatatgttcccaaattagaaataagttctctaaaactaaggcttccaatgctgaagagaatgtacaaaatgagaaaggcatactcagtccttcacttacacagtcaaagagcaatttttagggcactcccatgtgccagacagcccaacaggctttagggaggcacaaggatgaagaggacatggttatcagcacccccaagcaactctcagcctgtagagctttcctaatcattcaacaggtatttgaggtgctgaaacattgtttaaaaaaaaaaaaaaaagcccaggtgcaaacacttctatcagatgtgccatgcatcattgacaatagtatacacatattatttataatatgtataggtgctttataaatattaactcattttatctccataataactgagctatggacaataaatgattattatggacaatctcttaaccctcacaattcagacagtgttgctaatcccatgtcaaaaagggggaaactgaggtgcagaaaagttaactttcccagagtcacacagcctcttaagtggtagaaccaagattttatttgtcttcctggtgtaagagaacttggtgggttccttaaaccctgttcaggatctgtcactggatttgcctgttgtgcattcagaggctggagaaggagtggagggggcagagtccaaggtaggacactaagagtcagggagaggtgatttgtgaaaggctttaggggcagcgccagcctctggataacagggaccctggtggtaccaaggaatcattggcaggactctgggagatgaggacttggtctgcatggggcagcacctcgcatctgatactggcgcatatcagcaccctactggacacattcaaacaggcagcaccctgtgagtgtctcagcaccagcacatcaaccttccaattcaccaactcactccagggaatgtgaagggcagggttccactgggccgcaccacccagcccggggtggccccaaaggcagaggggatgtgagtgctgtctctgtgagcctaagtaggccctgcacctgccagagacagggcacagagcaagtgtctgagggcaagtcacctggacacagcagtggcagaaaccaaggagtaggcatgccaggcaggtctccagcagcctctgagtttccaggcacagggcccacaccagggtggactttttatatgtacatacacacccacacacccacacccccacccaaacacacacactgcaccagtcccgtttcctcagatggacatttttcagaagaaagccaatgacactagcaagtccatgacccatttcaagatatgacaggacatcattttccaagtggagaaaacaaaaattctcagaaagccctgtataccacagaaatccatacaccagtttcaagtctcatccaacagaccagccagagtgcagggccacagggcaccctggctggagtgaacaagctccctccaaaccccctcaagattctaggcccaccagcataaaagtcctcttgatggtggggtcattccaaccccatctggggttgtaacctctcagagcagaggaaaataaacaggctgttgtcaggcagcccagggcagaagtgatgacacctgctcattctgaatttatctttattatacattatggccacctgtggaccattcagaaaagatgctttttgagtctcaagcaagtgactctttaagccgaatcacaaagaaattcccattttggccagttctgtttctggacgtcaacacccccctctctgtatgaataaggggtcttccagatggccaggaacagcactcaacaggccaaaacaaagcagagggtggcttgagaactacactgctacattcagcctgaggcccagcatcgacctggccttctcccacttccaacaactcattttgtagctttttggttaagaacaaatttggatttcttctttttctcctcccagtaatctcaaatgtatcagaagaaaggaaatttctaccattattgtcagaaacaagacaagtaaaaggccatcctcaaatactagtgttctcttcaccagacagcagcacacgtggagagtagcagatctctaagcacgacccagtgtgtaactccaaatggccccattatcctatctcgaggagagctgcgcatgctgtaccctgttttacatggcctgccatgcttctggtagcaaagcagtaatctcctggttatgtagcactggggatgccaataacagccagataaagaatagaactcatgaggccagttattttcagtcaaaccaagctacaaaaaccacagtcatgcagaagctggaggaaccaccaaggcaaagagaatggaaattcccttatgctagacagcacaggtccccagttttctggggcatctgaaacttgatgtgacagcactgggagaggccaacagtccacgaataggccaggacctaaggggaaaggctaccactctacagccggccatcagggtgctgggctacagcagggctggcaggagcagacggaggccacatgccaactccagcctctgctacatatggtcccagcccccctactcaccagccatgcggcctcaggcaagtgggataatccccgtgtctcagtttcctcatctttaaaaagtgggataataaaagattcatgtactttatagggttgttgtgaggatcaaatgatttaatatacaaaaaaatgttgacaacagggctcaacacaaagtgtgctcaacagctgctgttggtattggtggtggtggtgaatggtctgccagcttggtagggatgtctatgaagtgggacaaacatttcatgagtatgaagatagactgttcagatgatactcatctaatgccattggcagctcctctctttattgtaccaagatctgtttccttcacgtttcacccaacgtcaaccagcccttcccttctttggactaagtctcccttcaacacatcctcaaatgacacagtttccagtcccctcactcttagtcaccctccttggaacaagctcaagttgctaaacaactatctctaaagccagttcccacccgagccaacattccaaggccaaaaaccatcacctctatcatgagttgagtatcctgctttcattaggggactgcactgacgtggctgcaggttgctggtcagccctagggagccagtaccatacagccagtacccgcgagctccctcctcacaagaggcggctgttgcctccttgtgccagagctcctgggctttggatagaggaattccactgcttgggtctcatccttactcaccaacttggaggaacttccatagagtggatggcagccgcccctccccactctgtctctgtggtgtgtgccccacctaggctgtgtttgggtgcctgtagtacctcttcctgttcttgtctcaaacacacacctgtggggctcctttcccagtaccgtgcttcacaacggggctctccttagcccaggaggggagaggctgtgcagaaaggagacttctatgacacccttggggcaagggtgttgttttgctccttccatagatctctgaagccacagctatgcaggagaacagaaatagaagccagccacacccagtcttctttggcatgggcacattgaacgggctcagttctcctgccacgactgaaagggcaccctcccacagaaggcacatgaccactgttccaagacagtccagatcaggagagaggcctttgaccagggcaaagcaggtgctgatgagaaggcacagcaaaggtggcccaaaccactctgcctattccctatccctcccctgttaactccactcacaattccaaacccagagccctagcttctgagatatccaggtaggcgacaagattttctttctctacatgatacagactgctgagaggctcccctaacaaagcaccagtattctccctgaagacacaggctcaaattatgctctattcaaagctggctgtgttcccaactcctaagccctgctggctccctctgccccccaccctgacgtgggggaagatgctacaggtgtgggggtgtgttagtccattctcacactgctaataaagacatatttgagaaatacccgagactaggaaatttatagaggaaacaagcttaactgactcacagttcagcatggcttgggaggcctcaggaaacttacaatcattgcagaggaggaagcaaacacatccttccgcaaatggtggcaacaaggagaaatgcccagcgaaggggtaggggaagctccttataaaaccatcagatctcgtgagaactcactgtcacaagaacaagctgggggaaaccactcccatgattcaatgatcttcacctggtccctcccaggacatgtggggattatgggaactacaattcaatatgagatttaggtggggacacaggcaaatcataggagtggggaaaccaggagaacagggaaataaaattggttttcacaatagctaaactttccctatcctcttgagagtatttctaagcaaaagagaaatatacttttctttttgctttctctaaaaaaagaaggaaagaaggaaggaagaaaaaaatggagggagaggaggagggaaggaaggaaggaaggaagcaaagaagaaaggaaggtcaaactgacttgatttagctcattattaaacatgcaaataagaaaattcctgttcttggaatgtgatcagtcatctgcataaggtcttgcgacatatctacgattgaattatttctttgaatcaaggattcccccggccacacacaaatcagtacttgccttactttggaaaacgaaaagagctcactaaagtggtccctcttataataaggtgagagtggcctctaggacaaatttcagcttgtacaattctggaatacagaaagggtagctggctagcgacctttttccatactccaccaggcactgtgtagaggctaagggaaagcttcccctttgccctctgaaagctcactgaaaactcacagaagacagattagtagaagaaaaggcatacgaatttattttaacatgtctagcactggaggatccatagagaacaattacccattaacccttcttcataggggaaggggagatgggggaaatgtggcaatttgagggatggtaaatgatttttagggggagacgagtggacttggggaacttacaatggccatggacgaagtctgttgggacttcagagcagacaagggctggtaaatgattctctttgaaatactgaatgagcaccaaaacagaagacgatggtttgtgacaaaatactgtccaggtgtgttgacagacttcagtctttcttcctgtgatatgggttcagttgatgaaaactcagggaggagactagaggtaattgctttcttccttggtatttccagactttaggcagataagggatgaagagaacaacttcatccagagctttgggagagatgaagaattgagagatggggtagggccaagggtggggggtagggagtgaagatcagagagaccctgaggctcttcttatttcagcatgtcaaagcaccatattttggggtaacagttgctgagccccaacaactgccaccccatagtcaaattaagccgatcatccccaaagcaatattagtccagtccagttcctctcatgacaaatgacctgaacacaggattcagcgagtcttactcgctgtggtcattttggaggtagggagatcattaacccacatactttgataaaatacgaaacgcctttcctagctggttcttttcctctcctataggccgacccccctccatccctttattagtattgaactgaacaaattagttaatatgggaacatttggatgtatcaactttgctctgaaacaaaaatgtattcatccccaaactctatgctgggggctgagggagagtccttacgactgacatagtccccaacaaggttctcattagtcccagtttttttttggacaccttttcctccgcattcacatccttctgccctctccagcactgtgcaggaagaaccaaccaacctgaccttggtgaaagggctgtgggtttttcaacccttcattcctgctactttttttttttaattttttagtattcttctgtgcatcctttcttctctcctaggcttctcacccagcctctctgttgagtactacttgtaggcagagctccctcattcacaacatcccaatgtatttgtcctgtatcaaagcaaaccttatacagtagctcttttaagaactgctaaaggaatgaaggaacaaaactgagccaaataaagcaaaatgaagaggatatgtatgcaggcaattgtgggaacatatcaccagaatcctctcttgttattgtacccaaatccacacattctcctcagtgttgtctgggaaatacatcaatccactgtgaatggtttagatagaatagaatccatcaatgtcaccagcttgattcctcctcagatgatgagccactttctccactccacctccagggctggccccagtcttcctaaatgttcattaactcctattaggtattccgaaactctcaggttttctgagtcagcatagaatggttggaaaagcaattgctgtagaatcaagaagactgaaattggaatactggagcaactacctactagccacaggcaggttactctctctgagtctcaggttccccatttgcaaaatgaagcaaagctatctactccaaggattgctgtgaagattaaaagaccacgtgctaacctaataggtgttcagtaaataaatataattttctatttttccctgcaaaattcatttcccaaacacaatctttattcttttttttaacatataatagccatactatggcttaccaactccccagtaagccaggactctctgtatacgcagtgttttgccacatcatttacatggatgaaattgtttcctatactcccaaatttaccctgcttggtgaccaagaatcacttctgtccctattactagtgatatcatgtctgcatttagaaacagacaagtgttatacaaaattacataatatgataggaatgctgtcaatggatatctattattatatttaccagtcaaaattttagttgttataactggtatcaccaattaaaaaattttataagaaaggggtttttgtaccattggatctattgaatcattaaaaaaaaaaagagtttagaaaaagaagaagctatttatatactatttcattccataagactttatccagttccactgttaataaaatgtacatgcgcagaattgtattgttttctccattactaaacatgtatttgctgagtaccttctgaatgccaacatggtgctaggtactgggcatagggtggaagacacaatagacaaggacacagctccctggtatgggaaacagatactttatgtcttcagttgtaaggtccactgttgttcctatttaatatctttgaatgtggaatatatcttacaatgctgtgggctagggcatggttgtgacattgataaaaagggctcttaactgccatcgcttcagttgacttgcttgcctttttgagtggcagtgcatggcttgagcttaatttccattcagaaggtttttgaaaagactaactcattatttgcacataaaaaggcacagagacagaggtgaggcataaatttgatattcatcattagagtaaccatcatcctatgttttcttacaaagtaacaaaaagtgttttatgaaatgtaatcacaatatatgaagctgtgctttactggtgcacatgcaagaggattgcccatcaggctctaagcaaagcaactaagagtaggagaaactgccaaaccctaaagtaggggaaagaaatctccaaacaacaagaggcactgtgaccaattcacataagactatcactaagacatcaggttttaacttgtaacttgcttttttccttgttagtggtatgttaaacaatggtatatcatgctatttgtgtatactggattcaatgaaatactataataaacaagtaagcaaaacataagatcataacacgtcctgaaaggacctctcagcaagagtgacacattgccaagtaatgcacattgttccacatggagttggtgaggataacagcacttccttccagaaatactttagtatacaaagtgctgtcacgtgatgacgtctcatttcagcatctcaacaaccgcacctggaaggccttattattttgtatatttacggatgaagagactggatctcaaatagcttaagagacttccctaacataactcagctaatgcctggaagacccaaaactagaatccagggctcctgactctacatcctatgtttttcttctcggctacatgaaatggtacaaaatacgaattaaatgattatccatggtcttgtgtaattctggcatgtttccagctaagacttctcagctgttcattcaactcaaaggcatccttcagtcctcttccccattcttctctgtctcggggatctgcctggggagggagtgtggtgaaagcagagtaactgaatcctcactaaccccaaggccctaacgcaaggagatgcaggcaataaatcattccattgcatttaccattgcattgcatttaccattgcattgcatttacccatacgtggggctctccagggatggcatcagatgctgcaggaacatgaatgataaataccacatcccaagggttagggcccaggcaagttctcaggggagagctatacatatgactggtaaaacccactatgtccagaagacaagggcaccctgctggtttgcatgagcaaagctaaattggcgctgacaactggcaataggtattgagagtctttttaaaagttgatgtcacttaatctagtaatcccatttccaggaattcattcaaagagaattaatctgggatatagagaaaggtctatgaataagattgcatcacagtgtggtttacatttggaaaaaactgtggttgtaacttaagttacaacagtagagggttgttcaaatattataattctggtacaaccacacgttaggattctctcttgccaattattgatgtcgtgggggagtgttcaagacaaaacattgagttataaaatcaggattctaaattatatatatacacacacatacacacaattaaactcaaacatacacatggagacacacacagcattttaaaacctagaaggaaatcacaaccataatacaatagttatctctgattatgggaatacaggtaattttggtgattttctctatgttttcttttttttctttttcttttttttttttgagacggagtctcaatctgttgccccaggctggagtgcaatggcatgatctcagctcactgcaacctccttctcccaggttcaagcgattctcctgcctcagcctccccagtagctgagactacaggcatgagccaccaagcctgactaatttttgtatttttagtagagatggggttttaccatgtttgccaggctggtctcgaactcctgacgtcaggtcatccacctgcctcggcctaccaaagtgttgttgggattacaggcatgagccactgcacctggctgtttttctctaagttttctacaatgttttattttgctttttaagacagaaagtccacgcaaatcagtcaggaatagatgtgaaaaatggggatggggcctttgaaccaggagcaatatgagaaggtgagaaggatggcctgggccggctgggtctgcgagactacctggaaaagccacgggaatcacagcccacagggtgacatctccagatccagcagtcttttaggaaggcagatggagtctcagacctgtcccacccatcttaaagtggcctggtcacagggtcagagcttcagcagacagaggcgccctgggataagttgccaaatatgggttgagcaacagtggcactggaacgaggtaggaggcggggaaaggggatggaaggtaaaatcctgcccctgtcctcaaggtacttacagtcaatgtgaggaaggctgacagccataaaatgatgacctatgacaacgagggtcgttccacacacatcctccagaccccggcacaagacctccgcctttcatctccattatattgggcaaaacacaaagcatcaacgaaaaaaaaaaaaaagtaaaagtacatagaaaaggagacacagaggaatacagaaaagcaaaaacctccttcaaactggtggatgtttcatcccaaaggacgctcgacctttctcaggcatcctgccactgaagaagtcaattactcacggcccacagtccctaggttccgctcagcacagtctggaatcaagggttcatttaatggaagcttaacagattcagatttctctaatattccacatccccttctgccaagaagctgctttgaaagatgacactcccttgatgtgaatttgcagcctgccccattaacaaggcttcagtcagaaaacatttttaaatcaaccctgttccagacacttgctcccaaggacaaactagaagaaactctgcaccagctcaaaccttccaagcactttgatgatcagaaatgaagggaaatattagaacaaatcttattaatccaaatattctcaacaatcttcaaagcaaaccgttgctctgggctgcagaaagcagagctcatgcagagccggccctttctgtcctaactcctgttagccaagccagccccctaaaaacagacctcagaacagcagagggaaatattcagaatcaaaggtgatgggaggaaaaaggaagaggaaacaggtaaatgaaagaaggaggatgaggattggaaagctgactacttaaacttttagcacgtccctcaaataaaaggataaggtgttgtatgccacactgcctcaaagcaactccctcagttcacagttgtgcagctgagaattctggagaaaccccacggcagctggcatctatgtcctggctccactcacaaggggctgagaaccccaggactcctcaccatgcacatttctcttgggtgtggtgggaggagcatttccgtttccaaacctcggggccatttgctcttagatacacaaacatctccccagcctttgccaagttcacccagccagaaggccataatgcagaattagtagcatttcaatcatttccgtgacgagctggtgacaggctggaatatgatgagtgaagcaatcagatgttgttacaggaaagaggcatgagaagagaatgacaacagagtggtacagtaataagcatcatcgtaaaagcccccactggcatcaagtttatcatcgccagcataactaaaggagccagaacacctgtttgtaatggggattccagctcctccactttctagctgtgtggctgagcacgcttctcgccctttctaagtcttggctgagcatctgtggaaggtggatagcaatcgctacttcataagattgtttagtgattaaagtcaaacaatgtctataaggcatttgcaaagcattagcagtaccagtagtaccagtagtagtagaagtagtagtagtatttggtattataaggagtattttatattatttcaaataggattatgcactatttcattatacccttatctcatatagaagacatttttaatgctatttgattgaaagtagaccagagactcagaaaggttaaacctctttcctagtaagtataaaaagttaatgcaggccaggtgcagtggctcacgtctggaatcccaacactttgggaggccaaggcgggaggatcacctgaggtcaggagtttgagaccagcctggcaaacatggcaaaaccccatctccagtaaaaatacaaaaattagccaggcatggtggtgcacacctgtaatcccagctacttcggaggctgaggcaggagaacagcctgaacccaggaggcagaggttgtggtgagccaagatggtgccacagcactccagcctggacgacagagtgacactccatctcaaaaaaagttaatgcagaaataaggctgcatatcggtttcctattgcttctgttaacaaattactacaaatttaattagttaaattgacactatcttacagttctggagtcaaaagtcctaaaattaaggtgtcaacagaactgtgtttcttctggagactctgaggacagaatccgtttcctcacctttttcagcttctagaggccacctacgttccttggcttgtggctccttcctatatctttaaagccagcagcatagcatcttccagtttctctctctgattctaagcctcttgcctctttcttataagaacccttgtgattacattgggcccattcaaagaaacaaggataatctccccctctcaagatccttaccttaatcacatctgcaaagtcccttttccatataaggtaacatattctaggttctggggattcagatgtggacaaatttggaggtggtcattattcagcctaccataaactggatcctgttctgcagaacatagctatttggagcaagaatgggagttttgtttgctttgctttaaactctttcatttctttactcagcaaataccatagagcagctactatgtgcagggcacattcataactcataacctcctcctctctggatataaccacatcagaatcgagcttcattagtgtgatataaaagaggtctttgcatatacacacacatatatatatatatatatatctcaaaatatcaccaaaacccatactttaaaaaacaaaaagggcctttggagatcatcagccaatccccttattctataaaggggcagaggagtaatacaactatcccagtgtcaaatagggagtttgtgagacataatgagggcctgaattagatctggaggaaaaaaagtaaatggaggtatttttgagaaaaatcagtgagctgaacggcaatagggtaggagaaatgtaggggtcaagggtgcctaaagttcatggcttggggatgtcactcacagagctggggacagatagaggaaagacacttttgagggaaaatatgtattcagtgtgttctagaactcggatctcttcttagtgtcactgtgaaattttccattacttcatctcacttcctgttctctcataagcgcgaacacggggctgtaatcatcgtctgaccaccacatgttagtgcactgtgtttcttgctgacacctggctaggctttgaggatgagtttccatcccaacatctaccaacatacaaggagcccaaggcaatgggattttctgcgcatctttgcttgaaccttaaaggtgctgccccattgtcttctggtaggcctcgtttctgggaagacgtctattgaattcttatctttgtcactgagtatgcagtttgactttttacctctagcttctttttttttttttttttttttttttggtcactggttttcagcaatttgattattctgtggcttggtgtagtttccctcatattttttgtgttttgagatcattgatcatcttggatctatgtatttagtgctttcatcaaacgtagatatttttccaccattattatttctttaagcatttcttctgtcccctttcttgtctcctttggaattttcaattacatatatatgaggcctcttaaaattgcccgacagctccctgatgttctgttaatttattttcagcctttattctctgtgtttcaaatggatggtttctgttgctgtgaattcaagtccactaatcttttcttctgcaatgtgtaatctgttattcatcccacctaatgtatttcatatctcagacattgatttttgaatctctagaagttcagtttagacttcttatatctcccatatttcttcttagcatgcttacattttcttctaccatcttgaataaatgaaatatagttataagaactgttttaatgttcttgtggactaattttaccatctataacaattctaggttggttttgattgattgatttttctcttcattatgggttgtattttcctgcttctttgcatgcctggtaatttttgactagataccggacattgtgaattttacctaattggtgctgggtattcctacattattttaaatgttcttcagctttgtcctggggtgcagttaaattacttggaaatagtttgacccttttgagacttgctttaaaactttgttagatgggaccagaacagcctttagtctagggcaaatttgccccttgaatccaaacactgtttatgttgttaatgatgacaaaatatccatgtcccacactattccttactaagtctcccttcaacaattgtgtttgagtagaactgttaactgcctcacctcactctcctgtgtattcacaaggcaaagatccccaaggttttgaccaatacccaatgttgttttggtgccagcttgcacagcaccagggctcttgcctctcagagagaattgtgccccctctctccactatgtggcacagcacattgagctcaacaacgttctatcagactgatgttgccataacactgcatatcttcacccaggaggggcgacagccctaagtctcttatgtggcaaaataaaatccaactttcagtgctaaaaaggccctgcttttctggagcgaaccccttcagaggtctcacaagcatttaaaagagaatttctagaccacaagtttcagtgtggagagctgcaggcttagagaattgcagggatgtttgaagccctgcccacagttccaggaaacaccctttgtatatgagctcctttcccacacaaatgtgagaaggaggctatgaccctggaaattgaacacagggcaacagaaaccctgccgaaactattcttgcattgacattagacacaaaaacacccatataagcttgatttgctgtcacagtcaaataaaacaataacatgtaagcatttcaaagagattccactgacattctcacttgtgattctgacaacaagcgtgtaagtaagaaaggcaggcgtcacagctcctaagtgacagacgaggaaatcagccttgcggaggttaaatgatctcaacaaggtcagacagctagttggtgcaaagtggggccctgaacccagatcttctgactcttggtcaagagctctattcattccgctgtgtctgctctcttactatatcagaaaagggaacagccaccaacttcctgtgttgaccctagaccaggacttcttgatcacagcacacttaacatttggggctggataattctttgttgtgagaggctgtcctgtgcattgaagggtgttgagcagtatccctggcctctacccactaatgccagtagaactccccttgccccctgttttgacaaccaaaactatctccaggtgttgccatgtttccaaatgccccaaggtgggggaaggtaacagcagagcaaacttacccctcagttgaaaaccactgccctaaatgatgcctgagaatgctgtccacgtgtttgagaaagcagtggtgattaagttagttctgtgaaaggagaaacaaaatcaaaagaggaacttgtgctgataccagtgagtctgggaccacgaaacttggccgtgagagacagaattgtgcagcaccagggagttatctaaaaagttctcttctgggccaccctctgaacttaaccttctgtgttctcgctccactccttcaggctcagtcagctctgcaaaacccaatccactttccaaggaaacatttctggaaggcaacacggaattagttaatgtgatgagaggcagaacagagcagttaagatgcaggctctgcacataccacaacgtggatgaatctcacttaatgttgggtgagaagagccaggcccaaaagagcatctattgtgtgaatctactaactcgaagttcaagagcaggcaaaactaatctccggtgatggaagtctgaacagttacatctgctggtggtgttgcctggagacacgtttcagagaatagaaatgttctctgccttgatggtggtggtggttacggtggttgtaaacataatagacactcacaacactcacagagctatacacttacgattcgtcacctaaaaaaaaaaagaaagaaaaagaaaagaaaagaatgttgactctagaaccaaattgtctaagtttcatccctgacgatgactctggttaccttagagcattttgtgaaaagttaataaactacacagggtatacaggaagtgcacaataagtatttgcatcattataattaacagaactacacttcagccaagcgcagtggctcacgcctgtaatcccagaacttcaggaggccgaggcaggcagatcacgaggtcaggagatcgagaccatcctggctaatatggtgaaaccctttctctactaaaaatacaaaaaaaaattagccgagcgtggtggcaggtgcctgtagtcccagctactcgggaggccaaagcaggagaatggcgtgaacccgggaggcggagcttgcagtgagccgagattgtgccactgcactccagcctgggtgacacagagagactctgtctcaaaaaaaaaaaaaagaaaaaaaagaactacacttctagccagtcaggcaaagccaaggattaagagagttactctgaatttctctgctgccccctctgcctcacctcccatgcattgaacacagagtgtatatgtaagtcctcccaccccaaccatcaagacaggcacatctgccatttttctctgtcttcttcagttccttccaggttctctctgccttgcttaggagctgcccctgtttgcagagctcttcatcaatagactgaatatttacagaatagcgcagttttgattaaacagttcatttcactggagactggggtggtgtattgtgtctcctccggagttattcttggcatcagcagcccttgctcttagcatccgtttctttacattttaaggtggagcataagaagaactgcagtgaaacagatcagatggggggcaggtgggatttctctttacctttcccccgctatttcttggtggatttatcccgttatcttcgctgctatttgctccttgctatcttttattcttctcttttgaaactggccgagtcagaaggaaataaacaaatgcaagggtgcgtagaaagagcattagatggtaggtccagaaacttggactctacatccagcatctagtgatgtgattgattgatatctgttttagcttttcggcacctcaggttttgggctgttttttttttgttttttttttaatctgttaattgaagtgattggtctagatttgtggtctttgaatgtgtgtcagccatggaaaccttcctacaaacagaatctcaagcagcaaatgttaaaacctaaaagcaattttgtttgggttgaaacaaggtgggcgggcagtcaggaacccacccttttaacttctgtgtcctctgccatctcctgtagcagcccccaaagtagttccacaagatccttggccttgggatgctagagcacaacgtctaaaccattcgatgtgcctatttagaaactcatttcctgctcttaaagcgctcagccctctcccctacacataaagccttgcctccatgaaagcagggaggactagccttcgaaaccccagcacacagaggtgagtgtgagcacagctcaacagtatacaagcccgctggaaagctgccccagacagaatttcctcagttgcatcctatggactatcagtcccagaaacgcttggccaaaaaaggaaatacggagggcgggggcagcttgcttcaaagtaattgaggttgagagccgctgtataccatctgccccttctagagattaaattcacagtagcttcttctctcgggccagcaggaagcctgattaatgccgcttaatacgacacttcccatatttatttggccacaaaactcctttttccccataactcctattaatatcacaggaaacagtttgagatcagaaaagccttcacaaaggcaatttttaaagactgagttataaggctcaaaataaatgaggaattctagaaaaggaagggaggagggagaaggacactggtttggggtctggagggctttaagatgagggcgaaacaaggaccacccatgattccaaagaatatccggaacttgcttgttgtctgttggtgcctttctttcagctcattcctagagggcggacagaggcaggagttgctgtgttgctggccagtggctcctgaccataggaaggggactgtgggtgtgagaagtaaagcagagcaggcccctgcctctgttctccccttccccctggtattggctcaccgtgacaaatctttccctaggaagggcagaaaatgaattatcctgttaaatcaattcagcagataacccacctctgtgcaggccttgtgctgggaccacacagatgcataagacacgtacagcttagagcctagtcatgaaatgggaaataaacagccccatcctcaaggtctgaacaggggattggggagcacagagaagggccccaccccgaccagctgtcaagagaactatccatacattctaattcctccaaggttgagggctaaggtgtaggaagaggagagaggttccaagcagaaggaattgcagaagcaaaggcacagaggcatccgggacctgcgagcagctatggctggagccgcgtgtcgcaggatggagagcgtgtgaacagaggggactggaagcggatcctcccaggaagcagttgcaggcggtcatgctacagtgagttgctgatagtaggaggggaagaaagaggaagggggagtggaagatgactcagtggggggtgagccagtgcctggaagagaggaatgtgtgagcagaatgaggaagttagcaaaagctggttgaaggtaggaggtggaaagacaagttcagccctcaacaagttaagcaggttatataagaagtccaggcatggatgacgatgatcataatcatgatggggaggatgacaaagatgactaggaacgctctgtcatctctctctctctctctctctctctttccttcctggttgtgtgagtttgcagggagacgggaggttgtgaagaacaataaccagaagagagtttgcgtcttcatcagaaagcacctggggcaggtagagttggtgctagcttctccatccatccctgacaccccagccccattcatcattcagcagaagacaggctgggctggcccaacttggtcctgtacccccaccaccccagaaccccactggtccatagtgaggatcccttctctttgactctcctccttctctgtgactcgcctaagcctgatcctacaccttctctcccagccactgcctcagcttcctccacccccagcttgggacgagccacctccctggctgggtagcatgggacaagccatctccctgcagaggcagagaaccagtgacactacacgcaaaccaaggccatgctgcaaacagaacaccaaggcaccctcgtcttaggatgcattatattcggggtagatgttgaattctagtaacacattccctggggtgttttcaaatccagacacactggagccttgttccagcctcactgtgggcgaaggccccgggctcacctccagcctcaggctggctctggctgctgcccctgttccatcctggcaagcggaactgaacaggcccgactccacagcccccggtgctgccagctgcaagctctgctgactccaacctcaggcccctgcgtgcctgcttctaaatccacacgttcctgctccttcctgcccctgctgccctctcagaatgccacttctttctgccaagacctcaggcattgctatggcccagccccatctttattgatgtcggggctctgtccccttgcagagcccatcccattgccacccacatctgggacagcaaaagacttctcagtttcctccagagttcagtttcttccaaaaagctcggcacatcttagctgccagtgtgaactgtgagctcccagagatgcccgtggcactttccaacattcgtcacttttgacacatctaaaatatcctagctcccagagctgcgtgagcaccagcccagatggaccggctgctggggaagcatcagtctctccagggcctctgtgaagccctggggcagtagggggatgtctgacaaagcttcctaactgaggagccccacttcctctcgctctgggcacccctgccaaatgagcgggcacctctatgttccagcagccctcgctgcccagcttctgagctgcaagccagcttccttccacagaattctctgcaccttggcttccggtggctccaagcactttgccatctgccgagtcagttctgccagagatgaagcagctgatgtggggagttctctgtgggggccacctttcctctctcaggtcacctttactctcagaaggaaactgaccccctgacctattaaatagctgaaatcaagggccactaggacccaagtcggtgaaggtgcaactgaaggcaagaaggtcagcatctagctagacagacacgtaagccaagaagacagacgaggtgagtggaccctttgactccacagtcagacagcaagagagctactcccagagttctctggggcatgaaggggctgcaggggtaggtgaacagcatccagagaaatagttatcatggaaagtgcaagcaggaaacaagctgggattttttttttatttaaaattatttttcaggccaggcacagaggctcacgcctataatcccaacactttgggagcccgaggcaggaggatcacttgaggccaggagtttgagaccagcctgagcaacacagtgaggccctgtgtctatgataaataaataaataaataaattagctagtggagcagggctggtggcatgtgcctgcgatcccagctacttgagaagctgaggagggaggatcgcttgagcccaagaggtcaaggctgcagtgagctacgatcactacactccagcccaggcaacagagccagaacttgtctctaaaaatacaaagaaataaaagaaaagaaattcttttaaggaagtaaatactaacatggctcagaaattaaaagaatgtaaaatagaatagatttgcaaaatctcacccccatcccacgatgtccatatccattccctcctccccctttcccaccatgggtaaccacttatattcatctcatctgtatcgttccaacataaccttacgcagctgaaagccaacatggagttatttacttatgcccccacccttccacaaaagtatcacactttagatactgttctgcaccttactttggcaactcagcagtacattctagaaatcttttcaaatcagtacagagtgtttctttagtcaagctgcaaagtattccattgagggatatgtccccgttcagttatctagacactagatggacacttgggatgtttccagtattttacaattacagacaatcctgcaatgaatgaccttgcattaatttcatttcgtaagtgtgcagatatagccacagggtagagtcccatgcaggaaatgctgagtaaagagaaaatgcatttgtaactttcatagctgttgccaaatccctctccattggagttgcaccattttgcattcctgccagtgtctccatcaaggtgtgtggtcacactttttaatgtttaccaatctgatggttgagacttgtgtctcagtatatatttactttgtatttttcatcttaggagtgaggttgaggatcttttcatatgtcaaagggccattcatattcctttttctgtgaaacggctcctcatgtccttggttggcccattttttgttctgtgggttgctgtccttggtctccttgatttctaggcattctatagatatcggggatattcgccctttgtgttatgagttgcaattattttttctcactttattgttcattttttgcctctgcttatggtctttttttaatttagttggtcatacagaagttttttgtttgctttaatgtagtctaatttaacaatcttttacagcttctgaattttgaatcacagagggagattcttattcaaaaggttatcaaggaattagcccatattttttttctggtcattttatgattcctgttatttcatttaaaaattggatccatttggagtttttcctgatgtatgatgagaggtatggaccaaacttataacttttcatctttttccagatctcccaatactattttttaaagtccatctttaccccagcactttgagaaattagatttccactgcccagaacaacctggccaatttgagaagtcacttctatcaaatactgaatgcaaacatatgcatttgagtgttctgggtttctattctgcttctttatccaagctcctgtatacacagcttgaattactgaatctttacggtacgtgttagtatgaaataggacaaatcttcccccatagtcctttttagttcagagctcccctggccatttactggcaagctgagctctgtcactggggctctccttgctcactgtcatgttttattctcttctctcctacaaggaggccaatatatgcctgcaggcatccaaccagggaaagaggcaagcacagcccactccccaaacaaggcagaggcaggggtgcaaggccttctgggagagtcccagtaggccatgtctatgtacccctttgaggccggtgttctggggaaaggccaaataggagacctatgtcttcctggaggtttggactttgccctgaagattctcagcactgatcttctggtccatccaatctgtttaaatgagggtgatcccagataacctcaacataaagagttatcctgtctgatattctgtctcctcatgatctgttactgatcaggtgcagaagaacccttcaaggaggaagatgttacaatagcaatatcaatgcctacttctactaccaccaatgccaccagggccacctttattcattgagaacctgctatataccaggcattgtgggaggtactttacacgtttatctcattcacttacaaccccatgaggaaaccatctgtaaacgtgcccagaattgtggctcattagcggcagagccaagctttggatcccagcctggttccaaaactcatactcttcaccactgggcaacttcttctcagaatgatctgccaccctgggatgatgcaaattcccaggcctcccagacctactgaatcagctgctctgggaatggcacccaggagtctgcatctccagcacatgaatacatgagaaccactgctcacaaatgtaaaaagttaggtaatatatcagggaggctgtgaggatgagtgtttccttagcagtggtgtaagggcagaaccctggctggagtgttttgcagtcagactgatttcctcattagcagagagtgttaaccggtagcctagtttggctcctcgaggtgcctgattcagacagagcatcccacagctggagcaccctagctggtggaggtagggactcagccaagtaggctccagagctgccacctaagcccagtagatttctcttgcccagaacaacctggccaaatggaagatgggaggctgaaatcctcactccaaggaggggcctccttttcttggcacaaaggcaccgcgccaagctacacagctaaggcagtgtgctacctaaagcaggtgcacagaattcacagagaggtaccaaataggctggcaaagaccttggtggataagtacccacaaatatctggaaggaactatgttgggttgagacatgagaaggaagagatcttaggcaagtttggaaagggaaacaacacattgaatgccaacccctggactagatatttcatcaacttcgttcatcctcactaccacccacacaagacggtcttcctatttccaacttagaagaaggaagttgaggctcctactggttaagcaagcttcccaaggccatacagctaataagtgttaaacaatcaaacacagaactgactggctccaaagccagtgcccgccccactggccactccactaccctgcctctgccattgctccctatggcaacctggaaactgtcgggtacctgcccgtggtctgaagtgggcaggcagcagtcagctgggcctccagatatgggtggtgaagggaggatacaggtccaaaagaatatcttaggggaaatagtgcacatgcccagaaaacttttatagtctcagaacttagatgtgcggagaaatcgaattctggtcctggtttgcttttttagccagttgtgggccttggcagtcactgaacccctccttatttcttcatgaggaaattaacatgcctaggataggaaccgctgtgctgcagaccccagggtcaggcaagtctcaaagaagatgagagtcaccaagcgcctcaggaaagctgaagggcacagggtgcatgctgcagccatgacctcaacctctgtgagtctagaggtgaccatattggccacacataagctcaccttccccctacatttcataatccttccctcccatcagggccagcctttgattaaaattcccaagattatctgaggagctggcggtaccacccaccaatggagttcatctggctgcctttacaccagccaccttatggctgggtgggcactttcctattcttcggccaacacaacactttccaaactgtgtgacagttgtttatttacttgcctctaccataagaccatgagctttttgaaagcatggtctgtcttattcactgttaggtatcacagtgtattcacaatccctgacacatagtaggtgcttaataaatgtgtggttgaatgaataaatgaattaatgaatgaatgaatgaatgaatgggatcagggtgggccttcagtctctaaaagcatacccaagagccagccctctcagccgcaggtccgcacatggggaagccctagggaggttcaaggactagatcaggcccattttctcatcaggcagcccccaaacctctgccccaaagagcacatccaacatgctttcagcccacactccccacccacggtttactgcctgtaatcccagctactcgggaggccgaggcaggagaatcgcttgaactcgagaggcagaggttgcagtgagccgagaccaccccattgcactccagcctgagtgacaagagcaaaactctgtctcaaaaaaaaaaaaaaaagaataaccttgggctgtttggccaagttaatgcttaatgctttcctcatgctgcaagcgtttatctttgcccagattccagctccagggaggggaacattcctgcagaacagccaggcgttcccaggtcacctctgctctcactctcacttttctttttgcatgattaaatccggcctaaaaacacgtctcaggggcacatatctgtcactcataataatcctataaggtaggtactactgttagtcttattatatagttgagacacagagaggttaaataactagcccaaggtcacacagttaataagtagcagagctgggatttaagccaggcaatctggctccagagctcggtgcctttttttttctttgacagggtttggctctgtcacctgagctggagtgcagtggcacaatcactgctcactgcagtctcgacctcgctcaggtgatcctcccacctcaacctcccaagtagctgggactacaggcacgcaccaccatacccagctagagcccaagctcctaaccgcttctgctgtgcagtaacaagccacgctcagggcatgggcccaacttgagtttcttccatccacgggtccagactggaaaggaagcagcaatcttctcttcttttctcactgagtataaggcacccaattcatcttctggcagctgacctggaggacggagtggccctgattttccttttacaggtacaatcactgccaatactaaagcagtgcctgtccctacctgccagggcacccaggatccttgtctccagcagtaacttcatgaggtaggtggctctgggctgagacaggacttgcatattcctagatcccttgactgtgatgtcgaaggtcctctgcccccacccctccttctattccttgtaagcttcacttggcaattgtgtagtttatgtctggtacaggaatgaaggataaggtcaaatgaagctcaaagccaggagctagatagtcatgatatatcaaataaagttttggaacaagaacacaatgggattaatttgccaatcaaaacagcgcttggcaacttgactgtaagccaagatctctcatggcaagagcagctgaagggcctgtgattgtccagctcctggggagcctccctggcctaaccgtggtcagatgccagcatcacagcccccttagctgggtaaggattctcctagtgctacctctgggagagaaagaaaaaaatctagtctgagaatgacaccagcagacagcagctctgccaggtgtttgaagggtgaaggtcatgggactctgtttttactaccctggtcaccccaattgtttcggggtattttccatagacaagaggatgccccagtcagctgtcttccgtgattcaagacccagtctactgtcttctgtgattcaagacctgtttcctcttgtgccgatcagaggccttatttggaggcatcggcctttatgtggcatggaatgtaagccctctgagctttaacagagataggaagagtcctagaacatggcagggaagagggtcggaacctctgtcctccagcacagtagaaggatgctggcttgaatgtcaggagagcccagagtttctacctggatgcatggtttggggcatgtcaggtggcctttctgggtcccagtttcttcaactgtgacataaggaaggtagactagatcatcactaccaataaaaggtccctggtccttggggagcagtggttggagtgggagaagggcatcgcccagctattttccaacacatcgtaaaagatatcgcacaggacaactgaatgttgacttggtttgcttacctgtggaattctatccacttggtgtggtaaaacggattctcgccagagaactggaagtgtagatgggtggtgttacctatatccttgattgataagagaaggaaaatgaatttttcctcaataagtacaggttgtttgaaatgcaggctgggtgcagcgacgctgcatggtctccaggcgccttgtgtttctaaccctcttgctggacaacttggcctccacagggtagtccccagggaacccttggccatctccggcctgaaggaatcagggaagaccttccggacatgccaagtctccctgagaccctgctccatgagggctggctccctccccgacctggtcttttggttcaaagtcagtcctggagttatgtctgccaattgaccccaacctccagaaaactcagaaacagcctgtcctctcaggcctgcaaaccaggagcagccaggcccagccctgacttatgcaagtaactaccacagaaggcctgctgtgcagcctatgccgctcaacctggatcaagggcaatgtggagaaaccacattattgcttgactatagtgcagtattccaacaatcattttaaatgtgcacttgtgtaaccatgatcaccatcaagatgtaggatatttccatctctctttagagattcccttttgccctttgctagttaatccccaccccattccctggacccaggaaatcactgatctgctctcaatcacaatagctttgcttttccagaacgtcctgtaaatggaatcacacagtttgtacccttttaaatctagcttctttcacttagctttatgcattttagatgtatccatgttctggcatgtgtcagcaattgttcctttttcctgctgagtagtattccattggatggatatgcgacaatttgtttatccatttaccagttgatagatatttgggttgtttcagatttggggttattatgaataaagctgccatgaacatttgaatatttatgtggacatatgtttccatttctcttgagtaaacgcttgaagtttactgggtcctatagtaagtgtacatttgcctttaaagaacttgtcaaacggttttccaaagaaagtattttttgttctcaccagcaatctatgaggagttctacccggttttgtcagtctttttaattttagccattctaaagggagagaagtgatattccgttgtgttttaaatttgcatttctcccatgactaatgatgttaagcacattttcttgtacacatgtgccctttgtgtatcttcttttaaggatatctgttcagttctctcaccctaccttgaacctacacagggtggaatgtgcctatgacctcggaaggactttagggaagcaagccccactttccccagagaggattccagtacaaacggaaagctcttctgaatggcatactctttcataaccagatttcttaaaagaaaaaaatcattctgattctagcctgaagtgcagtagaattcaagagaatttaagagaaaagtttagaaggaaaaaatttttggcaagaaaaaagactctacttacttttttccctgggatccacaaaagaagaagttgtggcctcaggctacagtagtatggagccaaaatggactcaaaaaaaaaaaaaaaaaaccccagaataaatcagacatgaaaataactttccttccatcccgtatctcattttcttatttgacaaaaaaatagtaaagagcaactacaacaacaaagaagaggtgaaacaagaatgcaaaaaatgatgggaagatggcaacctccaaaatgtaataaattaatttcagcagctttaaacctaaagctatttgtaaagaatagctagaaaagaaacccactcaagacaaacttaggaatttcttctgagttcaaaacaatatcttaatgacctgaaaaattaccacggctttacaaagcacctcattcactccttaggagtgaattataccttgggtaattgaggttcgacattatagtgaagtgatgctagggtgtcacaagaggtgaaggacaatacaaagtttagtaactattgtgcacattcagaaattgagacacagaattactttcaagaaaaaagtaaatgggagggtcaggtgtccaggtcagggcaaaattcaagatggtgggagtgggagaaacattcctcaccatggccttgggcagaatctgcttatctccagacaaagctcagcaacagctaggagctgaatctgtaaggtccagcagtgactaaattcccacacaaatgtttccatctttccatcgtgcaagaaattctgaagccaacattgcccagctacagatcattggcctgaccacagaagccagggacagagctgcggttacatttattacataggattgttccatcctgagcagagtacatggcctggagagttttcagggcaattatgaaatttcggtcttccagaggacccttgccaggtctaggaatattttcagcagtggatgtttacaaagcaaaagcccccctacacacacattagcaaattaaataatgcatgttgtatgaaaaaccttgtgaggggcatagcaatacccgaggcttctttcttatgcacttgtgtgcccagtaccagccaatacatggaaagggctcaacaaacactgaactgagcaacagcttctagcccaggcatcatgggcgggaggcagatcctgactccaatcgggcctcctatggtagaatccctggttctctcccatggaaggtgccccacctcaattgcctgcagtcacccatctgctgatgtccttacccaaaagaaaatgaaataatttcttcttgtatgaaatatcaggaaccctcaaacctaggagttaactaggaatagaaaaatcacttgctgtaagaaataatattagaaatgtaatggctggacccagcttctccttctaactaattttaaggattgttttgctgctctaggaacttactgtcatacagaggacaaccccaagcctccctagtccatcaaccccttttcctggatacaggggctgaatcccttgatggatttgatcacttacctcaatttaatattcctcctcctaaaaccacagtatcatccccagattcttatcactggtgtgactacctcttctgaagacatgagaaaagctccagtttcagaaggtatgcttggagaatgtgctgcttctagcttatccaatatggaaccaatttcttcactcatagctaaagcatatcctttcctcacagcttatcatagagtggccaggtttaaatgagtcaatacaaataagactgctggaaaagtgcctggcacagagaaagcattcaatatatatcagcttttaaaaatgctgaagatcaatttgaatatatatgtatatataaagagatataaataggatcacacgtaaggaactgattctacttttaggaaactacactaagaaaatactaatagattccgataaatatttatacataaagaatatcatcagagaattgtttgtaatagggcaaataaaaccttgaaacagcatacattttcaacaatagtggaataagtaaataaattacggcactttttccaagtacgttttgaagaatttttgatgctatgagaaaatgataatgataagtgaagaaggatttaaaaccatttatgtaacatgatctcaattatacacactgtaaataagaatctatggaacaaatatctccataagaaaacattatgaagatatactccaaatgttatttgtgtttttttctaaataataatattctttattttttcagcacttttcaaattatactgaaatatattttcagcatacatacaatgagcatcccttaattctacaaaaagcaaaataaaatatgaaacagttaaaagtctattgcaacactataatttgaaggggaaaaaaaaggctaaggacatacagtaggccactgggcagacaaaggagatcattctgagcctgagtcctcagtatttggtgacccagtagagaggcaagagagggcataagctctaagctttccaccttgggcatagagatgaatgacggtgttatgaaccacaataggaaacgtaggaagaaaggaagaagaatgggttgggaggaaggaaaatacatttagtttggccttgctgagtctgtagtgcccaaagagtacccaggcaaagatgcccagtcgagagctggtgatgtgcaaagctaaaacttgtaggaagaaactgcagtaaaggtatgagggtgggcacagcagtgagtccttgaagccacgggcttcccttaggatgcccaagtgtcctaagtgttctaggaataagcgacagactctgatctcatggaggctcagacccctgggcttcagggctctattccttccacccctaaatgtgacctgaagtggcccctgcctccctcagtcctagaggctgctgctcaattacagtgaagaatctcttatagactcacggtgacttaaacgctatttggtgctgtggctgctatttcactgaagattacagggctctcagagttaaccacataaaacttgctgctatatatttgtaacctcctttttcaataacacatagggaaaccatcttgggtttcaggaccaaaaaagtgtgagtgcctggccaccaggaatgctataactgatcccgcttccctctttgatgtggccaaaaagaagctcagaaaaaaatctgtggcccatcttcagcagccttataagatcacatagtgtacatttttgggtgttaatattgacattcctatctttattgttttactgcccttattttctctttgtcccaagttcttcaactatgaatttttgccaactacttcaagttaaaaatgttcttccatgtcatgcccacccagtgattctgtttgtttctacctcttgaagttacacaaaataagtctagtctaccttctccacaacagcccttcaactctcatgtcatcctcccaatcttatttttataggcaccagagccccactttctttaacaattgctcgtggatatgagctcttaaagagtctttcctccatctagacttgactgatgctttatcttctctcgacctcttccctaaagcccctacgcagggcattcctccgctgcaacacagcaaccacttttaatagttgcttttcaagcttgcatcccccaccccaccatggggctggggactcctgaaaggagccacatgctgtctttgcctccaactagtacctagccagggggcctggggcataatacatgcttaataagtgtttgttgaggaagtgaataaatgaatgagcacatacctgtatacagtatacagcttcctcgctcatacacatgttaaagagagctaaagcctccgggaagggagaaaagagagggccctgttcagtccagttgtttgtggggctttccatctgacaactgttttccatggtctctcctgaacagcctcgaagcctcagccacctgggctggagcgtatctcacagctaaatccagagtaaatatacacaagacagaattggtcctatgaggacaactggggtgaatttccacagaaagaaaggatttcactgatcagaaatgtaagatgctagatgctccaattggtacttattctaacaacgctctcttctctaggttctaattacatgtcaggcattgttctgagctctttacaaatatcttatttaatcctcctaacaacctcataagataggcactatttttatccccattttattttcatatgaccctcttaacatttgaggcagctatcctaaaatgaagaaaggtgtagtgtttcagtctctgaataaaagaaaatgagctacattaggtccaatgtataaatggctgaagattgagtgccagcctttgatccaagatctggatctggcaggacacctcaccgctcactaacatttattgagcacccaccattgtgcccagggctaccctccatgagttcgctgacaggtggaggaagcacacacctggataaataaatcaccccgctgcagggcaagtgtattaggatcagggaggcagtacggtgctgagagcaagaaggagtaattatctctgactagatgagaaggcttcctggaggctgtgaagtctcagttccattttaatgaatggagcagcagagacagagcaggaggtgaggtgcaaaggtaccggcatccaaaagggcatttgggaactgttggtagcaggagaacgaaaagagaggaggaggtgggggatgagggatcatcactcaggtggtggccttggctgcaataccatgaagctgaaagtcactaacaggtatagtcatttctgttttagactctttgagcagctgtgtgcaggaggacagagagaccaagcagagagagaccagttaggaggctgctgtaataaaccaagcaagacacagtgtgcacgggaactaaggcacaggattctagggatatttaggaaacctgaagctttggactgatcgagaagctggcatagcagtgcaaggtgacaccccggcttctgacttagacaggagggcagccagtgaaatcagcaggctaggttggaagcaggcttccaggagtgagggcaagctgagactctctataagctcagaaaagccaaagagagcggcagaaattttcttcattatctcagaaaagttattcaaattcttgctcacacctccttttaataaaatatgatgcatttcattctgtcttcatagtgaaaaatcattgccctttgctgagaattaataaccttttgagttaataccctttgggtaggaaaattggtttcattaacacctccccttgcactttgtaggttcatcatctcttggtcctgctgtcccctgaaaccaaaagcccaagacatattatttgagaagcctgaatgattttattctcagaaagaatgatcagggtccttattaaatgggctgaattgagttcactgaccaaaaaggtcagagcggccttgtgtctgctcctcagccgcaggggagcccaccttctaccagaaggaagggatgagagcttcctctcccagctcttggcctgatccctaatcttggcagaaaagatgcgcccatcttgacatgccacgccatggaaacgcgccaccttgccaggctctaccaggcctcttggcagaggtgtccgtctctggtgcagcaccacagacaggacagctgtcgggctgcctggcagagttggatggccactcacccacccctccaaagtggctcatggtcatagtgaggctcccccagaagagaggctggaaggcccttcggtcaaacaacagaaggtgatatgttaaaaacaatcttcctctccttttccacctcccacggccttggaaagcctccgaatggacattcctctactcttttctgttgcaaactctttagcagcagcctggcatctggagcatgaagccagactcttcagcatcccagggcccttcatgctctggcctgcctggccttgtctcctgcctctttatgtatgcaaggttgcatgcctgtgagcctcgactcatgttgctccctcagccacccctgacccccgcaacaaaacacacacacacactcaatcatcctgcaaggccagggtcaacatcacattccctgaaaagccctccctgaatgccacaccctccctcaagcggcatccactactccctctgtgattcccccaaccctgccccacactcacccctgtaccttgtccctgcaaggcttacctgatataatctgtctgcacgtgaggacaagttgagcctcaggagctaatacatagtgtcacccagctaagatgctctattcactgtctctctaggtagggatgtagggatgaaattggagacagcgacacctgggttcaaatcctgtctctatcagtttttggcagtgtgatttggggtgaggtgcttatccaccgagcctccaaaactgccttgcctatattccttatgacctagagggtgactctagtgcttgattggctggtcactgggataacaggctagaggatctggtgatctcaacctcctaggccaccctccatcacttggccattccactggaaacagtctttggggctccccacagttgtggctcattctgatctccagcatctcccagtaacctctttggcttgtgcttgtagaagcagcctttgagaagacggagggcttcagatgaagcagatgccaggctaagcaccgtccccaatcttatattgcagagccatttggaagaagagctcaagctgttgaaacaaacaaaacgctgcatgagatgaagaccagattcctgctctttggagaaaccaatcagggctgtcagattcgaatcaatcatccggacacgttacaggagtgcggcttcaactcctccctgcctctggtgatgataatccacgggtggtcggtaggaaatgctgacatgccgtttttctctccgatttcacattttctttttttctttctagcgtgttcatgttcataaaaagatagggagctggtgataacaactccatgcataatgtttatgaagcacgttctaattttccaagtgcttccccacgcattagctcattgattatctcgattccatgagtaagcagcgtgagaaaatataattatctccatgtttcagatagaatgtggctcaaagaggccacacagcccattggggcccacaagggattgcagtccgtgcaggaagaagcctccttcctgaatctgcatgttacacacagggggacataggaagccagaagaatggactcccaatgaaatgttgtatcagcaaggtttaagttcagcagcaaataacagagactcaaattagcagtggttcaaagaaaacagaaatttgttttcatttcgcaaaatattccaaagatatatgtaacccaaaaaccggctagacagctttggtcagtgaagtcctccaggccccagctccttccagttcactgctctgccatcttggggtgtgaccctcatcctcatagtccaagatggcagctagaggactagccatcacatctttattccaggaagcacaatgtagtaaaagatgtacacaaaggagtcaaaagcaaggtttttacaagagctttattgagatataatttacaaagcgtacaacttatccatttcaagtttacacaattcaatggcttttggtataaaagagtgttttttaggtgtcccagagcctctgtgaaattctcccagttacatccattgaccatatctaagtggaaaggtggctgagaagtataggctgttaaagaaaatgtagccttttagtgatgctaaaaattctattactatggaagaaggagagaaaggatattattggcaatagatgaagtcaaaccatgtgagaacttgtctccaagaggaaatcctgcctccccagtgtctagcccacccatgatttcaagcatagttcacaatttgaaccctccagagattttggtgtctacttcatgacttagaaacctttccctgccatctagttgaaaagtactcttgaaacccccatctatcctatcctggagaggaaaatgaacccttccatcacctgcctcccctcacctctccctgcctcccacatgacgttccagcaacatctaactgcttgtattaatagcttcctccacaccccatgcacctgccttctctcttcttggtcttggcttagtctgtgccctctgcctagagtgttctttctcctcctcttttcctgattaactcccacttttcctgtaagacacagtcccaaacaggtcctcctgcaagccattgctgccttcatcccagcactcccacagggcattcagtgtcaccgggagttcccgtgtggccctgagcactctccaccactgctctgcagctcggctttctaattgtctgtgtttctctgctctgctaggccgtaagcttctccctgggaaggattctgtcctattctcatctaatagactactgtgggccactatccattatgtaatcagtgctccaaaatgtttgttaactgaattaaagatcaaatgaatgagtcttgtttataaatgcaacatgaggaccacaggagcctcttaccaggatgcttttaccaaaatgcactcttcattatcaaaattctgtccaacctagtatatgtctcctcctcctattactgctaatattaataacaacaacaactgcagtaacgaacatttgttgagtccttactatgttccagacactgctctaagcgctttagatctattaacgtatttctccttcataacaatcctggaaggagagcattattaaccccattttccaggtgagaaaactgaagcacagagaaaaataacttgcccaaggttactcagctagaaactaggagagcctagatttgaacccaagatgctccatgcacatagaaggcacttggtaaatatctagtaaaggaatgcatcttaccctggaatggcatgacaggccctcaggggagctctccagcttcacccgctattgtcaagccttcacctcctattgtctagccttcacctcaccaactttcctcctctcccctgacataccacactgccctttcatgattctgtgactctgcacgcactgttccttctgcctgggatgccctagacctcaccactaccacattcacctgcccacctgtattctttttgtttctttgttttgttttgttgcgatagggtctcactctatcgcccaggctggagggcagtgtgatctcagctcactgcagactcgacctcctaggctcaagccatcctcccacctcagactctggagtagctggggctagaggcatgcaccatcacacctggctaacttttgtattttttgtggagatggggtttcaccatgttccccaggctggtcttaaactcctaggctcaagcaatccccctgccttggcctcccaaagtgctaggagtacaagcatgagccaccgcgcccagcccccacccatattcgtcttactggactcctattgatcctttaaggcccagcacaagtgtctttgctctgtaaatccattaggagtgccctgcaaattggttctcaaacaaggcacacacacagaacaattctctgtaaacattttttacctcctactatgtcaggctcacagtgcccatcccgctaagtccagcataacgcagtctgcagggcagagccagtgctatgggtttaggggtgaggtggggcagctgcacgcagaaggaggcgtacaaatggccctaagggacaggtcagcttccaggacctgatttacacatatttctccactgttttaaggtttagaaagtccctaagaggaaaaacattaagataattgttctcgggagggggcgggggggaacgtttggaaaaatctggagacatttttggttttcaaaacctggggcagtgggtgggtgttgctggcatctagttggtgaaggccaggaatgctgctaaacatcgtacaatgcccaagacagcccccacaacaaggaattctctggcccaaaatgtcaactgtgcatggctgagaaacgtcatagcaagcccttcctccagcattatccaggagctggagaaggaagaagggtgagcggggagaaaggaaactagtgcgaccctccctctgtcccctcctcaggtggacggcgtgctagaaaactggatctggcagatggtggccgcgctgaagtctcagccggcccagccagtgaacgtggggctggtggactggatcaccctggcccacgaccactacaccatcgccgtccgcaacacccgccttgtgggcaaggaggtcgcggctcttctccggtggctggaggtaccgacctgccccatccttccttcacctcccttccctcctttcccttcctctgagagtgaatgaattaagctggtctccaacagcagcccaggcaggagaagcactaatgctcagctcacaggaatgagaaggcacaggactgacaccagaccccagggctctctcagacgcctcccttgaacccctgtttcacagaaccaccttctcccctctcctcatccactattcctcttatgctcacccccttagacatgctaagggatacaaacacaccctgtaagctatcaagcccccacacaaatgagtgggatcacttctgtagggcattagtgtccaggggaagacaggcaggcaggaggctgcagctacaaggcgaggtcacaggtacctgagtcccaggagagtcagccagttgagagattagtttcagtttggagtgtgaataaggcacctcatttctgagcaggcacgaagaacagggtgggcgccacaacacactggaccgcaaaaggctttcatccaggcagctcttctcctgcccccatcccgctgctgtcttccaggaatctgtgcaactctctcgaagccatgttcacctaattgggtacagcctgggtgcacacgtgtcaggatttgccggcagttccatcggtggaacgcacaagattgggagaatcacaggtaaccatgcctaataactcacacactgatctccactccataggggcatccaacaaggacctgcttttccaacaggctcatcattaaaacaccccaacacttattgtgagggatcagcgctcatgagaggacttgtgacattctttcaaacatgaccaatgtcatggattgctgttccagagaattcagagcaaattatagcctcaattcctattgcctgccctcaaacgaatacctcatgttggtgtgccaaatgggactaaaagatggacttttctagcaagaaagagtcttattttttaatctataatttacaaagtccaatttgggcgagttaaggagtgaagaatcacagccttaatttgctgtaattcatcagccacgttagtgcctccgtttccacatttgtgaaacgtgtatgttttagtctgggacccatttgggttgagggagggagctctgcatccaaaacttcaccccaaactccatacacactcagaaatggcccaagatatccaggaaggtctgcacatgtgcgaggaaggccttcctcccaggcttccgtgacaccaaccccacccttcacactgccaggcattggatccaaaaacacacagctggtgagattgttccccagtccaagtctgaggcccactgataccacaggtataaaacccgggaggcacaggcaaggcctttctcggtgtggaagccccagagtgccccagcctctcctcctgctgatcccttcccatagctctaggcttcaacgacacaaggtttttctctacttcacaaacacaccatggcctcttgtgcctctgggcctttgcatgcactgtttgctttgcccaccactcagccactcaaactcctcctcatccttcaagacccagcaggctcaaacaatatttcacaggccaaaacaaagagcattttacatgaataacaaagttgttgcgaatttatattttatcaagtgaggacatttttttttcttttgagacggagtttcgctcttgttgcccaggctggtgtgcaatggcatgatgttaactcaccgcaacctctgcctcccgggttcaagcgattctcctgccttagcctcccgagtagctaagccacacccagctaatttttttgtatttttagtagatacggggtttcaccatattggtcaggctggtctcgaactcccaacctcaggtgatccaccatctcggcctcccaaagtgctgggattacagacgtgagccaccacggccggccatgaggacatttttacaaacaactactatctgctattaccattcctttataaaagaatttcttttaacttgagaaagaatggggataatggcagacgtttcaacagaatacacttgtgattatgacagctcatttcctcatgcttttttgttcatcttgctggtcactggggaagcctggtcacagaccggcgtgtggcccccatggatttaacccacaatagcctggggatgagcagccctcccactgaagaagcagggccagaggtcagagtccacacccagcgaggcagcctcaggcccaaggcccagaaccctctccatccaactggtgctgtgggtcacattaggcgtatcagctgggcccacccacctcagagacagcaggaaagctcaacaccctcttgccgtcttgtcatcagcctgataaagaaaggaacagaaatcatatcaggacatttttctttttctctttcttttttttttttttttttgagacagagtctcattctgttgcccaggctacagggcagtggcatgatcttggctcactgcagcctccacctccctggttcaagtgattctcctgcctcagcttcccaagtagctgggactacaggtgtccaccaccacgcccggctaatttttgtatttttagtagaaacggggttttgtcatgttgcccaggttggtctcgaactcctgacctcaggtgatctgccagactcagcctcccaaagtgctgggattaccaggcgtgagccaccgcacccggccaaggacatttttcatttgtcactgtgggtagggctggagaacgggtgatctcacggctcactctcaattccttcgccccccaagtagggaaggaaaccagggctggggtgggacaccagagggtcctccagagaaggcagaggaagaaagacagggaaaaaaaacttggagcgcataaatactccccaaccacagtcagccaggaggtgccaccttacttcatgcacagacatctgtcacttgaggcccagagctttgagctcccctacttgcacacaacattttcacatacagtgaaatgtcccgcggctgttctggacgttctaatgaaatgacatcttaggagaaaaatcagcttgtttagggaaattattgacaacatacaggcaaataaatttcattctttgataggtaggttggaactacttataatgagcatattggctttttttgtatgcaaacagatggtcttgaaagtagcttgagaggtactcaaaactgatttgctcaagtaaatcaagcattccctcataaccttattcctttttttttttctttttgagacaggatctccctctgttgcctagactgggtcacagtggtgcagtcatgattcgctgctacctcaaactcctgggctcaagcaaccctcctgccacagcctcctgagtggctgaaactacaggcacaggccaccacatccacataacttttgtattcttttttattttagagatggggtttcactatgctgcccaggcctcctggcctcaggcatcataaccttgtgtctaccactggagagtttccgcaaacctctttccccgctagctaatgcccagcctgtgtgtcattgttagcaccatgaactactgtggttttactgagaaaaggttacggcgaggttttctagggaaggatcagccctacgtgtttcttcttcctgctagttcactgatgtataataatatccaaaagctaaaaagcacatctctcttcccctctccttgctcctgcgtaacccttacccctgctttcccattagggctggatgccgcgggacctttgtttgagggaagtgcccccagcaatcgtctttctccagatgatgccaattttgtggatgccattcatacctttacccgggagcacatgggcctgagcgtgggcatcaaacagcccataggacactatgacttctatcccaacgggggctccttccagcctggctgccacttcctagagctctacagacatattgcccagcacggcttcaatggtgagaatgaagtcatgggccgggagcaccggcctacatttcaatggggcctctggaattcagcggaatctaccaacatacgggactcagggaagagttcagcaaggataggggcccagggtgtatggtcaccaagcccacccagagagaaggaatgctggagtgggcaagggtgcctgtcccccagcaggccactcctggcaacaggccaacgccacgccctgaggatgaacagagggcaccaacaggaacctccacttctcactccagccccatgtgcccaggcaaaccctctcccggggtaccagctcttctgagagttgagtccggatgcctgtggttattcttccttctctggaagtttcctcgttccagggaccgcctctattctgaaccacatgaggatccacttaataggttgtggcttctcgatgaaggtctcactcttcatcccaccccatcagtttaattgaggaaattactcagactgtcccaatgggaaattcagcttcaaatatgtccttgttatgccctttacctcagggcagacacggaatgtgctgttatctgggttgtgatcccacttctctctcaagtcctaaaaccgaaatattaacatgcacattgataatatgcacaggattaaagaacaaaaatgtcagcagaagcagcacattccacgggcattccaaatttcttgctattataaaatatcaccctgattaagacatgccaatcactccaagccaagtagagccctccacccctacaagccacctcaccctgatcatccaacactcagctgagaacacactctcttgtgatgacaccatcctcgcctctccaatatcagagtgaccttcacactccgcatcatctcattttggctggactcccagccttccaccgcccaggcctgagagagccttctgggaacttgcccttatcattgcttacatccctcccacctcccccactccaacacctcccctccagccaccagcagttcccagctgaccatccagccctcatcccaaacttcaccccacccaacaaagctcagtacagaccatcaggatggtgtatgggctttattttcctggtaaacacatttctgaccaatcattaccatttgctcttttgtgctaaacttcaaagtgacggaaccaaatgtaggtattcagcttgcccaagcttgggctggtttttctcagtcgtcttcacccctgtgtttgaaagggttcctggggtagttctcccagccacagctgcacaggggctcactggataactgcagattcaccttcactacctcctgggtggatgagcttgggtgagttagtggatgtcttggaagctcagttttctcgtcgaaaacagcggcctcaaggagctgcagtgaagatgcaggcagtggaggagcggagggcacgcagcatacacagcctcctagtaggtgcccaaggaatgcagccgctagcgtccaaggactgcagtgactaatcttggcatttagcctccagacaactggggaaatagcttttggcaaagtcacctgtgctgtccctttacagcaagtgtttcacatatcttgtggtggttcctcaacatcccttgagaattatttaccacagattaggttaaaatttggagagttaaaaaaaaaaaaaaaaggtcaaatccttagtagatcaacctcataagcttgttttgggggtgaggcctgtccagatctggttactgggcaatgtccttccaaatccaattcttgtgctggtttcacaggcctgttacctaagggatgcaatggctgctttgggacacaaggtagacattgtcgagaggcctcagcgttctccagaccatcagagtgccacgggattgtctcgtgtatctagttatattaagagaagaggagtcccacgcaagcctgttccagaaaacccaccctccaggcatcagcacctgggcattttaaattatctcatttgagatagaaatatttctataataaattacactaacctgctctcttaatgaatttgatctttccttagtgacttgggtgcctattaaaatgcctactgtaacacgctgtcataaaggagtgctctcaggatcccggcagtgcccgggattttgcctgacactacatgactcagagggtctacttcccttagtttcagtcagttgtcacatcctgctcttgtcaaggggtctgccttgacaagcccacccttgcctgttctgtgtgctactgctaacctcctgtgggatgagaaccaaggtgatcctctgagttgaggctgctttgggttaaggggtgataacgtccttcttgccctgtgttccagccatcacccagaccataaaatgctcccacgagcgatcggtgcaccttttcatcgactccttgctgcacgccggcacgcagagcatggcctacccgtgtggtgacatgaacagcttcagccagggcctgtgcctgagctgcaagaagggccgctgcaacacgctgggctaccacgtccgccaggagccgcggagcaagagcaagaggctcttcctcgtaacgcgagcccagtcccccttcaaaggtgagtgtggagctggggagccttcagaagggcaggatgcagtcccctgtccaaagggctcagaagtccccttggcttctttcctggaggtgcttcagctctgctgttgcggtgtttctgaaactgtgcaggctccagacagcaacgttgacacagcctttctcctgtcccaagagtgtggccaccttgccgccaagggctaggaggagaaacctcgaccatttctgaaacgatccttgggttggcctctctgtccattttcatgctcccctagaatgttagatctgcaaggccacacgcagtttacctgggccacccggatctcactgtacagggacgtcaggcatctccaaacacatcctagaacccagttctttcatctctgttcacggcccccatgaaaaaactggattctagactgcatttcatttcttctaagatttgaatcagctgatctgataggacatgatattcaccctgaggcactcccaagacaagattcagcttccagtgtttcccagccagatttttaaccacagggcagaaagtgggcccagcagctctctggattgaatggaagattgtagaaagggctgtgaccacgtcttaggctgaggccagcagagaaatactccactgaaacctaaatcctcctggagggaacaagccgacatctgttgccattaacatttctgcctaatccctaaaacagctcgggagtgctttagcatctcactgtttcatcgcacagcctctccagtgctgggagaagaaatctgatgtgctgtttgactattaccaggcagatatttgtatctggagaatgtaaacaggccgtcaccaccactttgcttttagggagcattttacacaaaacattcgatgcagccatcagctccttgtggttctcccaacagccaggcgaggatggcagggctggttattatcccattctaaagaggagcaaagcaaaactcgcgtggggtgcccacagctgtgcagctgtaaggagacctggaacagggccacctgactctcagtcgtgagttcaaactcccaggcagcttatttttgaggcacaggatttctctgtgtatcggaacttttgctctccagtcaggtttccctcccttgagtcaagcaggtctaggaatgacagaaatttcttgtgggtgcgcacagcatctgaagagtagttggtgtgagggcaggatctttcgggccaaagggtccctccactggctgtcccttagggctggaggagatggcagcacgcaggtgagggaatttggaagtcctcctgcttcggggagctcctccgctgcaggctgccaattaaagactcatttgggtgaaccagctcctcttttaaatggcaatgccgcctggagtgattaagcctcttagataatcacatttcactggatctattttaatcatggaatgttcgcatcatgaggagcagttcaaccctgccgtttttcagatggggaaaccaaggcctaggcagggaaaattatttgtccagagacaaaaagctcttggcagacctggcatttagacctggggcctccaaagagtgagcagagtgatttttaaaaactcctaaacctgccgctggtctgtttatggggataagaggggtatggaagagaagggtgggggaattgctttctccttgaaatcacctgggaagaaaagaggtcatttttcatcttccagggctaaactgggcacttcatctgatttggcccagccctaggacatctactggggacttggagattgggaagggaagcatcaagagaaggaagaaggggaaacaagagcagtaggcatgaaccaggctgagcttctcccatttgccaacggccccactgcccgaccaccatacactgctgatgtgaactcacaaggatccctttgttattaaggaagaccaaagaattgcattagggcatcattatctcacccaccagctaccaaaaccaacgtactcatccatccgtatattcttcaaacacagtcctaccctcagggggctcggtggagactaacccacgatgagttccttggagaccacatttgtgtctctttattaccgactacttatcttgctcctgggacatctagtgaggaggaggttaagggcaggactgactgaaactggtcaggaaccgaaagccccaggctggagggaggttccagtgccgagctgtggcttgtaccacaccctctccttttctttcttactttttttttttttttttttttttttttttgagaccaagtctcactctgtcgcccaggctggagtgcagtggcgtgatcttggctcactgcaacctccacctgcagggttcaagtgattctcctgcctcagcctcctaagtagctgggattaccagcgtgcaccaccacgcccagctaatttttgtatttttagtagagacggggtttcgccacgttggccaggctggtctcgaactcctgacctcaagtgatccacccgcctctgcctcccaaagtgctggaattacaggtgtgagctactgtgcccagcccataccctctccttttctgctcccccacaaattctccccagttctcctgcagcccctccagtgagcaaagtcctcacccgctcaacccagtttcacttgctagtggaaagtaacgtctctgtggtcacatcaagccaccctgggcatggctggaaagtgcactcatgcgagactcgcctgtttgaagcagctgctcatgggatactgctatctatataatgttatgttatccaatgtggtagccacaaaccatatgtggctatttaaatccaaatctaagttactttaaattaaatggaaccaaaaattcagtttgtcagttacacaagccacctttcaagtgctcaaatacgtggctgctgcatcagagaacacagaaataaaacatttccatcgccgcggagagttctactggtgatgctgggatgaagattttaatctaggccaccacagctacaccactccctgcccatcacaaccgtgatcataactgacttgggcccccaaagcctattccaccagccacctccagcattttgatgaatacatattacactcttaaaagagcagacttgcccaaccccggcctacagagaaaccacaatccccatttttcaaaaacatctaattgtacaatgtattttagtgcagggtctggttgggcaagataaacatcgcctcctgattgtagtttcacaaaggatgactaacttggcctgaattcctctggctcccaagatatttcgacaaaaccatcaaaggatctattttctacaactgtacaccagaactcgggtaaacactgcgagagtacagcagtagcaagagagaattgggaaacagtcgccgagtgaaacgaggcaatttatcgcccacttccattctcactctctcacaaggaacctttaccagtttgggagcctgtttttaagggagggggagggaaacggatctgtacggagtaaatcctgtttcgccagtgcctcctctcatttcatcctcagagcagtcagatgaggtaaccgggtggagaggagggaaggggccctcggggggcactctgcccgggcactgggctggatgtgttgtacacgttagctcatttcccatttgatcctcacagcaacccccagacagggagagacacacgcacacacagagacacggtcagggcaaagtcacacaatttgtgagcaggaagcatcgcattgaatcccagcctttgctccttttactgcacttggcctcggcgtaggaccaaggccctcgactgagtgcctctccctcctgcggcattccagctgcatgtcccgcctcctcctctctgccctccttccacactccctcttccatatctcctccactcttctcctgtcttccccgtgctgcccttccccctcccccgccccctcacccacggccctgcactccaggctccctgggtcgggggtgaggggcacttgcttctgctgctcgccgcagccatgagagcacccttccttgctggtcggcgagatgacgagccaagctgtgactcgggcagtcggtctgtttttggcttctctcagctacttctttggaaggtttccactgacttcagggagagttccagaagaagcagggggtgtcgtagacagcacaggcttggggttgggataaggagtgtcaagaatcttggccttgctgccaaccacttatgtgaccttgacctaatgacaaaacctatgtgggcaccaaggaagaggtgtgaatagacatggggatgaaccactagcacgggacctgcaggtgggtctcaaaacctgccccggtcagttcagtgtggaggaaggaagtagatgacacccgattaacaccttctggaaggcaggcattttttcatcgccatcttatcacatttttacagcgacactacaagaaagttcctaacctgcattcacagatgaggaaatcgagccccagaaaggctatgtggtctccagatcacaaggaagcaggcatcagagaggactcaaaccctgggctctgtctatccgttgagggcccttattccacccacagcacaaagagctggcaacaggacgccagtcagcacaacagtcctggccgcacacacacactcccccatctccaccgctcgcaggcagcaacagacccccacagaaggggcaggcattggccaggcacggtggctcacacctgaagtcccaacactctgggaggccaaggtgggaggatctcttgagcccaggcgttccaaaccagctcgggcaacaaagcaagacgccatctctacaaaagaattaaaaattagccaggtagagtggtgcatgtctgtagtcccagctacttgggagactgcaggagggttgcttgagcctagaaggtcaaggctgcagtgagacatgatggtgccactgcactctagcctgggtgacagagtgagaccctgtttcaaaaaaattcaatttaattttaaaaagaaaggggcaagcatccagtctcgtgacatcagggcatcacttaaatgggactgtactgttaaaccaaaatgtggccacgaaaataccgacacatacaggtgttacatacaaaggctaacaaaatcactttccctttttcttcttcactcgcgcctgctctgagttaattcactttcattcagccttgccggcactggctgccttctttgggcagcaacaccctggacaacaccatcctgggcccctcaatcctatgatcttcagcttccctctgagttagaggcatttcgggtctaggaacaagccctctgggcttggagaaaacacaagaggtctcattcctaccatctccatgagagaaatccatacacggagggggaaaaaaaaaaagccctctttgatgtttgcaaagagagtcataatatctcccagagccaacatctaatgattcagaatcattgtttctgggaggcaaaaaatagaaagaaatatattctcttttcataaattcaataacctgatcttgtgaaaagaaaatgtaagttttttcttttttaaatggcaccagcagggtccacacagggttacaatccaggatttttcctagtgaggagactctccggaggcctcagatttctgctgtaaatggagtttccctgatcacattcgaggtcaatggactatttcatgcctttcatctttaagacctgaaataatttctcctgccagaacttgggagtatgttgtactggtctctttgcagtcacaggattaaaagcgttttccccaaatcattttttaacgtccttattaaacatgtcataaggtaaagtgggcaaaatcactcacacttttttccttaatctttgtaatagcatcattgtgctgggggtggcagggtagaatgataggcaaattgtcttttcttttcttccttttttttttttttaaagaaaaacacttacaaaaatccaaataagagtaaataattaggactgggtgtggcggctcacacctgtaatcctaacactttgggaggccaatgcaggaggattgtgtgagcccaggattttgagaccagcctgagcaacatacagacctcatctctacaaaagaggaggaggaagaagaagaaggaggaggaggaggaactagttctcagcaggaaccagttctcagcctgaaagactcatttatatttaaagttaatttcatttaaagatttctccaaaaaagggcagtcatgcaagattctccgtgcagacatggagtttctcaggagtgctcctgcaaactcaagggtgcctcagccatcagcgcaggttccgtccccagcccgttccctggtgagcctcagaaagcatgctggcttggctcttcacagcccacacaccttggcacgttccatcctcctgcagagatgctactctagggacacatgttgtagaaataggcaattctcattcataggatgtgcaagctaaaggggcctttgcatcctctaaagctgactcctgggttttacacaagcactttctcctaaaatcgtggaaccatagcatctcaaatgcagaaatcaatctcctcctactcacaatttaagaaaaagggaagaaaaagtgtatcgccaagacaagggcatgaaacattttccccggctcaggggccagacgtttaggggacaggagagcgtcctttgtggcagcgatagcccaggatggatgtcaaggggtcagagctggcaggcagtttgtcttggtggcttcattagaagcaggtgttgaaccacagcttttcttcaggggctgttggccatttgctttcaagggacagactcagcttgcagaacgaaaacagcaggcgatatagaaagagtcttttggaattagacacacctggctttgaatcctgctccactgaactatctggataactataggtctccaaacctccacttccttatttatattcaccaggataattaacactgtgtcggtctaggtctcagcagaaaacaggactccactggcctggatcagctgaagaaagcaagtgggactccttacaacagggtgggcagtgttaaggaaaccaacaaggactgaggcgactccctgcctctaacagcaggacagatggagccagggaagggactagctgtgggaaaaccagagccatggaggaggggctgctgataatcgtgggagggcagtggctgcacagtcaggctccagagcacgggggagcagagggaaaatgcccctgcctctctcttctccgccctgatctcctgctagtgcctctccctccagtggtcacacccaaccagaaaccaatcgacaagggagcccggcagatgcagcctaagggatcccatcctggggctcagagctgagcagtggagggcagagtggatgaggacagcaggggtagagggagcagatgggcactacccagcagggcatcattatttagcctgttatgaggagaaagatgatgtatgtaaaacacttagtatgtagcttaacacatagtaggatctcaacaaatgggagctattttatcatccttggtgtctttaatgcagttatatatgcatgttgttcttcactcagagagcctgtgaagtactccttggaggcctagtgtgtgctgtgcccttgtggagatacaagcagtagtgtggttccgagatggcctttggggagataagacatggacacagatgcccgtgagacaaggcagaggccacaaaggaccacaacttctagttctcttttttttccttttcaatacttgtaaaagctctttctttttccaataggattccaattagaatacacgtttactgcagaaaatgtgaaacttgcagaagaacataaagaagagaataaaaatgaccactctgccctctccagagataagcactgttaatatttttgtgaattcccctacttctatgcattctgttttgcagagttggtctcatactagacagtttcgtagcctgtgtttttttgtttttgttttctttttcacttctttcataagcattgaaatcattccaaaaatagcttttaatggcttcataagagtaaatcacatgtttgggacaatgaactgagaatcagcagactaacttctaattgcagcttcatcagttattagccacgtgacaacgacaagttacttaactttttctgagcctcagcttcttcctttgcaaaatgatgtgggagggaagataaagtaggcatcttataaagttgttgtaaagagaaatgagataattatatgaaactattagctcaatgtctgggacatagtgaagcgctaaatagtagttatcataattgctgttattagttcatagccatccctctattactgaatatttcaggtgttttcagtgtatttttacacaaatgttaggacattttttaactgaaatctctttccacaattcaactttttccttagaatatataaagctagtggtcctgggtataaacatgtaaaagttcaagttctggagtcaggttgtgtgagccgacgccccagccatatacgacttactagctgtgtgatccgagaaaagtcacttaacttctctgtccttcagtttcctcttctctaaaatgagataataatcgtatcatttgtttgagggtcaagtgagatgacagaagcaaagcacttggcaaaaaccaaaatagatattagccaatgttattatcatgcatactgccattatatgctctttttttttttttttttttttttgagatgtagtcttgctctgtcacccaggctggagcgcagtggcgcgatctcagctcactgtaagctccacctcctgggttcacaccattctcctgcctcagcctccccagcagctgagactacaggcacccaccaccacgccccgctaattttttgtatttttagtagagaacggggtttcaccgtgttagccaggatggtctcgatctgttgacctcgtgatccgcccccctcagcctcccaaagtgctgggattacaggcgtgagccaccgcgcccggcctcattatatgcttttaattgcatttagcactgggctaaacacacagtagacttccaattaatacatatcatattaaactgaattgaagatcggttactatgagtgttccttgagaactctggaaggtaccctgactattcataaggaggttaacccaaggccagtcctcccacatcttaccccctcccccactttggaaagaactttctttttgtctcagtttgacttacaagactgttcatttgttacagagtttccttgacaaacccccaaatagtgtaagacctctccagaggcttctgggatgacaggctaagtccctctctccagtggtgccacccaagagtttagggacccttcccaggacttgcgcctatagctcttttctttttttttttttcttttttgagacagactcttgccctgtcaccaggctggagtgcagtggtgcaatctcagctcactgcaacctctgcctcctgggttcaagcaattctcctacctcagcctcccgagtagctgggactacaggcgcccaccaccacacccagctaatttttgtatttttagtagagacggggtttcaccatgttggccaggatggtctcaatctcttgaccttgtgatccacctgcctcggctcccaaagtgctgggattacaggtgcaagccaccgtgcccagccagctgttttcttacttctcacccacagcctcttttgctgtcttgagggcatcacattgctttattccaggcttgggatttgagcatctattgtattacagcaggggtccccaacccccgagctacagacagtgggcaattaggatccgggcctcacagccagaggtgagcagtgggcgagcaagcataaccgcctgagctccacctgtcagagcagtggcaacataagatcctcatagcagcgcaaaccctattgtgaactattatgagaatctaatgcctgatgatctgaggtggaacagtttcatcctgaagctatcccccctgcccccacactggtccatggaaaaactgtcttccatgaaacccatccctgatgcccaaaatgttggggactgctggtgtatagggtactgtagtaggcaccagatactacctgagctagctcttatctaaagcagaaaactcttggccaataaatcaactcttagtatttggctcttgttgtgaacataaataaacatttggtgcttcagagataacccctttagtaaacccaagagatatccccactcacatgagcaaattatatacaaaatccaaatgggaagattagtttatgccaaggataggattgtgtaatctagaaacttggcaatacaggcataccaggacactggagctggcagtaccctctgctgggcttgctgtatagctaccaacctccggtagaaatagtaccatttaggagttagtagattgattgatgaagagatgaatttccacatgctgggtacaagggatggatagtcaagtggctagttaccgtgatctaattttttgaaattctcctatgacaaagcttgaaactcaggtcttgaatcctcagaggtgatttccatgttgttagatgttaatgtgcattgtgatacgtcacccccaagcaaaccatcagttcattcatcccacaaaagtttattaagcacctactgtgtgcaaggcactgttaggattcgtggattaaccattgtctaaacaggaaaggcaaatacgcagcaagtattccataaatcccttatccttttcccaaaccagacactcatcttgccccaagcccggacatggcctcagaatccatctcaacagagggatccaggcagttcttatcaatcaaatggaattaacatgccgtattaaacctgtttgcaatcttggagctagaacactgtagatgcttagagaatatggagacaagagagctcaggaggtcaaggctgcagtaagccaaggtggcactgcacccaagcctcagtgacagagagagaccctgtctcaaaaaaaaaaaaaaaaaaaaaaacccaaaacaaaaacaaaagccaatcctggtctggaagctggaccctgcatccaaccctggggaatccactggggagaatatggagacaagagaaagaagtccaagcagtaatcagccattttggaatgaggtaggataattttcaaaacagctccatagctgtgccaccatgcaagctaagcaaacaccatctagggtgagggaagctaagagcacagatgctgctatttgaccttaagcaagtcactttcatctatctgagctccagttttcttatttataaaatgggggtgataataacaatgcctacatcatagcgttgtgatgagtaaatgagatgatgcaatgcattcaacaatgcaaaaatgtattatcatttaacgatgccatgtatttaacaacgcctgtctaatagtaagccatttgctttcagtaactaaatgtagactgtattaggtaaagaagaataaaataaattatcctcttccaaccaacccatcagtaggaggacattccagacatgtgataaaacagaaagattttaggcccaagttctagaactacagttatcttatttccattaggaaatacacttattgaaactcacagagcttgtttccaggaactgccccggaatataaacgcttggtcactagggcatatatttcttggctggagctctgccccaccctgaaacacaccccatcagagagcagcaataatgtaaaatggcaatgtgttctctcttgccttgtcaaatgcctaaaaggcatatattctttgatttacgaaaggagaccctcaccaaacacatgaaatattacagcagaacttgcatctagaactcagtgagaatgccagatgtcctatactcctattctgccatcttttgttggtgaatatttatcattattacattacaaacacaatataagtcctgaatagacatttaggaaatacagagaaggaaaaacaagaagataaaccaccatttaggagcaaaaaaatgttgttaacatattaatatctatccaaactcttccctctgcatgtttaaattttaagaaataagagatttttaaatttaaaatcactgcttaaattatctctctctttctctctctgtctctctctctagtttatcattaccagttcaagatccagttcatcaaccaaactgagacaccaatacaaacaacttttaccatgtcactactcggaacaaaagagaaaatgcagaaaattcccatcactctgtgagtaggaggtgtagccccctagggtgatgacacacttatttttcttgcagaacataaatggactctgtaattttcaagagtcaggccagctacaactactttattccagacgcaaaccaaaaactatctgagacacatgtcaatcaatttagtttattttgccaaggttaaagacattaccgtgacacagcctcaggaggtcctggtgacctgtatccaaggtggtcaggctacagcttggttttatacattataggaagatataagacatcaatcagtacttgtaagatgtacactggtttggtccagaaaggcaggagaactcaaagtggtttggggttggaggtgcaggggagcttccaagtcatgggtgcattcaaagattttctgattggcattggttgaatgagtttatctaaagatctagaatcaatagaagagagtgtcgggattagataaggggttgtggagaccaaggttcttattatgcagaagaagcctccaggtagcaggcttcagagacaattgattgtaaatgtttcttatcagacttaaaaaggtgccagacttagttcattctctcccagatcagtgaaaagatctggatagggaagggaattctctacagaatgtagattttcccaccacaagacagctgttcagggccctttcaaaatatgtcaaagaaatatattttagggtaaaatagtttaatttctttcagggcctgctgtctgtcatgtgatgctatactagagtcaggctggaatttggtgtcttattgctacaaaaagtctgcttcatcagtcttaaaatctgggttttaatgttaatgctggtcagttgtgcctgaattccaaagggaggagagtataaagaggcgtgtcccacctccccttcccaccatggcttgaactttggaatgcccttggctgagaggaggggtccattcagatggttggagggcttagaattttatttttagtttacatgggcttgagcatttaagcaccaatcacatacagggcactgtggtaggcgccagatactacctgagctagctcttacctacagcagaaaactcttggtccacaagtcaactcttagtgtttggttctttttgtgaacataaataaatatttggtgcttcagaaacaacccctttagtaaacacagcccatcccacatggccatcctggtcagacaggacatccacccaagcccgaaccctcacgtccctcctcagcctctccagctcccaccaactgctcaatgttatgcactgtgggctgagcagacagggaagccagagatggccccactagggcctgcagtgcagaggcaggtggtgaggggcggagcaggtgttcccaagaggtcccaagagcctttccagtgagttcataacccagaaattcaagtggtatcttttgacttggcacagatttccaatttcaatcagcctgctctgccagcctccccatctgtccttcaccctgttacccacctgctcactctgaggctccccagcctctctggcctctcaaccctcagcatggactctccctggaaagtgacactagcccctcacccactccagagatgatcctgagcttcccgaaaattgcccccagctttggatctctgatcatcacactgattcagtcattcagcaagcatttgttgatgctctgtccaacacctacctaaggatacagaggaccctagcctctggatgctcacaacctggcagggcggggggattcctaaacaattcttcacagcatactcgggaagagctatgccaagccacacaagggacccccccccaaccccaccatccatctgcctcgccctaaatccactgctgcctctgcactgccaaaaatctctcccaggggatggttctcaatagtggaaagggcatctcgctgctctgtcaacgttgggatattttagtgtcttggagattagtgagtaaagctgatcatgatacctcagagtctgcatttaaatcttgctctaaatcggtgcatcctttttatgtgtagtttttctattactgttatgcctcactgttttaacagaggtttctatttatatggggggaggagcattacttgggagagagtgcatgctgcaggcatactatgttaaacctacagagagctgaactgtccagacgccgttgccaaagccccactgtctccacagcggcttcttcctagaagctaagctagagaaagttaactagatttgttatagtgggacttctcggagcctttttgatgtgttaaccagaaaatagtatagttttcgcaattttattatctggaaatcccttttttatcctggcacacctactgctaactctatcaatagtctgttgaacactagtttgggaaatgcagcaaaaatcccaagtcattcagggaaacacaacacatcctgaatgtgtgtgaccgtcactttgctgttacgactaaactgattgtgtctgattttctttgtgtattcaaggggcaaaggaattgctagtaataaaacgtattcctttcttatcacgctggatgtggatatcggcgagctgatcatgatcaagttcaagtgggaaaacagtgcagtgtgggccaatgtctgggacacggtccagaccatcatcccatggagcacagggccgcgccactcaggcctcgttctgaagacgatcagagtcaaagcaggagaaacccagcaaaggtgactgctgattcaatctcctattaacgtccattaagcacccacttgtgccaggcagtctcacaatttaatactcacattcatcatgtgaggtgagtattattaggccctagtgatggagtacagaagctcagaaaggtgaagtgactatcccaactttacacagccacaggtgccaggacaaggattcacacccaggtctttgaatacacaccagggtctccccactgcccgtggctaacgctgcctgcctctggagcctgaggaccatcacacgaaccccaggcttctcaagcttcggtgcaggtgaatcaccaggtgatgtcagtgctgccagtccaaggtgctgtggtagatgcaacatcttttttttattgtttgcccaaagaaaatcttttaacagatcacaatatcaaaaatctcgatgtatctctctctctctctctctctctgtggtcgtatctttcaaatgtcagttgccaaagaatcactgggaagccaaacacatttgcagaattcctggacctacccgcagattcatggtgggcttgggaaggggtccaggatgcctgttgttgaatcagagccctaagaaactccaatgtagaacaatgggtcacccgaaagaaatgctgctgtgtttgatttaacatctcccgtggccccaaagtctccagggatacgaaggagctggggtggggagcaaagaaaaggaaggacagggctgggcgtggtggctcacacctgtaatcccagcactttgggaggccttggcgggcggatcacctgaggtcaggagttcaagaccagcctggccgacatggtgaaatcccgtctctacaaaaatacaaaaattagctgggcgtggtggcgcacaatggtagtcccagctactcggggggctgaggcagaagaatcagttgaacccaggaggtggaggttgcagttagccgagatcgcggcattgcactccagcctggatgacagagagagagactccgtctcaaaaaataataataataatagaaaagaaaaggaaggatgctccagcgctcctgaagtcctcccagcaaaagaaagggctgcccagcacaccctgccatagcaaccgtgcttttcggtcatccgtggttctccacggcagaattccaggcatccccgggccctctcctctctcttcccttctctattcaggaaacggtctctcctctcccaccttcacttgtcgcgaaggccatgtttctctttggcttgtcctcatagaggtggaaaacagcaggtttctaacctctgaactaccctcttccgtcaccccctgggtttcactgccagatgccggcctgtggcagatgtatgcccctgagtccctttatacaaccgcactctgagattttatctccctgggatgcaaaatcctggcaattactgagagcatactctgccgtctgccaacagatctcccaacaggatcaatctgggaagattaaactgctcgctcctcttctgcactgagctcttctcacatgactctttggcccattggagcagcgctgcttctgagctctgaccctgcccagatgctcttagctggagagtaattcctcagtttaggtggctgctcaccctgacaatcccatgtggcttgacctgaaagggtggctaaagcacaacactaccttctccactggggcacacccatgtggtacggaagaagaaatgaggagagggaggggcctggcccttccagggctcccacacggggtgagcattgaagcaggtgctccatggcattggtctcacgtgatctttgctgtgatcctgaaatgggtagtattggctgtgcagattaggaacctgaggctcacagaagttacacagcttgaggacattgctcaaaattgtcccagtccagatttgactgggatttgtctgatttattacccatttgttgggggtgtgctgtttccaacagttccttcttccattagttttggttccattaatctgaattttctcagtctaatctagcagagttgcagtgctggacattaacatatgtatgcatcaaacccatccttagggctgtaggaggtactgtatgcgggttatgggagctataattttttttaggttgtaaataccgagtgcctcctctgtgtctacacagtgccaggtactatcggagaatacaaaaaaaaaaaaaaaaatctgagttgtggctcttggtagaaataaactccaggacctaaccaggaaaataagatgaattaattttactaacggtgtggtccatcccagggcttctcaaactttcacgagcatacaaagcatctgggaatcatgttaaaatgcaggttctgctttagtgagtctggggtgagcctgatgttctgcatttctaacaagcgaccaggcaatgctgttgctgcaggtcaacagaccacactttgaatagtgagagtccagcattacacaacccgggaagtgtaagaagaaagttcagacccgtacacttggggctgtgctgcaacatgctttgaggaggccaagaggtgttcccagggagacaggcagccggcaaagcaatatggctggcaggatcggatggactccagtgtcagccagtcctaaactcacattttaacttcactgctcacaatctgtgtagcctcaaacaataacttcactcttcaagactcagttgtttagtgataaacgagaatcataatatacatttcatgagactaataacaactactaattttttagtgccttttgcagaccaaaatcccagaatcgggatgggaacattaaactctacactcgtaatatcgctgctaagtgcaagtgggaaaagaagtaggttaagtaacttgctctgtgcctccatggaagaaattcagtggaaggtggttttcttcccccaaaggcacaaaatcagggatgagtagggttgtggagatggtgaagagaaagagaagaaattattggccctacagcaagaccaagtataataactggctaaacctaatgagaagacattcaatttccacagtactcatataaatgcaaaataaaatcaaagaaattatcactggttactcattagtttggcaggaattcaaaaacggacaacacccagagttagtaaagatgtggagaaacgggcattctcatacactattagtgagagtgtaaattacaggcattttgtaggggaatttcattcaacaactaacgtttagtgagtacctaccttatgccagacaatgttgtggacaccagatgtataatagtgaacagacaggctgggctaaaatacaaaaaaattagccgggcgtggtggcgcatgcctataatcccagctactcgggaggctgaggcaaaggaatcgcttgaacccaggaggcagaggttgcggtgagctgagatcacaccactgcactccagcctggcgacagagcgagactccgtctcaaaaaaaataaaaaatatatatatatatatgtatatatgtgtgtgtgtgtatatatatatgtatatgtgtgtgtgtgtgtgtatatatatatacatatatatatacatatatatgtatatgtgtatatatatatatatgtatatgtatatatatatatgtatatgtatatatatatatagtgaacagacagagtccttggtctcatgaagtttacattatcacatgtttaaatatgcatactactttgagccagaattttatttctaggtgtcttatcatctttctggagtatctgtgcacataatcaaaatatgcacaaaggctatatatgaatacatatgtacagaatgtttgttgcagtactattaaataaatactatacataataagtaaatagtaaactcttgagaaaatcttaatgtctaacagtaggaaaatgcattgtggttcatccttaaaatggaatgtcatgaagcaggtgaaaaatagtgaaatagacttctacctactgatatgagcaagtctctgagtaccattttctggtaacaggaaaaattgcaggaaaacatacacaacatgatgccactcaatatatgtaaatgcataggaacaagtctggaaatgcataaaccaaatcataaatgtagagaggggagtgatgttagtgaaggccgatggtgaagaggttctttattatttggcttcatttattcctttaccatttgaattttcaagaatgcattcacaaattactcatagcatttttaaattttaaaagtccagtttagtgaagacttgaccttagacgcaattcaaagaaaaaagaagtaataaactagaatttttctacagatatatctatagatatatatttaacagatgcaattggaaataataacacaaaatggtatctcgggccaagccaacagccaaagcagtctagttgttgtttccaaaacacatagtagtgtcctctttagtggacaatgtcagctccaatatgaggaaggggcagggcttacagggctgagccaggcagaaaccgatgacactggcctcatgccaaggacctttaagaacagcatttacaaactggagcttgtccaaggagggaaggctgaggaggtaagcttgccttaggaggaagggttgaggaactagaaatgtttgccctgaagtcaaggcaaatgtggtcaaggaaacaatagtcaccctcaaatcttcgatgagctgtcataggggagaacaaaggagggctgccccaggactttccttcttacagaactgaaatcaccccagtgtagaactccaggaagtcttacactgatggctttcactgacttgggttttgtttttctctgaagttacaaaaatatttgcgaacataagaatctaacttaaaaaaagacatcacatgccttacacaaattgagtgaaatttgataaagaatgaaacacttcaataagctccacctaaaacttaatgctgtgtttgcttcctgttttctattcagaatgacattttgttcagaaaacacagatgacctactacttcgcccaacccaggaaaaaatcttcgtgaaatgtgaaataaagtctaaaacatcaaagcgaaagatcagatgagatttaatgaagacccagtgtaaagaataaatgaatcttactccttatctggaatggctgccttatttagaagccaaaattacataaagaatctcacacaaagcttaaataaagtttagatttaaggggggtatgtttcactctcataaactgagcttttaaaaacgatatgatataactattttccagtatcagtacaaccaaaaatgtcccaattttatctctggttaaatgttaatatatgcaaataagtacaaatgcaagagccattttagatctgttgttctaatttacaatgtcttttataattaagtttcccacatgtccttgctagtttattatgacccatttttgaaccatgctagaaagatacttttttattaggtaactagtgcttcaataaagcaagattctaattaatcaccactagttgtgtataccaaatacacatcctttaagacaatacagttcttaaaagaagaaaaattataattattctaatatttatacaaatcatataacgatttcacagaaccaaacacttacaagtagaattctactaaaactacttgtgataacagtgaaagctagacatgtggtcattttaataatggaattacaaattaaataaacataattattatatcttactaatgcttgcaacaaaagctaattttaaaaacttggaatgtctcaaagcatttgctatggactgaatgtttgagtcaccccaaaattcatatgctgaaatctaatccccaatgtgatggtgtttggaggtggggcctttgggaggtgatcaggtcatgagggtggagccctcataagtgggattagtgcccttataggggataaaggatcagaactctctgccatgtgcggatatgagaaggcaactatatgcaaaccaggaagttgaccctcacctggaagtagactaccagatctgctggcacctttatcttggacttctcagcttccagaactgtgagaaataaatgtttcttgtttaagccatccagactatggtaatttgctatagaagcctgaactaactgagagagttagatgtcaaatttcaaactgtccaataagtgaaataataatgttttgaccagcaaattccatcacaaagcacatggtgacaatggacgctaaatatggtaatcagttagatatgtgttttacataattcagagaggaggaacatgttatgcacattaaacaagctaacctaacttgcacttaggctcagctatatacagaccataattcatattctcttcaccaaagcggggtaaactggggctcatgaaaacaaaaatcctggaaagatgtctgcctctgactaatcaatttaaaattatcttgcatgattcacttttatttccctttgaaagacctagaaatctaaaacttatggggtggtgggataggaagaacagctggtcaatgtttccaaatgaagcattctgtcctgaatgctaatcttacctgcaaaagtatttgaccctacttttagggaatgtgtgtgagtgtgtgtctaaaattgatagataataaaatgaacatttcccattatgtctagaatactaaggtttacaataaaatgtttgcattggattgccaggttttatcattaacgatccagaaggaatttagaatatcacttttgaaaaacaacagggaaacactctttgctgtatatgcaacagagtccatgcatatgtattccaggagacatgtatgtgagccttgaaatcatcgcagccagaaacagcccaaatgtctgccagtacgatgcagaaatgaactgggttatagtcttgctaatggactgtcgtacaaccgtaagaaagataagccaaagctacacacacaaaagaacagagctggggccagcgtgaggcagcgaggcatctagggagcaacatttaaggaagcactcatgcatttttcgtttgcacaaagacacaaaaaaaggtatagtatgatacaaacaatggataaacacctgtaatcccagcactttgggaggctgaggcaggctgatcaattgaggtcaggagttcgagaccagcctggccaacatggtgaaacccggtctctactaaaaatacaaaaattagctgggcatggtggcgcatgcctgtaatcccagctacttgggaggctgaggcacaagaatcccttgaacccgggaggcagaggttgcagtgatctgagatcgcgacactgcactccagcctgggcaatagggtgagactccgtctcaaaaaaaaaaaaaaaaaaaccaaaaggaaacaaaacaataaaatcattatcacaaaaggaaacaaaacaataaaatcattatcacaaaagtgaggctgtgataatcccaggaaagaggaagggcaccctggagttccaggtgccagcaatagtctacttcttactccaggtggtgggtacacacacgttcactgatttaaccgttctatatacatctacatttcacgcactttttagtatgaatgtcacctttcacaatgtgaaaattaaaaagggaaaataaagggcagagttaaacaaacatgtttctactatagtgtgatatgtttcaaaagtaatatagtttcacaagcaatataattagaaattatttcatctttagtaagaaaacttgaagtgccacaatacatggtaacattttgggcagagaattcaacaagcatccaacgtgacaagtggttaactggaacatttgaaactcctcttggcatgtccaaatctggttgccaattctgttgtcggtggattattttcacttggagggatgtgttcatcgacatcacattttcttaagtatattcgagtagggaagtcaaattgggaaactgaataatgcagtcacatctgttcgttgcacatgcaaaatgctggctcgtgaactgattatacacacctctctccaaagaatctgcatttatgagcccactcaggaaagataacactagcatcttgccttttaggcaaaagcttatttgtgcttctcttgtaagagagcactgggaaagaaatggaatgtcgattacactgcagctgggctctttgaggtgagtaagtcagagagagaaggaaacaagcactccattcaacattaaaatgaacgcactctgctgcatcgcaaagctccctgtcctcaatgttcaccttgagtcatgtcggccgcaaatactgcaaaagcttggattgcaatacacgtctgtggggcagcaaggcaaggggtaaagctgcccagtgctgtgcttgccctcccacagaggctggaccaaagtaaagtcagagggatgggaaatagacaagcaagatgaagactaaagaaagtcagtcccaaaagggaccatttacatggtcccataatacatacttctatttgaatcccaatgatccgtacatgattaatggctcccgacacatctcattccttcccttctcttatcccttcctccttttcttttctcccctggaattgctctgcctaacttagtcctatttatctacccaggcccagttattttcaccagttgcctcctagcctggccaggccacagagatctttctctcttctgagcgcctggcaatcacataagtgacgctctccgccatccacttggcctttagttatttgtgccccgctgattcccctccaacctcccagcctccctgctgctccctgccctccattcaaccattccaggggagcccagacctccttccctactcgcacgtttctctctttataggcaatctcacccactcctatggctttatttatgatcaaccacataggccaaccattctcagtgtagagctccagcctgggccttctctccagacccgtattcccatatattatgcaattgtccattccacagttcccgctgtgtcatctctccctgcatccaaaaatgaatgcatgatgtttcttgcccctggaacctgctcatccccattctctctgttgtttatctccttgaaggtcattaccacccacccagttgctggtggtggactctggggagtcatccattatgtgtcctcccctttggcccctcacaatccaatgatcaccatattccatgaattctactcttatttcttaagcgtgtctatgtctccccacctctactgccatcaacccagcccaagccgaactatcgcttacccagacatttgcaacaactttccaactcatccctcagacaccctcctccctctcaatcccttcccctcacagcgaccagagtgatcttaaaaaaaaaaaaaaaaaaaaaaggttatatcattttcctgcataaagccctcccaatgacctcccacgttttttggaaaaagtccaaaataattaccctggccttcaaggctcccagtcaagcccctacttttctccccagtcttgcctcccattactctctgtctgtcactcactaggccattgtccagctccacccacggagtgtccgcccagcctgcattttatttttaatttttatttatttatatatttattggagacaaagtctcactctgtcacccaggctggaatgcagtggtgcaatcacagtcattgcagccttgacctcctggggctcaaacaattctcccagctcatccttccgagtacctgggactacaagtgcacactgccacatccatctaattcctaaatgttttgtagagacaggggtctcactatgttgcccaggtttagcgtgcactttagaaatgcctgaggagctttaaaaactagccctgcctcagccccacacctagagattttttacttaattggactagggcagggcccggagattaagactgttgaaagctccccaggtgatcctaatatgcactaagtttgaaacccagaggtctagacaacaccagccacctcagttccttcaaaagcgcaaagctctctccttggccccttctgttgcttacactcccacctctcctccattgcatgcttgcagctccaagttaggtgttactgcttgggagatcatttaacaattatctcatcctacccgagcttcaagcagctcaccctgccatccatagtcaatgtttttttattctcctggtgaaatgatttgtggccatgccatgcagagccacattggagcctgaggcaaaaggaaaaatcagtaatagtgaacctgtgtttatttatatatttattttttagatgggtctcactctgctacccagactggagtacagtaacatgatcacagcccattgcagcctcaacctcctgagctcgagggatcctcccaccttagcctcccaagtagctaggactacaggtgcatgccaccaagcccagataatttttatattttctataaagacaagggttgcccaggctagtcttgaactcctgggttcaagcaatccaccctccttaccttcccaaagtgctgggattacaggagtgagccactgcacccagcctgatcttgctgtcacctaggctggagtgcagtggccaaatcagagctcactgcagcctcaacctcctggacacaagcaatcttccggcctcagccttccaagtcactgggattagatgtgagccaccatgacagcaaaatgtttatattttatgtatcatagatttttgcattcatttccattagaaaaatttttgcattaaaaattttcttgataactgagtttttggagcccccttacatttttgcactcaaggcaagtgcttcactagctttaccctagccgtaggcctgatctttgaaatggtttctttactgcctttctcccccactggccttgaagcttggtgaagtcagggagaggctctcattgttcactgcattattcccagtgctcagcctatcacctggtacagagttggcatcctgtaaatgcttgctgagttaataagtgacaggtatctcttcttatctgtatttttttcctcttgattaaatcagaagcttcagctaccacacctgtccaagatagagttcactgcttcctcattcagcttagaaacaaagccaggttggcgaggcggttgacttcctccctccctcatctcttggccctgccggcctcctcttacgttagctcagtttctgcctcaatcagttcatcaaaatccctttgggttccttgactacatttttacttttgaaacacgtctatcacaaaaagaattttccagtgtcttggagctatcttcctgtcaaataagatagaattagagaataactgtaagggtcatctacaacatccctctcaacccattctgtgcacaggcaccttgttcactggcatttctgtcaccgtaggtctggggcacatcctgacagcaggcattcctaacaagctctcaggcgatgccattgcggctggttcccaggccacgctgagcagcgtgaatgtagaccagtgtttcccaactttccccaatgatatgaatcacctgggcactaaaaaataaagcttcccagactcctcccctggagattcgaattcagcgggtcaaggacagatcctaaagatttttcttttcaacaagtacccgggctaattcatctcttcagaaaactggggcaacactgacggagtccaacaccttcctctcaagagaatatcacaggtgtggcccagcaccgccagggaaagagcttcccctaccttgccgtaccttctcccctcgctttcttccctggaagccatagagagcaaatcaaacacatcagctatctgaagacagtctgcaggagactgtgagccccttgagggcagaagttgtaatgtatttttaggttttgttatgtggttattttaggtttctcattttaaagatattttataagagtataaaagcagtgcaacaatgcaaagatatgtaaagagaaagctggtcatccgtctccccgcacccaccttcttccccaccccagcgacccgaagtgaagattggtaacagcctggcaacgttattccttcgaacatagacaagcatttatccacactcaaggcttttgtttgcttgttgttttcaccaaagtggaaccatcgtatatatattactctacaacttgctcaacttgcttgctttttgtttctgtttttgcttctttttttttttttttttttttttttttgtcttagtgacttattcgtatccttacatgctaaaagatatggatcttttttctaatttccttttttttttttttttttttttttgagagaaatctcgctcttatcccccaggtttgagtgcaatggctcgatctcggctcactgcaacctccgcctcctgggttcaaacgattctcctgcctctgcctcccaagtagctgggattaagtcgcctgctaccacaccaggctaatttttgtattttttagtagagatggggtttcaccatgttggccaggctggtttcaaactcctgaccgcaagtgatgcgcccacctcagcctcccaaagtgctgggattacaggcgtgagccactgctcccagcccttttttctaatttctgtatgcctattatacaatatttttttataaatagaagtatacatgctggaggggttagtgcaatctttttcctcctcttgttacttgggtcaatgccctctcccctgacccatgttcataaccaggagtgtaattctgaagtttttctatagtcatatatactaccatatacagacatccccaaagagaagggacttgttactgtttcacaaacatgtaattatacattcttttcagcaaattgatttccttactcaacaatatgagctgaaatatttctgggtcaattggtacagatcttattattttttaatttttttcttaattttttagaactccagtctgttgtccagactggagatcagtggccctatcacagctccctgcaacctcaaactcctggcctcaaacaaaatgcttggattacaggtgtgagccacagtacccagcctcactacttttgatgattgcataatattccccattgtagacagaaccttaatttattgtcagtctcatactgatgtgccttcacttttctccagctttttgcctttctgaaaagtgctgcatttaacatccttatacatgtattctcatatacctatttgtgggaaatatttctagtagtataattttttttttttttttttgagacagagtctcgctctgtcaccaggctggagtgcagtggtacaatcttggctcactgcaacttccacctcccaggttgaagtgattctcctgcctcagcctcccgattagctgggactacagacgcatgccaccatgcttggctaattttttctatttttagtagagacggggtttcaccatattagccaggatggtctccatctcctaacctcgtgatccacccacctcggcctcccaaagtgctgggattacaggcgtaagccaccgccaccgtgcccggcccttttttttttttttttttttttttttttttttttttttttgagatggagtctcgctcttttgcccaggctgaagtgaagtggcgtgatctcggctcactgcaacctccacctcgcgggttcaagcgattctcctgccttagcctcccgagtagctgggactacaggcaccgccaccgtacccggctaatttttttttgtatttttatatttttagtagagacggagtttcaccatgttagtcaggctggtctcgaactcctgacctcaggtgatccgcccgcctcggcctcccaaagtgctgggatagtagtagaattttttaagtcaaatgatatatatttttaaattgaatagatgttgccacattgctttcctaaaacattatcacaatttgcacttccaccagcagtgtatgaacacctatttcccactccctacttctttccaaggcagaaatatttattgctcattttagtttttgctagtctgctgggtgcaagttgtgacttcattgtgactttacatttccctgcctactgctgagattgagaatctttgcatatgtttattgaatttgctttactgtgaattaattgttcaaatcccattttcttttagaacgcttctgtttcttgccagtttgtaagaactacatattttatgacatatagtaaccttttattgttcagcttctttgcaaataactttctaagttaatttctctattgattttagctacgggttattttattttattttattttattttattattttattgaaacagagtcttgctccatctcccaggctggagtgcagtggcatgatctcagctcactgcaacctacctcgcgggttcaaggttattctcctgcctcagcctcccgagtagctgggattacaggcatgcaccaccacctctggctaatttttgtatttttggtggagacggggtttcaccatgttgcccaggctggtctcaaattcctggcctttagtgagccgcccacctcggccacccaaagtgctgggattacaggcaagagccaccccacccagccttgattttagttatagtattctttgctgtacagtagtttaatttcctttaggtcaaaaaaaatctaacatttctattatatggaatttctgacttgaagtcaccattgaaatgcaaattgttgaaaataaatattttcttctgagatttttggttttgttccttaaaagccttaatccatctgagatttatttttgtatatagtgtgagatagaatgacaacttaattttcttctatatggatacaagtggagccaacgttatttattaaactttttcatgctgaattgagatcccacttgtatcataaatttaaagtacatgtgaactatttcttaatcctctgttttgccgcattgatctctttatttctatttctcattatttctattgtaatcacacttaattgattgcaagcatctagtctttcatacagactttacagtaatttcccaaaaatctctatttcccaaaa

SEQ ID NO: 358 - DNA, 159139 bp, Homo sapiens
gtcagctaaataatctgagatttctaatacttttaatttggcttttacaatgcaatttatcttagcttttttgatttcttaggtcatatctttagaactatatatttgaatgttaatgtaattttcatattgaaattaaaatgttgaactgcgatgttaagtgtttcctgtggaaaaacgttcacattttctctagttttaaagttgaatcaagctgtttgaagattttcacatttcttctagattttatcagcttgttactttatctgtcactttctgtgatttgcagctggagggggttcctcatgcagccctgtcctttcaagaaaacaaaaaggtgattatttcagaaatcagagtcttgtgttgaatcttactgattttcttgtatttctgtaatgtaatgtatcttgtatttcttgtaatactgtattggactctgtgtatatctcttctcagatgagtgattatatgtgtgaatgttgctggaatctgataaccaggcctgaatagttttgtagggtggcttttaaaaattactttcatatcagaattgctttgtcataaattttgaacgcatcataaatttctaatgttcggggtcagcagactttttttgtaaagggacagagtgtaaacatcttagctttatgggccatatggtctcttttgcaacattcagctctgccctgtgacaggaatgcagttgtaaagacatgagctactggccagctatgttccagtagaactttacttacagaaacagacaggctgtagtttgccaatacctgccttagggaatgtgttgttatattttgtgagttaccttctcagtaaattttatttagtattagtcaggaatattattaagtagcttcttttccagcctggtcaacatagtgagacccggtctctaccaaaacaaaacaaaacaaaaaaacagccacgcatgtggcatgtgcctgtagcctcagctgctgctcagggggctgaggcaagaggattgtttgagcccaggagtttgaggtcacagtgagctgtagtcatgccactgcactccagcctaggcaacagaatgagaccttgtgtcttaaaaaaaaaaagtttcctttgttgggttattttaatttggacctggttatcatttttcagccatatttaactttgtacatatcagaatgttctgataaaacttaacttttattaaagtgtttgtgatataatctgctagttttggtacacattatcttttgcaatgccagttattttcttttccagtgtgggtttgcataggaaaagaattgctgtcactttctattttgaaatcttaaaagactgatccttttttgtgtcatgatttgagtatttaattgagagcctaatgcctaatattatttgcagtattaaatgggatcttaacaggaatagcattctagccttcattgaattaagtaaacatttcttaagagaacttggaatctataatatttgcgtcatcatagtatgagatacttaatcaagtttgagattttagtgaaacattgtttagaagccaaaaggattctaggaaaaattaatgtctatattcttgaattaggagagattttgggacgtgtgactaagttacgctgacacttgtttgtttcttagtcgctttttccagtggcggtgagaacgaagatgactgattcacattgctcagatgagtttatcctcttctggctgggacatgggatatatcctgtctcttttaagcctttttggtatttttcccccattgagagctgtgtcttcaaactcttctgttatagctggaaaatcctttttaagtgaaatctgcccaaattataagacagatgaaggtagagttgtgttggatataggattagggtgaaagtagtgggggtgtcctggagcctctcttctggtggcagcctagctcttgtgcctttgaggaaattaccctggggacggctctgtggaacatatttgcaaaccactgatttggaagatagagatggcttttgttaagatctgaattcacctttttggcattttatttgatttctcaaggtaaagaacttattttgtaataaagtttcctattatttagtagataggccaagttgctgtgttaattccatgtagattttgggtttcctttgctcattttttcactcttaatctcacatcattgtaagtttatggaagttatcatacttctgactttttctttgaagagcagaaattagaaattcccaataattattttgatagtgtcatttaatgacactcacatgtgatgtagccacaaagatttaatgagttcagttttaaatcatattaagactgttggtttcatttgttctcattaatgtaattctgaagatgaacaataaaatgtatttttagaactttcaaatgaaatattatttcatccttccagatcatataatgcttaagttctgattgttaatcataaagtctagaaaattaaaagataataaaatgaaagtgacttttaggtattagagttttattataaattctggtgtgtcattggagctatgacatgaatatttcaaaggccaatagcattggatctttacagttataacttaccatttttaagtttaagtagtaatatagattatttaataatcaaaatcaataaatattaattattaaaatgttttgtggtatagtttgagaatcattgcttttaactttttccatataggtttattgactttaatagcattctaaacataacatctctacattctttgtgtttaatactgtggaggtataaaaatacttatatatgatgataaactatattagagtaaattaaatattcttatgagtttcattttagagtgcatttacttaattttgaagtccttatttttagcaaactaaaaggaatgttggtacattatttactaggcaaagtgctcttaggagaagaagaagccttggaggatgactctgaatcgagatcggatgtcagcagctctgccttaacaggtagttctcactagttagccgctggtgtggaccttcactgtctgccttccaccccttgcccttcctgctcgtccccctgcacctggtggacagcacgactgggggcagcagtggagccaggttgcttaaatggggcatattcgggcttcttttataatacttactctgaagcttgtgtgtctgtggtgtttgcatcatatatttgttgttttccatggtttaggctgttttaaaattaggtttatggcttgagcatagggctttgtgagtaggggatggcaggtcgaaacatctcatgagttggatgggttatgctgggggttgggaaatgggatgaaaaattatgggatgaaaaattgcctatggatagtttaacttgaaagaatctgcctttgtttacagatagttatcttttttcttttttgagatagagtctcacactgtcacccagtgcagatacccagtgtcactggagtgcagtggtgtgctcttggtgcactgcagcctccgccttctgggttccagcgattctcctgcctcagcctcccaagtagctgggactacaggtgcccgccaccacgcttggctaatttttgtatttttttgtggagacgggtttttgccatgttggtcaggctggtcttgaactcctgacctcaagtgatctgcctgcctcagcctcccacagtgccgggattacaggagtgagccactgtgcccggccagttacagatacttatctaatgaaattctctgtgtactttataaaagatgaggattaactgaaggtactaataactggattatatgagggtggttttggttgtataatcctatctaaaagaatattttagctataactgaaagtaagacttaaatatttagagaggaaaatctgaataattctagtagtaattatttatttacaaaataaaaatagatttttttttgattacacaaattaaacaacaataaaacatcacagcaatccggatactataaagctcacatgcttaccgacccaactgccccaggagtgaccactgccaacagcttcatgtcgacctttttgccataatttttatatagccttttttgtttttaaatggtaatttagaaagtcaactaggaaaatgtgttacaggtttatcttccaggagaataggactggagtcgagatcttgaatgtggcttggaagaaggcaagcccaccccagagagatgagttgacagttgtttctgaccactgcttgcttagagggcctgcgtgtctgtgaccgcctagctttgcgcccctgactaggctgccccttaattacaaatgtctttatatattgctccagctaaggcttggagtagtcggttaagaacttgaacttcggtttttgcagtgaaacagcatttgagaatatcaccttctgataagccttattttataaggtgggtactgtagtgggaggcagtgtgagagatgcttgaaggatgcactgctgtcctgcatttcagcatcttcaggatgctgtgcagctgaaacatttgataacggtggaactgttcgttattttgcaagcctgtgattccctattgaatgttttctctcgccatttgacaaatgagtgtttctctgtcttcagcctcagtgaaggatgagatcagtggagagctggctgcttcttcaggggtttccactccagggtcagcaggtcatgacatcatcacagaacagccacggtcacagcacacactgcaggcggactcagtggatctggccagctgtgacttgacaagctctgccactgatggggatgaggaggatatcttgagccacagctccagccaggtcagcgccgtcccatctgaccctgccatggacctgaatgatgggacccaggcctcgtcgcccatcagcgacagctcccagaccaccaccgaagggcctgattcagctgttaccccttcagacagttctgaaattgtaagtgggcagaggggcctgacatctttttttttattttttatttgagacagagtctcactccatagtgcagtggaggccgggcacaggggctcatgcctgtaatcccagcactttgggagactgaggcaggcggatcacttgaggtcaggagttcgagaccagcctggccaacatggtgaaaccctgtctctactaaaaatacaaaaattagttgggcgtggtggcacatgtctgtagtcccagctgttagggaggctgaggcaggagaattgcttgagcctgggaggcagaggttgcaatgagccgagatcgtgacactgcactccagcccgggcaacagagcaagactccatttcaaaaaaaataaaaaaataaagtgcagtggctcgttctcagcccactgcaacttctgcctcccaggctcgagcgattctcccgcctcagcctcctgagtaggtgggattacaggtgggcaccaccacactcagctaatgtttgtattttcagtagagacagggtttcaccatgttggccaggctggtctcaaactcctgaccttagatgatccacccaccttggcctcctaaagtattgggattatagttgtgagccaccatgcccggccctgccacctgccatcttttgagttcttccctggagacctagacctgaaccctcctgcttgttctcttgttatctaatacccctattgacagcgcagcttagatcattaatggagagcttgacctcatctgataccttcactgaaggaaacaacttagtgtcttttgtgttgaacactgaggtaaaaaattggaatagttgattatatgaactctgctaaaattgagtgcattttacattttttaaggccttgttgggccctggttaaataattatttttaaaaatccttaaggagcctattataaacagatctgtggtcttaatgaaatgtgattaatactgtgcattattttaagaacttttgacttttcaaaaaacttttacaacatttcccatttgatagcggcataggtttaagcacttctcatctctaagttagtggacaaaaaaccctcatggatagtctaataatgtttgctacaagtccatgttgagttttatactccattttattttcagttttaaaaactgtggttaaatatgtgtaacataaaatttatgttcttaaccattttttgcgtatacagttcgctggtattaaatacatttaaataatgtcatggaatcattgctaccacccatctctgtaaccttttgatcatgtaacactgaagctctgttcccattgaactctattcctcctttcccgccaagtccctggcaaccacgattcttctttctgtcttctgaatttgactactttgggttctcatatactttaggagtcacacagtatttgttttacttagcataatgtccccaaagctcatgcatgttgtagcctatgttagaacttcctaatgtttcaggccaaatactattccattgtatggataggccacattttgcttttccattcctctgtccatggacacttgtattgcttcatgttttagccattgtgaatcatgctgttatgaacgtgggtgtacagatagctcctggagactctgctttccatttttttggctaaatacccagaaatggagttgcttttacattccaattttaatttaaaacattcatatcattgagtgttttacttaatagtatagtagttaacaaacttaataaaatagtattttggtaataatttgctggtagtccattgttcagtttttttaggtaaattacacaggacatttcaagtggacatgaaacatcttgtgatgtggaatcatgccccaagctgatggctaaacatatgaaataccataccctaaatttagtagatttagtctttgcaatttaggagataacctgttatattgttaggtttttgtcgaaaagctttgtcctcatatttccaacttgctgtaaaatttgtttgtgaagacaaatatttttgtatgggttttttctttttcatattaaaaagaaatgtccacattggaatttttttggagtttttagagctaatagagcttttcataatgtagtgggaatgagtgatcagtaagctcttagcagtttccatgcgtgcatttctgtgccttgaaataaatgacagatgagtacatttgtgttctgtgtgtaaaatgtgctctttcctcattgcacttccatgttggagggcttgtctcttggtgatcacacttcaaaattctcacagccccccttgaaccgtttaggtgttagacggtaccgacaaccagtatttgggcctgcagattggacagccccaggatgaagatgaggaagccacaggtattcttcctgatgaagcctcggaggccttcaggaactcttccatgggtatgtggactacaggtgatgcgctacaaagtggtttgtattcagacctggacatcttaattatatctttgcttccaagaagaagtcctttgatactgttttctgagttctgaatagctgatgaaaatgaccaattgaggaataatcatactttttcttgatctaaatcttatacttttgagttatcttagcataaatgtataattgtattttaagtggaaatttgtcacttaatcttgatttctctgtttttaaagcccttcaacaggcacatttattgaaaaacatgagtcactgcaggcagccttctgacagcagtgttgataaatttgtgttgagagatgaagctactgaaccgggtgatcaagaaaacaaggtgagggacataggcttgagacgacttggtgtttctgagcttgtgtgaggatttaaaatcgccctggctactgtctactttattgctttcccatccctgggcctttaaatttcccctttaaataccagctcttcccaggcctgttgttttctgcctttccaggtactacccacagccttgagaattgcctgagttctgcctcctttgagagtgtgccccagacaaatctattctgtactgaatgtttccttgtctgatttcttggatcattcatttgatggttgcgtatggcctgcaacgtttcttgttttggttctactgaactgttctaaaagtctctcttcatattatctttttacatgtaaatgtaactgtcttcacttttaattcctcaaggacaaggaatagcgtttcacagttcgtcccatcaatcagaattatagcctttggcatctccctatctaccaggcccacttcctcttagatttgggcttccccaggctgttgcctttccccaagtagcttctgcttgtcctgtagaagacctttcatgctttgcttctgcagcagccgttcctgaatgcctagtgtcaactgccttcttaccacgcccaccctccctgcatgctgcatttatcccctgccacagccctgtgaccctgtgtcctgctgcctctgacttgtctgtttctgcttggccatggtctctgtgaggtcaggtgtgcatatgggcacaaaccagggcatctctttatccccagcacctggcttaagtgctgctctggaactatctgttgaatgaactaatgcatgaatgtattgttgagtatgagacaaacaagtgtcattgtctcctttctagccttgccgcatcaaaggtgacattggacagtccactgatgatgactctgcacctcttgtccattgtgtccgccttttatctgcttcgtttttgctaacagggggaaaaaatggtgagtacaaaaggggatgtgcacagttgaaggaaataactaggtttcagaggtcagcttggtggcctgtttttgccttgcgtgcagcagaggaagtagaatctgaggatgagtttggttttcactagccgaggggagggaggaaatgatgggagcaggtaggttattgggtctggttttgttcatttgaaaacaatctgttgtttgaggctgaaggtggcttgggtgatttcttggcagtgctggttccggacagggatgtgagggtcagcgtgaaggccctggccctcagctgtgtgggagcagctgtggccctccacccggaatctttcttcagcaaactctataaagttcctcttgacaccacggaataccctggtatgttaaaagttcacatcttattttctcagatttaatcattattgtaaaaactatttcagtattgactattttagttttagagcagtaagtgttttgagttcatttgggatatttgacctgcgttgtagctcttcagaaaacacatgaatagtgaagttctttgtttcatgggttccctttagatgaaacccatagaggagaaaagtagaaacctcagcacgtaagagccaacatatatacacatcggatttaaacctaaagcacaaattgtgcctggtcgcagtggcgctgagtcgcactcagccaggccaggcattcacactcagggtgagtgggaaccaggactggctgaggcagcagtggacccaagtctccatcgcgcccatgcttactatggagccttctcgttctctctttttctttgggtgagagggtacacttgtgtttttgaatttatatgaggtaagtgtgtaatagggttttttctaatcttttttaagtggaatctggaattttaatcagatttattatctgacaacctagaattataatccagaaagtctgtggtattgaggacatattggcaatatgatgaatctctaattcttaaatcctgaaacttttttttttttaatcacttagggttattatagtgaagtcatttctgaatttggatcttctcttcacacctctttttctctttcctgagaattaagcttttgtttcgagttagaaagttgatagtagggaattgttccatggctgagcaatttatctccacagaggaacagtatgtctcagacatcttgaactacatcgatcatggagacccacaggttcgaggagccactgccattctctgtgggaccctcatctgctccatcctcagcaggtcccgcttccacgtgggagattggatgggcaccattagaaccctcacaggtaacggccagtttttcagctgtgttttttctagttatgcttactaaggtttaagtttagatgatgatgtttgttgcttgttcttctggttaggaaatacattttctttggcggattgcattcctttgctgcggaaaacactgaaggatgagtcttctgttacttgcaagttagcttgtacagctgtgagggtgagcataatcttctgtggaaccatttcttcacttagtggacattttatcattgctacaattaaaattggagcttaataggaaatatttccatgcactctaaagctgtaaccagtaatacccaccatgtatccatctctcagctttagaaagaaaacgttgccagtaaagttaatgcttcataaacttcagtttaagttctaattctcagaatatttgtttgaaatagacctcttcctaaaggatatatttagaaataacctatcattaagtgtaaagtctgttgaatatgctgggcacggtgactcacacctgtaatctgaccactttgggaggccaaggtggaaggattgcttgagcccaggagttcaagactatgggcaacatagttgaccctgtccctacagaaaattaaaaaaaaaaaaaaaaaaagtagctgggtatggtggtgcatacctgtagtctcagctactcgggaagctgaggtggaggggggattgcttgagccccagagatcaaggctgcagtaaggcgtggttacaccactgccctctagcctgggcaacagagtgagactgtctcaaaaataatagtaataataatcagttgaattaaaaaaaaaaaaaaaaaaaccactgtgctaggcccatagtatggtaagagttaaagtgagccttagggattatttactcaacctctgtttctgtataaagtggaataggctcaattctttaagtgatagcatgttgaacctttccataccaactggctcataagtcacaactggccagtcaacaagagtaaaaattaactggtaaaaatcaaagcaaaaaacctacaattgtcaaatttgtgggataactcccccttttaaaatgtcatgcctgacagtaatttctctctagtttccaggttttcagtcagttgtgtcttttttgagcagaaggaagcatgctaagagctcaatcttgtggctagctgggggtctttgtgtcagccatgcatgtgatggtgcccctgggtgcttggggctgcaggggaggggtacagcagtaggggcctgttctgttctctcgtgctgtggagtacatagtgacatagtggggtggtccttggtgtaggtcccttgttcctacccctgggtctgagatttatttagaagtggtgttggggctgtgcggcaggcccctctgtaactgatcaatgtttgtgaagttgctgtttgagagttgaaaccatgacataagcagaaatggaaggaagaaagaaccagttatgtgaaagggacacatttacttttaagcttgtatttactgagataaagtattcttaatcaatgttcttgagaggtgtgggaaaaatgcaacatcctggttgcagttaaacccagaacattgtgtgttgaagagtgacggttctcaaaccgtcaagacgcgggtactgagtgggactaacctgctgtcctcttgccttggaccttgtgttccagaactgtgtcatgagtctctgcagcagcagctacagtgagttaggactgcagctgatcatcgatgtgctgactctgaggaacagttcctattggctggtgaggacagagcttctggaaacccttgcagagattgacttcaggtaagtgagtcacatccattagatttcatgaactaagctcaattgaaagttctgggatcacttgatgcaaggaatgatgttatcaagtaccctgtccatcagaaatccgagtggtttaggtagatgacagtgattttctcctcccagtggctttttgctgaactttgccctatgcttggaattttattttattttattatttatttagagacaagatcttgctctgtcgcccaggcttgaatgcagtagcacaatcatagctcactgaagctttgaactctaggactcaagtggtcctcctgcctcagcctcccgattagctaggagaataggtgtgtgccgtcacactggctaatattttttgtagaaatggggtcttgctatgttgcccaggctggtctcaaactcctgggcttgattgatcctccatcttggcctcccaaagtgctgggattacaggcatgagccactgtgcctggcctagaattttaaaatataagtagaagagtagatttttttttttggtagtcctcgtcatttaagtattctggatagtgggaataaaagagcttagaatttttcatctttgtcttaaacttttaaaaaaatgtagcttatattaattctgcttgtttaaaaagaatatactcttcattatactgaacctaggtaagacagctggtttatattttgttgcaattaaaaaacgtgagctgtggttgcagtgagccaagattgtggccattgcacttcagcctggcaacagagtgagacttggcctcaaaaaaaaaaaaataacatgagctgtgttggcactttcattttctaagagtagttttggctggagaagttttctttcagtactttcttttagaagggaaattttcctttataatttagggtttgttttttttttttccaagccaccttttatagagcccttgtgggttatttcatttaatccttagaatgtttataaatctgggcttgttctcggctccacccacagatagggacgctgagcgtgcatgagtgggcagcaagatagcaggttatggagggcccagctcaccccttctgtggcttgagccaattttatagggcacttacagagtcttttgaaatagtatttattttgaagaaaaagaaaaacagtttactgagtactgtcttattgagtctggaattgtgagaggaatgccacctctatttatttaaagccattggccttttttgttgttttgagtaagtgctgcccaaggtccttccagggcacctggatgagcctgctctggagcaagctggcggtaagtgtttactgagtaactaaatgatttcattgttaaatgtgctcttttgttaggctggtgagctttttggaggcaaaagcagaaaacttacacagaggggctcatcattatacaggggtaagcggtttatttttgtgagatgctgttttaccttcaagaaggtgaaagtgaggctttccttgtggaatttctctaaatgcattcgtcatgttttagatgtttatttcacagtttatatcatgaaagttataatcttgtcatatggatttaagtctagtaatgttgagttctttctcactagctttccaaaatatcttacctaaaatttagtcaaatacaagattatgtttatttttattatccttctctctaaagcttttaaaactgcaagaacgagtgctcaataatgttgtcatccatttgcttggagatgaagaccccagggtgcgacatgttgccgcagcatcactaattaggtatttaccaatattttatctcttttccttttttggttgaagtactaaaagatacgagaatggaaagagagggaagaattcaaaggatgtagagcagtattcctgaatctgagctcatttcagccattctattcttaaactataatgaaaaaaaaatccaaaaaagtctaaaattataattaaaaaaacaacaaaatactaactgtccattgtaaaaagtaatgcactttcattgtaaaaattttggactatagagaatagtactaagaagaaaaaaaaaatcaccttcaattctgctgccacctggaggtaatcactgttaatattttgctatatactctatgagtttcttgttcaaaatcaggtcaaaattacatgcaattttgtaatctgacaatttccacttaatattttattagcattttcctgttatgaaacagtaattttagttatgggtcgttgttttgctatgcggttgggataaaattttatatactttttttggcaattacttattatacataaatgtttgtgtatagttttctttttctgagaattcctggaagttgagttaccaggcccggctttgaatttttttttttattttttttttgagacagagtcctgctctattgtccaggtgctatctcggctcactgcaacctctgtctccctggttcaagcgattctcctgcctcagcctcccgagtagctgggattacaggggcacaccaccacgcccaattaatttttgtatttttagtagagacagggtttcacgatattggccaggctggtctcgaacttctgaccccgtgatccacctgcattggcctcccaaagtgctgggattacaggcgtgagccatggcgcctggccaggctttaaatttaaaacaaatcttctaatagctttatggaggttataatttacatttcttgaaatgtactcactttgagtgtatagtaaactccaattttatcacatttctgtcaccccaaatgtatccttgtgcccatttgctgtaacctccggttcctgccccaactcctaggcagccactcatctattttctgtcccttaagatttgtgttttcgccaggcgctcatgcctgtaatcccagcactttgggaggccgaggttggtggatcacttgaggtcaggagttcgagaccagcctggccaacatggtgaaaccttgtctctactaaaaatacaaaaattagtcggatgtggtggcacacgcctgtaatcccagctactcgggaggctgaggcaggagaatcacttgaacctgggaggcggaggttgcagtgagcagagatcgcgccactgccttccaacctgggcaacagagagagactgtctcaaaacaaacaaagatttgtattttctggacattttatagtactggggtcatagtatagatggacttttgcatttggcttcttttacttaattgtgagattggttcttgttgtagcatgtatcagtagtttgttcatttttattggcgaaagtattctattatatgaataataccatattttatctatccatcagatggatattatagagttcatgttttggctaatttatgaattatggtactgtgaacatttgcctgcaagattttgtgtagacatgtcttcatttctcttgagtagatcacctagaagtggatttttaaataattttggtacttactgtgaaactgctcttcaaaaacataccattgttccttccttccttccttccttccttccttccttctttccttcctcccttcctccctcccttccctacttccctctccctttccctttcccttccccttttcccttccccttcccgcctgcctgcctgcctgccttccttccttccttccttcgtttctttctacatatacacatttttttaaatttcaatggtttttggggtacaagtggtttttggttacatggctgaattttggttacatggtgaagtctgagattttagtacacctgtcacccgagtagtgtaccttgtacccaatatgtagttttttgtccctcaccttccagccttccgccttgtgagtctccaatgtccattataccacactgtatgcccttgcgtacccacagctcagctcccacttctgagaacatatagcagaaacatgccaaagtatactcccactaccagaatgtgattgtgcctgattcttctcaccagtacaaatatttcaaaaaaagttaaatatgtatcagttttttgggcagaagttgatacttctctttatttatttattttttttgagatagggtctcattctatgatgcccaggctggagtgtggtggtgcgatctcggctcactgcagtctctgcctcccaggttcaagtgattcccacgtcagcctcccaggaagctggaattacaggcgagggccaccactgccagctaatttttgtattttttggtagagatggggtttcaccatgttggccagactggtctcaagctcctgacctcaagtgatccacctgccttggccttccaaagtgctgggattacaggcgtgagctaccacacccggctgatatttctttttaaaataacttaccttcttttgaaagtaatacatgtttaatgaacagaatttaaggaaaatataaaaaaacgaaataatctttgtaatcaaactactgaaaagaaaaccaaagttacattttggtgcatattctttttcattttcatcattgtaatttgcatttctttgattacttgtgagacactcctttcatttacttaataggtttatatgacttgcctattcagagattttgcagctttaccattttctgcaaatgatagcaacttctttttgtttgtttgtttgtggagacagagtctcgctctgtcactcaggcaggaatgcagtggtggaatcttggctcattgcaactattgcctcctgggttcaagcgattttcctgcctcagcctcccaagtagctgggattacaggagtgtgccaccatgcccggctaatttttgtatctttagtagagatggggttttgccatgttggccgggctgatcttgaactcctggcctcaagcggtccccctgtctcggcctcccaaagtgctgggattacaggcgtgagccaccgtacccagccagtagttacttcttatattctagaaaaaattctactcatgatcaagtctccatgaggaaagagactttaattgaagatcatggggcttgcagaccaatatgataaaatagttcattgtttctaaaagtattactgagtgttgatggcagatatgaacccttttgtttttgtaggaaaatgttacccgtattctccatttgaattcagtttagatttgttaggaatcgcagcttaagctttgccatctgggagtgtttgggacagttttgcagacaaaattgcaaaagtgcctaaggaatgcagctggcattcagacctgctctgtgctcagtactctgtggacagacactgttcagcacttgttgatcagaaggtttagaaagagaactttcaaagttggtttttaattaaagcatttaatagtgtaaatagaaagggattaaattttatgacagacaaaagaaagtacagcacccagctgggcgtgggggctcacgcctgtaatccagcactatggggggctgaggtgggtggatcacgaggtcaggagttcaagagttcaagaacagcctggccaaggtgatgaaaccctgtctctactaaaactacaaaaattagccgggcgcggtggcaggcgcctgtaatcccagctactcaggaggctgaggcaggagaatcacttgaacctggacggcagaggttgcagtgagccaagattgcaccattgtactccggcctgggccacagagtgacattctgtctcaaaaaaaaaaaaaaaagaaaaaaagaaagtacagcacccagttatgtccgagtgggtgcatgagagtgaccctgagattggagacaacgctgtcacgtgcttgaagaacgccacctgagaaagggggcgagaagtggtgtccgctggtaaccagaggtgttggcttagccatctgcagggaggagggtggtctatcacaggtgagtttcatctactttcttaagcaaattaaccttacttttgtgttaggcttgtcccaaagctgttttataaatgtgaccaaggacaagctgatccagtagtggccgtggcaagagatcaaagcagtgtttacctgaaacttctcatgcatgagacgcagcctccatctcatttctccgtcagcacaataaccaggtatgctgacccagtggcatcttcacattgtcgggaaaatgccctttcctgatgcctttctttaggctttaattgaaaacattttattttctagaaaaaagcttcagctcaggatgtttgagtgtaggtcagtcctttgataggatattatcattttgaggattgaccacaccacctctgtatttaagctctgccacaatcactcagctgtgacactgtaaatctcttaatagtttattacattccatgtgctgacagttgtatttttgtttgtgacacttacgtattatctgttaaaacattttcactttagttgtgttacctttaaagaggattgtattctatcatgcctgttgattttttggtgagcgggctattaaagtcagtgttatttagggttatccactagttcagtgatttgcgagattatcattcacatttattgtggagcttttgaatatcgtgtcaaatggccacatatatcccattcttatctgcttcttaggtgagtgggacacagtgctttaatgaagctataatcttcagaattctagcttgcagagaagattgcagaagtgataagacttgtgctttttaattttgtcttttaaatgttattttaaaaattggctttatatgatactctttttttctgctgagtaacagtgttttacaaaacttggactaaatgacttctaagcttaaatgatcacttgatgctttttttctgaattaggaactcagcttatcaaatatcaaagtcataattcctgaataaataacgtcttttttcatgtaaagactgctttaaaaaacacatggaaggctgggtgcggtggctcacgcctgtaatcctaacactttgggaggcccaggtgggcaggtcgcttgagctcaggggttcaagaccacccagggcaacatggcaaaacccacctctactcaaatacaaaaaattagccaggcgtggtggcgggcccctgtaatcccagctactcgggaggctgagggatgagaatcacttgagccccggaggcagaggttgcagtgagccaagattgtgccattgcactcccagcttgggctacagagtgagactctgtctcaaaaaaagacacacacacaaacaaaaaaaacatggagacatttttttggccaccttaatatttcccctcagataatttcctttgtttaaactcagaactggcattttctctcttggagaagattcaggacaaatactcctttaagataagtagaagcagtgaaagaggatttgattatcaggaatttgataagcttagaataaattgttgcttcttaatgtcatttcagaagatgaatatttattaatagatgccaactgagatatcattaaaattgattactaactactacttggaaaagtctcccagttccaaacttcagcaggcctcttgacaattcagctgtggtcaattgggtcttgcgtgatagatacaatgaccaattgtgcagcagagtgtgctgcttagctgcctattctgttagcattcatgtgttaacttaaaatcataatctccttagttttgttgagtgtctccgtggacaagacactgtgagggatacaaaatcagattggctttattcaaaccactggggtattataattcatttataatttattttattttttgccttttttccatgtgttctaaaggaattagagtttgtatataactataatgggggatagaaattgacatgtgccatgaagggaatgcaaaaaagtgccgtgggagatgagaagtggagaaaggaatttcttttttcttggaagcaggaataacttcatgaagcatgtatttcaacttaaacagatagtaggcaacgctgtaaggggagtatggctgcagcaaaagtgttcggggcagactgggaggaagggagggaataaattcagccattgttatggaataatgatcaaaatttattttcagcccgtttcacttaaaagttgagactgcttaactttttttaatctttaatcttaaacttttaaatgccatttgatctttaaaaatatatgttttaatagtgtattttaagtctctatatttttgttattagaatatatagaggctataacctactaccaagcataacagacgtcactatggaaaataacctttcaagagttattgcagcagtttctcatgaactaatcacatcaaccaccagagcactcacagtaagtctctttcttgatcggtcttactgacattgtaatagtttttggtagcttgtatggccagttagttgtatggtcatcttacggtgaggtgcttgtcttacagctcttacttatccatgaggcttgctaagaaattgtgcttctgtgaaaagaatctcagcttactccaggaatgtaaatgactatgttttttctgattattaaagtaatacacgcccaaaataaaaaaattcagccaatttaggaagacacaacaattaaaataagccaggcatggtggctcatgcctgtaatcccagcactttgggaggccaaggttgggggctcacttgaggtcaggagtcggataccagcctggccaacgtggtgaaaccccatctctactaaaaatacaaaaattagctgggcgtggtggcgggcgcctgtaatcccagctactcaggaggctgaggcaggagaatcgcttgaacctgggaggtagaggttgcagtgagctgaggtcaagccactgcactccagcctgtgcaatagagcgagactctgtctcaaaaaaaaaaaaaaaaaaagaaaagaaaaaagtaaactactgtcacctgcattggtaatgtatcagaagtttaaaatgtctagattataattaactcagtgacctggtaatatatactaagggaaaaatatttataatttacatttttacatttttatttttttaattttattattttttttttgagacagagttttgctcttgttgcccaggctggagtgcaatggcatgatctcagctcaccacaacctccacctcccgggttcaagcaattctcctgcctcagcctcctgagtagctgggattacaggcatgcaccaccatgcccggctaattttgtatttttagtagagacagggtttctccatgttggtcaggctggtctcaaactcccaacctcaggtgatccgccctcctcgaccccccaaagtgctgggattacaggtgtgagccaccatgcctggccttacatttttataataagaatttatgttgctgacattagaaaagaaccataatatccaagaatccaagaataattaaattatgtacatatgctagtatatagtgtgatgctttggagaatttttaacaatatggagatgtataatctggattgtaatattgagtgaaaaaaggcagaatacaaacctggtgggggtatagtcggatttcagttaagaaaaataatatttacatatatacatttctcacactggcagataatcaccaagataaattttgggattgtggatgatttttttcttctttatatttttcagatattctcaaattttctaaaatgagcaagtataacttttgttatcagaaaaaaataatatacaaaagtaatgttaatttgctggtgaccaggttaaacctttttatttttattttttgagatggaatctcactctgttgcccaggctagagcacagtggcatgatcttggctcactgcagcctccgcttcctgggttcaaatgattctctggccccagcctcctgagtggctggaattacaggcgtgtggcaccacacctggctaatttttgtatttttagtagaggtagggtttcaccaggttggtcaggctggtctcgaactcctgacctcgtgatccacccacctcggcctcccaaagtgctgggattacaggcgtgagctactgcgcccagccagacctttttattttatttgacaaaagaaatacttccatgttatagaagactaaatattgtttgggctgtctgcagtatggtcttcccttgatttgttcaaaatatcgtaaactttgcttatttatttttattgtggccgactgtgtcgggcactgttgtaggcttgggatggaaaaacaggattcctgcccttagggtttctgcaggctggtcagggagacgatgtggtaagctggagctcagctcctaaggatgtgcaggggcagttgagaggcggaagggtgggagatcattccagggtgtgggcagcacaggaacctctcttcattgggatataattgccattctgataacacgtgtttgaggtgtctaaagtaggaagttgtaccatggtgggacagatatcctgtggttatcatacacagatctcagttttcttctcattgtttgtactttttataaagggtaacaggagatataattcaataaacctttgtggtgtttgggtgtgattttattgtttctttcttctcagtttggatgctgtgaagctttgtgtcttctttccactgccttcccagtttgcatttggagtttaggttggcactgtgggtatgtattttcctcagtatatattaatagttgtctacaacagtatgacataaacatagttattaggatgccctttttctttctttttaagtcttttatcaatttggctttttggaaaaatatctgatggaatacttgtttctgctatattagctgtgtgagactagtgacaggagctgtgggaaatgaatgccaaatgttcttaggcattgatgggaatttcagggtgtggtcttcaagttcatttaagggaattttcatatgctggcaaaaggcttttctcattagcttgactctttccaaaattatttgctgtgaattagaagtttaggaaccttttttcacttaattgtgacctagcatacgaaatggtgatgatttaggaactactgttcttgtattaacagcttttatttaaaaatgattttcctccagtagatggccctactagcatctgggaaataatttcaagtcttctccagcattcaggaataggctttcattttgtgtatcaattactgagaatgattttggtgactcacatcacatttgagaagtaaacctgcagatttcttgtgtgtgtcagcaaatgaccaactgatatttgcttgaagtggattacattatctgctctagaatgattgctttcccaccttcctcacatacagactgagcagctacggtttctaatcataggtctggcactagacttcacttctgggcaactttggcattggagtaaaatgtattaatttaaagaaagttaaaaatccgttcaagtaaacatacagttctaatactttttacaatttaaaatatagatttaaatgataaaataaaaaagaaaatatgggtagacaccataatcctcgtttctgcatctgttcacaaggggttgatatttatgagttctattctccatatccattctatgttctcttaatgctcagtcagcacctcaggtggttggagttcaatgcttggtagtttgacttacactgtcttttctaggggattgagccctgggtagtcctgcttatttgaggttgcaatttgtctttcaataacttttactacaagatatggcgtgttaaaggataccattggggaaccaacataataatatcaggaaaactaaccacgtcagacctgccccattgtgtatcaagtacactatttttccatagtaataaagagttcaccccagccaattctcttttattttgtgcctgtttactcaatggcattaacatgcccaaatgtctgggtagctgtctcatctccagttcagcagaaccattgtcatatgccctagtaaaagcattccttcattggacacttaggccccaatactttcattcagatctactacctgatttcatttctcaaatgatttttatggagctctgatttataggaaagatgttagttgattaaaaataaaacaatttctgagctggtataaaatgtattgtgacatgccttcctcttggaattgcaagagaaaggaagactgttgtttgcttaaaaattgtctataatttgactttgcaaatgtctgcttccagagtgcctccactgagtgcctcagatgagtctaggaagagctgtaccgttgggatggccacaatgattctgaccctgctctcgtcagcttggttcccattggatctctcagcccatcaagatgctttgattttggccggaaacttgcttgcaggtactggtactgagttgaaacagggactccaggacttggattttgatttccttagggggaatgggggtggtgagcatatgaggggaaaatactataaggtcattgccagtgatggcttgtccctttagtcaaatttcagatgttacctatatgcataaacacatgcagttggcagctgttctgtgctgagtattttaaagtagcctcttcccaatatagcccctcagttaactacaagtaaactcattttgaatttcattttaatgggcaccatatgccagtactccctcgggcactgggatgttaagaaagtataatgtatggacttcattctcaagttagttttagattagagggggatacacgtaaacaaaagtgcagtggtcacacagagtggccctaatcactctccttgggcagatttatgggctggtaggaaagagcacaacacggagagggtgtagcaccttggcgatgataatggaggatgtggccagcaaggaagacggagtccattgaaattgattttgggagaagttgccaatctccatgaaagaattggggcctgtgctatttgcttcagggggctataggagagtttcgtgaaagggactaaaagatgagtattttaataagatcattcatccaacttgaacatgggctggaggagaaggtagggagactcaggagattaatgttgatgctaaggcaagataatggctttgggactgtagggaagacactgattgtaagagaatgaaggaggcagaattgccaggcctggttcaccaactgaacttcggttgtgaagacaaagaaacctgggatgacttcacatcctgggcaggtgtgtggtggtgacagtcatggaaattgggaacacagatttgtgcgggaaacatcagtttcagtttgagtttggcttatcagttgaatatcaggcacagatgtctggccaactctcaacatagggtcttaaatgacttcagttccccaagcaatttgtccttcccatgctattggggtggagaggtaatgtctgtgcccatatcacagccagtgctcccaaatctctgagaagttcatgggcctctgaagaagaagccaacccagcagccaccaagcaagaggaggtctggccagccctgggggaccgggccctggtgcccatggtggagcagctcttctctcacctgctgaaggtgattaacatttgtgcccacgtcctggatgacgtggctcctggacccgcaataaaggtaatgtcccacttgggtgctggattcatacagccttaatgactatgggtttccagactacctttgtttagtaatctgtcccttctttattctctttttgctttaaatgaacaaaattgctcagattgtgacactaaatttaacatcaaaatgtgaccatgtggatgggtgcagtggctcgtgcctgttattccagcactttgggagactgaggcaagtggatcacttgaggccaagagttcgagaccagcctgggcaacatcacgaaaccccctctctactaaaaatacaaaaaattagatgggttgggccgggcgtggtggctcaagcctgtaatcccagcactttgggaggccgaggtgggcggatcacgaggtcaagagatcaagaccatcctggctaacacagtgaaaccccgtctctactaaaaatacaaaaaaattatctgagcatggtggcgggcgcctgtagtcccagctgctcgggaggctgaggcaggagaatggcgtgaatccgggaggcggagcttgcagtgagccgagatcgtgccactgcactccagcctgggtgacagagcgagactccgtctcaaaaaaaaaattagatgggcatggtggtgcgtgcctgtaatcccagctacttgggaggctgaggcaagagagttgcttgaacctgggaggcggagtttgcagtaagccttgattgtgccgctgcactccagcctgggtgacagagtcagactctttccaaaagaagaaaaaaatgtgaccatgtgttttatagctcttttagtatcatcagtcactgttatccctaagagggaaatacctagctttagttttaggtttccagcattagccaagaaagctcagaattgatgttcctggccaagtacctcattgctgtctccttaaatcttggttaatggctactgtcctggctagcatagttatggagcatttccatggttgtagaatgttctgccaatctcagggacagttttgcttttctgtgaagcaataaaatcaacttcaaaacaaatgttaactatttgtacaatggatttaagatagaccagttcacatacttttttttttttttttttttgagatggagtttcattcttgttgcctgggctggagtgcaatggtgtgatctcagctcactgcaacttctgcctcctgggttcaaacgattcttctgcctcagcctctcgaggcagattacagctgggattacaggcatgcaccaccacacccagctaatttttttgtagttttagtagagacggggtttcaccatgttggtcaggttggtctcaaactcctgacctgaagtgatctatccgcttcggcctcccaaagtgttgggattacgggcatgagccaccacgcccagcctaagatagaccagttcacttactgtttatatctgattactctctctttgccttgtcttctacctttaaaaatctccctactaacttcccattctcctttagctgccatcagtcttctcccttctctgcaaacatctctggagagtcccagcctcagcccacagagcttcccactgctctgaggtggaccttgtttgcaaggcttctttggctctcttggcctggaccctgtctactacttcagccatccttccttaacccctgctggtggtttctgttgccacactccatagcagcgtttcccgcccagatcatgtctttacatctctgggcactgctctggtcctgcctgcctttccctctttgtatcctgcaggctgctacccccatcttgagtgtcctcttcagttggctttcagagggcctcctgggtgttcccttacccacttgccactccccagtcactgggttcagtccttcctgcccaccagcacatgctttctaggctctgtcctaggccgtcttctctctttgtagtctctgggccagtgctgttctagagagtggcagaattttctataaccatggcagtgctccatagctatgccaggcaagacagtagccactaaacacatatagctgttgagcccttgaaatgcagctagtgtgactgaagaactgaaccccgattcggtttaattttcattaaatttaaatttaaataaccttatgtgggtagtggctccagtattgggcagggcagcctgagagtcggggctgttctcctgtcttcagtgtctagatgagggacctcagaggacctgtctctggagctgcagttcaatgtagccagctgccccgtgacacttacatatagctgatttgtggatatgtcagacacggtgtgatgagctcagctttctgtcctcctccccacatctgcccctgccccatttaccccactttgtgtcttatcaagctagaaacaggtcaccacaagtcttcatttccactcaccaagtcttttgtttcccctactaaatattttgcgagaagaaagtgtgtacctttgtattcacatacatgtacatgcacatatacatgcacatatgcaggggtccccaacctctgttaaaaaccggactgcaggccgtgcgtggtggctcacgcctgtaattccagaactttgggaggccgagaccagtgcatcacaaggtcaggagatcgagaccattccggctcacacggtgaaaccccgtctctactaaaaatacaaaaaaaaattagccgggtgtggtggcgggcgcccatagtcccagctacctgggaggctgatgcaggagaacggcgtgaacctgggaggcggagcttgcagtgagccgagattgtgccattgcactccagcctgggcgacagagcgagactctgtctcaaaaacaaaacaaaacaaaaaaaaaaaaaaccaggctgcacaggaagaagtgagcaagcattaccatctgagctctatctcctctcaggccagtggtggcattagattctcataggagcgtgtatgagttcgttctcacacttctgtaaagacatacctgagacatataaagaaaagaggtttaattggctcacagttctgcaggctgtacaggcttctgtttctgggaaggcctcaggaaacttgcagtcatggcagaaggtgaaggggaagtaggcacatcttcacatggcccacaggaaaaagagagaaggagagagagagagagacagagagagagagagaaaaagaaagattgagagggagagaggagggagaaaggagagtgcctgtagggggagttgctacacaaaggagcaccagggggatggtgctcaaccattagaaactacccccatgatccaatcacctcccaccaggccccacctccgacactggagattacaattcagcatgagatttgggtggggacacagagccaaaccatatcagagcatgaaccctattgtgaactgcacatttgagggatctaggttgcatgctccttatgagaatctaatgcctgatgatgatttgaggtggaacagtttcatcccgaaaccatcccccgccaaccctggtttgtggaaaaattgtcttccacagaaccggtccctggtgccaaaaagtttggggacctctgcacatatgcatgcacctgtacatggacacataatacatgtacatatgcatactttatattctctgccacttctggtccagactgatatactatctcatttggattactgcactagccttttgttttggaaacagcattttttaaaaaatttaatttaatttttttgagatagggtgtcattctgttgcccagcttggagtgcagtgtcatgatcatagctcactgcggcctcgatctcccaggctcaagtgatccttctgcctcagccttctcagtagttgggactacaggcatacccaccatgcccagctaattttttgatttttttttttttttgagacagagtctcagcctgtcgcccaggctggagtgggttggcgcgatctcagctcactgcaacttctgcctcccaggttcaagtgattctcctgcctcagcctcccgagtagttgggattacaggcgcctgccaccacacccagctaactttttgtatttttagtagagacggggtttcaccatgttggccaggctggtctcgaacttgtgacctcgtgattagcccgcctcggcctcccaaagtgctgggattacaggcgtgagctaccgctcccagccaggaaacagcattcttgagataattcatataattcacccatttaaagtatataattcattctctttagtatgcccacagagttgtacagccatcaccagaatcagttttagaacccataaaggaactctgtactctttacccaaaacctccatgcctccagctgcaggcagccactaacctgccttctgtctctgtgactctacgtcttctggacattactgtggatgggctcatacagtcagtgagcttgtgactggtgccttctaccaagcagggttttcagtgtagcagcctctctgtttttcttttttttttaaattgtgacggaacttctgcctcccgggttcaagcgattctcctgcctcagcctcccgagtggctgggactacaggcccatgtcaccatgcctggctaattttttttttttttttttttagtagagatgggtttcaacatgttagccagggtggtctcgatctcctgacttcatgatccgcctgcctcggcctcccaaagtgctgggattacaggcgtgagccaccatgcccggctaacctttcatttactgtctgcatttcttccctgatgccttccagtccatgcacccgattgtagccattcatcctattatggtttaaggtgactgtcttagtcagcatgggttgccataacaaaataccatagcctgggtggcttcaacaacagaatttacttctcacacttctggaggttgggaagtccaagatccaggactttcgccttgccctcatgtggtgagggggtgaggaagctctgtggggcctcttatatatggatgctaatctcattcatgaggggtctgccctcatgacccagtcacctcccaaaggccccacctcctaataccatcaccctggtaattaagtttcagtgtataaatttgggggactatagacattgaaaccataacaagcacttttctaagatcagggagtgagtaagtagcagagctaggacctcaattccacatgtcagtcatcttgccttcactctgctccatgatggctgcctcctagagcattgggagtctcgatgttctatatgctctcatgtgttgtgtattggagatagttgaggctttatgaatacatctggatttgttgacttctagctttgctggtaaccagctgtgaccttgaataagttacttcatctctgagcctgtttcctcttttagaaacaggagtttaaaatgctgctttgggttgggcacggtggctcatgcctgtaattccagcactttgggaggctgagatgggaggatcactggagcttggagttcgagaccagcctgggcatcatagtgtgagatcctgtctcctcaagaaattaaaaaattagctgggtgatgtggcgtgtgcctgtggtcccatctactctggaggctgaggtgggaggattgcttgagcccaggaggttgaggctacaatgaaatatgattgcaccccatcctgggtgacgagtgagaccctgtctcaaaaaagaaaaaaaaaatgctgctttgtacccctttcatgtcatggcgtcatggccaacatagaatgccctggttgtttgctgttggagggcatgggcctgggggctccctgagggctccttccatcttcaactcattctctgtgcacctgttaggaagttgtgggccagtccctaccatgtatcattgtgtgggtaaaagtaaataaaatgtgtacagtgtctgaactgtacatatcagggtccaagaacaaaatgagtgacatgggttagctctttttaataaatggtaaaaccaaatattctaattttcagttttgttatacttccatcacatgtttttgtttttttgttttttgtttttgtttttctattttaggcagccttgccttctctaacaaaccccccttctctaagtcccatccgacgaaaggggaaggagaaagaaccaggagaacaagcatctgtaccgttgagtcccaagaaaggcagtgaggccagtgcaggtaggaaacagcgtggggaagggagggacatgagtgcagcatctgtcatgtagaaacataggatttaagtaacttggtgttttagagaaataaatataatacacatcagtaaagtgagagaaagtttctccaggtgcggttcaagatattagaaactaatgactgatgtacacagaccaccttttggtctgaagcatttctaagtgccactggctgacatgcagcccctacagcctccaggcttccagccctagcatggagcatcactctcctatgcttccctggttgcaggtgatggctggagaggcctcctgattttcagtaagggaagtggtgtagatgcttaggaatagatgtagtgagtgaaaaaactgattctgatatgtcaaaaattctgattggaaatggaatatttacatttggaagagctaaaggcgagagaaagtggggataaagtcatctgagttggaggagcttaaaccattcacaagtttggaggacctttttttacccatgaaaaggtcagaacagaaggggctaggatttaggtgtgactgcagtttattgaattcccatccatactgctctcggtgggcagtggcaggggcaggagaggagcctggcaaagcatgaagtgactgctgctgcctctgctatctgggacgcctggccacctgtctgtacagtctccctccagacccattctcacgctgtctcttggcacccaggggccagtgatggttctcccatttgttttgtgtatatagcatttatatcaaggctatttatttatttatttattttatttatttatttttttgagacagagtctcactctgtcacccaggctggagtgcagtggtgcaatctcggctcagtgcaagctctgcctcctgggttcaagcaattctcctgcctcagcctcctgagtagctgggactacaggtgtgcaccaccacacctggctaattttttgtattttttattagtggagacggggtttcaccttgttggccaggatggtcttgatctcctgacctcgtgatccgtccacctcagcctctcaaagtgctgggattacaggcatgagtcactgtacccggcctatttatttatttttaattgacaaaattgtatatatctgtaatatacaacatgatgtttgaaatatgtgtacattggccaggcgtggtggctcacacctgtaatcccagcactttgggaggctgaggtgggcggatcacgaggtcgggagttcaagaccaaactggccagcatggtgaaatcctgtctctactaaaaataccacaaaaaaaaaaaaaaaaaaaaaaagccgggcatggtggctcgcgccagtcgtcccagctacttgggaggctgaggcaggagaattgcttgaatctggcaggtggaggttgcagtgagctgagttcatgccactgcactctagcctgggcgatagagcgagactccgtctcaaaaaaaaaaaaaaaagaagaaatacatatgcattgtggaatggctaattaacctgtgcatcacctcacgtatcattgttttgtggtgagaacacttaaaatctactctttcagtgattttcttgcatatggtacattgctattaactgcagtcaccatgctatacagtagatctcttgaactcattcctcctgtctataaatgaaattttgtatccttgaccaacacattcaaggttttttttgagatggagtcttcttcacccaggctggagtaccatggcacgatctcatctcactgcaacctccgcctcccaggttcaagcaattctcctgcctcagcctcctgagtagctgggattacaggcacatgctactgcacctggctaatttttgtatttttagtagaagtggagtttcaccatgttggccaggctggtctcgaactcctgacctcaagtgatccgcctgccttggcctgccaaagtgctgggattacaggtgtgagccactgcacccggcctcaagcgttttaaaagatgctcttttctaaggattgactgtagtacaggaggaagattgacctgttgaaaagcctcagcctttacaagtgtaaaattatcagtatattactatcatctttctgatgaattaaataaactaaggactccaagtcaaaagtcttcaaactgaagtagaatagttgtatatagtgcttggcactttaatatttagtatcggtttaatgataatgtttgtgcctttgccgtctttaaaacatttttacatcatccctgtttgattacttggtgtgctcatgaagttgttggccactaaggaatcttaggctcagagaggttctggaattggccagtggtccttgaatcagctgctcctatgattctctaactgatttctcacaaagcaaacaagcaatcataacaaaacaactgtgcacactgctcttcttattttgttatttaaaaagtacttaggctctacttatgtttgttagtcaatttctcattacttctagttaatcaaaaggtcagaggaaatacttgaatattttcatactagaatactttaaaaaatcatgatttccagtaatctctttaaaacttggcaagttattttgatctaaaagtttatcttttgtgtgcatatttttaaagcttctagacaatctgatacctcaggtcctgttacaacaagtaaatcctcatcactggggagtttctatcatcttccttcatacctcaaactgcatgatgtcctgaaagctacacacgctaactacaaggtatgggcctctgcatcttttaaaaatatatatgcacacatacttacgtctaatggatagttgatgtttttcttatgatttgtaggatgtataagccctttgagatatgagttacatttagttttttcaagtttgtttgtctttcagctttgtttatgatagcttctatcatacaggtgttttggattttcatattgtttgtactcacagctaagattgattacagtgacagagctaggatgtgcagccaggttatagggggaagtggccctggtggagtctggagggatccgtgtacaggcttccttccctcccgtgaggctcacacaaaaatacagcaacatgctggtcctgcaggtaccctctgcctaacatgagccacaattccagactcacagaagaaaagcaggtgttcggcataaaccatgtgtttcaaatagtctgggcatggtgagccacttgttatcagctagggaaagtttatgtcagcgtaagaaactgttcaccagatacccccaagagccagcctttctgtctagggatgttttagttttttagttcatttttttttttaactttaaaattttctgttcatctgcaatttgttagatatgaagtatgtgtctaatttaatttttgtttttggttgtccccaataatgtttacagaagaatttttctgcactaattggcttgagttacttacattctcatagttctctagtttcagtagtttcatttattattttgttatatcaatctatctgtctgctcatctattagaagcatccttgttttttttttttcttttttagacagagtcttgctctgtccccaggttggagtgcagtggtgcaaccatgcctccctgcagtctcagggctcaagtgatcctcccacctcagctcctgagtacctgggactaccggcatgtgccaccacacccagctaatttttacattttttgtagagacagggtctccctaagttgcctgggctggtctcaagctcctggcttaagtaatcctccctccttggcctcccaaagtgctgggattacaggtgtgagcaactgcacccggctacaagtatacttcttaattattgtagcttaatggtatttatgaggggatcagttcccctgttgttctttagaattttctggatattcttctttattgattttgggatgtgaacaatagaatcaacttctacttgtagattgatttagggagaacttatacctcagatgttaagtcaccctgtccagaatgtgggatgctttcctatttgttcagaactttttaaattacctcagaagcacatgaaatttaaaggattttaaaaaaaacttaaagattatttcacatagctcttgcacatttcttgataaatgaatcctcaggtattcctctgtttttgttactaatagttacttcttatgggttttttttcccctgaaaatcatttatcaaacgtatgtggcttattttctgaaggatgtttgataattttggaagatatgaaagtcttcatattttacaaggtttgaggtctctttaagctgcatggttctcatgtcagctcccaaagcagaagacggcatgttgaaaaatgccgtagagaagatacttcttttccacctgttttcaactcatatcatcttgaatttcagggcacctttccatgctcctagtgcttgctatctgtttattattttccttcctgaataccctgaactccagcatgttctgctgtaattctggcctccctggcatcttggactcctgtttcctttgctctgtcatccccgcggtcagctcctgctgcgcagcttctcagctgaagtgcgtttggagtgcctggcgtgtcttgctggatctttgagtattgcctctggtttccttggttccttctgctgagttgctcagcgtctccactccccatttcttgtgtggcccttcctgcactcctctgattccttttgtcttccctggtttcttgctttggtttcgagtctccacagaacttttgcagctcttctgaagacctggaagctttttcatcttaattctcatctcatgacctcttttcccttctttgagagctagaacttcccatggtgaacttctctttccagaattccatgccttcttttccctcccacttacctgttgtccaggagaggtcagattgctgtgcatattggaggagaaccctttcttccctgggctcttcatctcacatgacatcaccacatcacctcgttccttggaccctcagtggtgtcactgctggatttttctttcctttggctggccttagggcacacccaggttgactagcgtagtcatggtatttagatccactcacattttcagtttctgtgtctgtctcttgcctgcttctgacttcgcccagagaaagcttctctttcacaagggttcttagatttatgttcactgagcaccttcttttctgaggcagtgttttaccaatatttattttcctagtcagtctcgccttacctttcttgttatgcatgtctttggtcctgacccattctctgagtctgtaaaatagaattgctgtataatttaattacatgaaatcctttagaatcttaacacatcttacacctgatttaatattttattgtatccaaattgaaccaaccctatgtgaatttgacagtgatttctcccagggatcctagtgtataaggaataggacttagtattttctattttttgatataccacataccagatactgattatgatggacatttaacccttttttctcattatgaaagaaagttaggaattatttcttccagtagcgccagtgtaacctgaaagcctttgaaagagtagtttttgtatagctatctgaaaggaatttctttccaaaatatttttccagtgctgacaacaaacacgcagacacaccctgcaaggtgagtgtacggcgccgcacagtggaggcatctgctgcagccgtcgatgtttgtgtctttggttgtacattatgagatcgtgacagggccagtaaccgtgtgttctctccttcaccttcccaaggtcacgctggatcttcagaacagcacggaaaagtttggagggtttctccgctcagccttggatgttctttctcagatactagagctggccacactgcaggacattgggaaggtttgtgtcttgttttttctccttgggttgtggctggcacacttgatgtgcgtcttctgggctgagttcatctaggatggagcctggttctccagggtgcctccgggagactcctccctgccccacgtgcttgcgtcacaggacccaagtctgactctgccttagccatgaagtttagggggaagtttctatttgtattctatttttgtctgttatcatgtattagcttagacccagtttagtttggaaaatcagtgggtttcaaaatgtgtttgtagagtcctttatttcttaacttgaccttttcaagtggaaaggggcaaaacagacgggtaagggggcggggcgggaggtgtgacttgctcttttgtgcctgaggaagtaacagagctggggttgacagtcatattctctgacacagatagtctctgacttatctcacagaaagtcagcggcagagcctgagttaaaagtctcgtagattttctttttcttttttttggtggctaatttcagttttatttatatttgtttatttatttattatactttaagttctgggttacatgtgcagaatgtgcagttttgttacataggtatacacgtgccatgatggtttgctgcacccatcaacccatcacctacattaggtatttctcctaatgttatccctcccccagtcccctcactccccatgggccccggtgtgtgatgttctcctccctgtgcccatgtgttctcattgttcaatttccacttgtgagtgagaacatgcggtgtttggttttctgatcttgtgatagtttgctgagaatgatggtttccagcatcatccatgtgcctgcaaaggacatgaactcatccttttttatggctgtatagtattccatggtgtatatgtgccacattttcttaatccagtctatcattgatggacattcgggttggttccaagtctttgctattgtgactagtgccacaataaacatacatgtgcatgtgtctttatcgtagaatgatttataatcctttgggtatatgcccagtaatgggattgctgggtcaaatggtatttctagttctagacctttgaggaatcgccagactgtcttccacaatagttgaactaatttacactcccaccaacagtgtaaaagtgttcctatttttccacaacctctccagcatctgttgtttcgtgactttttaacgatcgccatcctaactggcgtgagatggtatctcattgtgattttgatctgcatttctctaatgaccagtggtgatgagcattttttcgtatgtctgttggctgcataaatgtcttcttttgcgaagtgtctgttcatatcctttgtccattttttgatggggttgtttgcttttttttcgtaaatttgtttaagttctttgtagattctggatgttaatcttttgtcagatgggtagattgcaaaaattttatcccattctgtaggttgcctgttcactctgatgatagtttcttttgctatgcagaagctctttagtttaattagatcccgtttgtcaattttggcttttgttgccattgcttttggtgttttagacatgaagtctttgcctatgcctatgtcctgaatgttatggcccaggttttcttctaggatttttatggtcctaggtcttatgtttaagtctttgatccatcttgagttgatttttgtgtaaggtataaggaaggggtccagtttcagttttctgcatgtggctagccagttttcccaacaccatttattaaatagggaatcttttccccattgcttatgtgtgtcaggtttgtcaaagatcagatgattgtagatgtgtggtggtatttctgaggcctctgttctgttccattggtctatatatctgttttggtaccagtaccatgcagttttggttactgtagtgttgtagtatagtttgaagtcaggtagtgtgatgcctccagctttgttcttctagcccaggattgtcttggctatgcaggctcttttttggttccatatgaagtttaaaatagttttttccaattctgtgaagaaagtcagtgatagcttgatggggggatagcattgaatctataaattactttgggcagcaaggccattttcacgatattgattcgtcctatccatgaacatggaatgtttttctatttgtttgtgtcctctcttatttccttgagcagtggtttgtagttctccttgaagaggtccttcacatcccttgtaagttgtcttcctaggtgtttcattcccttagtagcatttgtgaatgggagttcactcatgatttggctctctgtttgtctgttattggtgtataggaatgcttgtgatttttgcacattgattttgtatcctgagactttgctgaagttgctaatcagcttaaggagattttgagctgaaccaatagggttttctaaatatacaatcatgtcatctgcaaacagggacagttttacttcctctcttcctatttgaataccctttattgctttctcttgcctgattgcgctggccagaacttccaatactatgttgaataggagtggtgagagagggcatccttgtcttgtgccggttttcgaagggaatgcttccagtttttgcccattcagtatgatattagctgtgggtttgtcataaatagctcttactatgttgagatacgttccatcgatacctagtttattgagagtttttagcatgaaaggctgttgaattttgtcaaaggccttttctgcatctgttgagataatcatatggtttttgttgttggttctgtttatgtgatggattacgtttattgatttgcgtatgttgaaccagccttgcattccagggatgaagctgacttgattgtggtggataagctttttgatgtgctgctggattcagtttgccagtattttattgaggattttcacatcgatgttcatcagggatattggcctaaaattctctttttttgttgtgtctctgccaggctttggtatcaggatgatgctggcctcataaaatgagttagggaggattctctctttttctattgattggaatagtttcagaaggaatggtaccatctcctctttgtacctctggtagaattcggctgtgaatccatcctggactttttttggttagtaggctattaactattgcctcaagtttagaacctgttatcagtctattcagagattcagcttttttctggtttagtcttgggagggtgtatgtgtccaggaatttatccatttcttctagattttctagtttatttgggtagagatgtttatagtattctctgatggtagtttgtatttctgtgggatcggtggtgatatcccctttatcgtttttattgagtctatttgattcttctctcttttcttctttattagtcttgctagcggtctacctattttattgatcttttcaaaaaaccagcacctggattcattgattttttttggagggttttttttcgtgtctctatctccttcagttctgctctgatcttagttattttttgtcttctgctagcttttgaatttgtttgctcttgcttttctagttcttttaattgtgatgttagggtgttaattttagatcttttctgctttctcttgtgggcatttagtgctataaatttccctctacacactgctttaaatgtgtcccagagattctggtatgttgtgtcttcgttctcattggtttccaagaaaatttttatttctgccttcatttcgttatttacccagtagtcattcaagagcaggttgttcagtttccatgtagttgtgtggttttgagtgagattctcaatcctgagttctaatttgattgcactgtggtctgacagacagtttgttgtgatttctgttcttttacatttgctgaggagtgttttacttccaactatgtggtcagttttagaataagtgcaatgtggtgctgagaagaatgtatgttctgttgatttggggtgcagagttctgtagatgtctattaggtccgcttggtccagtgctgagttcaagtcctggatatccttgttaattttctggctcattgatctgcctaatattgacagtggggtgttaaagtctcccactattaccgggtgggagtctctttgtaggtctctaagaacttgcttcatgaatctgggtgctcctgtattgggggcgtgtatatttaggatagttagctcttcttgttgaattgatccctttaccattatgtaatggccttctttgtctcctttgaactttgttgatttaaagtctgttttatcagagactaggattgcaatccctgctttttttttgctttccatttgcttgttagatcttcctccatccctttattttgagccaatgagtgtctttgcatgtgagatgggtctcctgaatacagcacaccaatgggtcttgactctttatccaatttgccagtctgtgtcttttaattggggcatttagcccatttacatttaaggttaatattgctatgtgtgaatttgatcctgtcattatgatcctagttggttattttgcccgttaactgatgcagtttcttcatagcgtcagtagtctttacaatttggcatgtttttgcagtggctggtactggttgttcctttccatgtttagtgcttccttcaggagctcttgtaaggcaggcctggtggtgacaaaatctctgcatttgcttgtctgtaaaggattttatttctcgttcacttatgaagcttagtttggctggatatgaaattctgggttgaaaatactttttttaaagaatgttgaatattggctcccactcttttctggcttgtaggatttctgcagagagatctgctgttagtctgatgggcttccctttgtgggtaacccgacctttctctctggctgccctttccttcatttcaatcttggtggatctgatgattatgtgtcttggggttgctcttctcgaggagtatctttgtggtgttctctgtatttcctgaatttgaatgttggtctgccttgctaggttggggaagttctcctggataatatcctgaagagtgttttctaacttggttctattctccccatcactttcaggtacaccaatcaaacgtagatttggtcttttcacatagtcccatatttcttggaggcttggttcatttcttttcactcttttttctctaatcttgtcttctcgctttatttcattaatttgatcttcaatcactgatatcctttcttctgcttgattgaatcggctgtcgaagcttgtgtatacttcacaaaattctcgttctgtggtttttagctccatcaggtcatttaagctcttctctacactggttattctagccattagtctaacatttttttcaaggtttttagcttccttgtgatgggttagaacatgctcctttagctcggagaagtttgttattaccgaccttctgaagcctacttctgtcaattcatcaaactcattctccatccagttttgttcccttgctggtgaggagttgtgatcctttggaggagaagaggtgttctggtttttggaattttcagcctttctgctatggtttctccccatcattgtggttttatctacctttggtctttgatgttggtgacctacggatggggttttggtgtgggtgtcctttttgttgatgttgatgctattcctttctgtttgttagttttccttctaacagacaggcccctcagctgcaggtctgttggagtttgctggaggtccactccaggccctgtttgcctgggcatcaccagcagaggctgcagaacagcaaatattgctgcctgatccttcctctggaaacatcgtcccagagcacgaaggtgtctgcctgtatgaggtgtttgttggcccctactgggaggtgtctcccagtcaggctacatgggggtcagggacccacttgaggcagtctgttcattatcggagcttgaatgccgtaccgggagaaccactgctctcttcagagctgtcaggcacgtatgtttaaatctggagaagctgtctgctgccttttgttcagatgtgcccttcccccagaggtggaatctagagaggcagtaggccttgctgagctgcagtgggctctgcccagttcgagcttccctgctgctttgtttacactgtgagcatagaaccacctactctagcctcagcagtggtggacacccctcccccagccaagctcctgcatcccaggtcgatttcagagtgctgcgctagcagtgagcaaggccccatgggcgtgggacccgctgagccaggcacaggagagaatctcctggtctgctggttgtgaagactgtgggaaaagtgcagtatttgggcaggagtgtactgctccttcaggtacagtcactcatggcttcctttggcttggaaagggaagtcccccgaccccttgtgcttcccaggtgaggcaacaccccgccctgcttcggcttgccctccgtgggctgcacccactgtccagcaagtcccagtgagatgaactaggtacctcagttggaaatgcagaaatcacctgtcttctgtgtcgatctcactgggagctgtagactggagctgttcctattcggccattttggaagcatcccttgttttttgaggtggagtcttgctctgtcgcccaggctgacgtgcatcggcacaatctcggcccactgcaacctttgcctcctggtttcaagcgattctcctacctcagcctccggagtagctgggattacaggcacctgccaccatgcctggctaattttttgtatttttagtggagatggggtttcaccacattggccaggctagtctcgaactcctgaccttgtgatccacccacctcagcctcctagagtgctgggatcacaggtgtcagccaccacgcccagccatattttcagatctccctctctttgccctaaaccactgtgcttaataagtagtttttagtggccagcagtctccatgtataacacattttagcaaaatggaaaatactatatgttttaaatttgaacgtgagattatactgaaataaaaatcatctaactgggattctttaaatagtaagattttcttttttgtatgtgggtttttttttaaccttattattatgactgtcatatatagaaatggctgtttttcagttacagtcagtgaatgtatcaaatgctgccttatccaaataataaaagtaaattattaataagtcacaatttaatgaagattgatgttagttgatctttatattcttgaaatcagccatatggttgtgtgtgtatgtatatatttttaaaggtacataaagataataagctcatctctgaaaatttttacatttggcataagaataactggataattaagcatcttattctctggcctgtgtctttacagttaaaggtagatttactcacctctccttttttgtttttctaagttcatcttttttgctgtttcaagacagaggcccattttagctttctcgcatatccttttgtttgtactttggaagcctcacctgcttaattgttgagtttttatccgtggtcttttagagggggatatgtagggtagaagctttcacaggttcttgtttgcacttggcccctgactgttttgaggaatctccctcactgactcacagcatggcaaggtttcagatctctttctgccacacagcagttctgaggcagctggaaagatatccagatgcttagattgtcaggccaggcttgagatatacaaactattgagccttatctgtgaccttgcttaggtgaaggcatcagagcccctgcaccaacatgcataggcctctgcatgtgtgcggggctgggtgttgaggtctgagcacaagtgtagctggagaggtgagcttgatgtggcgacgggtatgagcaggttttcttcagacttctgtgagtttacctagttccaggatttaaaggcacagagactttagaattaaaatagaatcattttctttttctaaatagcaacactaggaataaaaaataataattccacattcttgacaggtaatgttttttcttgtcttctaatccttatttattccatactcatttttatacataattgaaatgtattatgcattggatttttcttttgcattatattatagacgatttttcatgtaactccttactgttccattttatatgttttgtctggtttaagactttatctgcaaaccgggaaactgtctctacaaaaagaaaaacaaaaatagttggccgcagtggcatgcgtctgtggtcccagctactcggggctgaggtgggaggattgcttgagccttgggaggttgaggctgcaaagagccatgatcatgccattgcactccagcatgggtgacagactttatactgtctgttttgggtgatttgataatgatatgccctgatgtagtttttttatatcttgtgtttcttgtgcctgggtttattgaggttgggtctgtggcttcatagtatttttaaagtttggaaaattttaggccattctttctttctttctttcttttttttttttttgagacagtgtctcgctctgtcgcctgcgttggagtgcagtgacactatcttggctcactgcaagctctgcctcctgggttcacgccattctcctgcctcagcctcctgagtagctgggactacaggcgcctgccaccacgcctggctaattttttgtatttttagtagagacgaggtttcactgtgttagccaggatggtctcaatctcctgacctcgtgatctgcccgcctgggcctcccaaagtgctgggattacaggcgtgagccactgcacccagctaggccattatttcttcaaagattttttttctgccctgcctccctccttttttccctctcttaaaggggctgtgatttcctgaatgattgcttagtgttgtcccatagcttactgatgctcttttcagtgtttgattgttttatgtgttttctgttttgtatagtttctattattgtgttttcaagttctctgatcttttcttctacagtgtctactctgttgttaatctgttaatctgttgttaatcctgtccagcgtatttttttttttgtttttgaaacagtctcactctgttgcccaggctggagtttagtggtgcgatatcagctcactgcaacctccacctcccaggctcaagcaattcttctgcctcagcctcccgagtagctgggactataggcacgtgccaccacacctggctaatttgtgtatttttattagagatggggtttcaccatgttggccaaactggccttgaactcctgacctcaggtgattcatccgcctcggtctcccaaagtgttgggattataggcatgagccaccgtgtctggcccctgttcagtgtatatcactaattttgtttttatctctagaagtttgatttaggtcttttaaaaatgtctccctgtgtttctgtttagctttgtgaacacaattgtaataactgttttaatatccttctctgctagttctaagatcttctaataacttcccagttcttggtgtttctcattggttgattgatactcctcgttttgggttgtattttcctgcctctttgtatggctgccaattttttattggatgcccaaccttgtgaattttactttgttggatgctatatatttttgtgttcccatagatcttcttgagctttgttctgaggttagttgagttacatatagatggtttactcttttgggtcttgctttataatttgtcagatgggttggagcagtgcttagtttaggactaattttttttttggactaattattcctctttaggaataattaggtaccatgcttaggaggcaagaccatcctgagtactctacctaatgaaccagaaagtttgggttttccagtccgcctgctgagaacagtgactttctagccctgtgtgagcgctgagctctgctccttctaatcctttccaatgcttctttccctggcctcagggagttttctcacacacatatctctgctgagtactcgagagggaccttccccagatctccagagctctctctgtcttgttttctcttctctggtgctctgtcttatgaactgtggctgtcttggtctccttagattctcagcacctcttcaattcagagggttgcctgtccctcctccttgtgccacagcctaggaactctctcaaagcagcgagttggggcagccatagggctgacttagtctctcgtctcccagggatcactgtccttcattgctcatgtccagtgtcttgaggactctgggttttgtctgttttgttttttggtttgctttggttgtctcaggcaggagggtaaacccagtccctcaccctcattgtgctcagtagtggaagtctcactctattacattagatattagtatttgtagcagagccctggttccctggtacttggggagctcttgaaaggccagaaacagcatgctttctcaccttttccagggcttcagtttctggtgcacatcaagcattccatacacatttgttaaagtcctttgttagacaagtagtgattcacaggttctatttgtaattttttcagttaacatgtattgggtatctgctgggagctagtaaaaacaaaaagtggtgtgtgacaaattcaattctgacaagaacaaccttaaacacttagaatatactttgagcatatcagaattttaaaaatgtgtggcccttgagtatttgaaaccaacaagaatctattgcttattagtagaggatattttgttaaacaagtggagagagaggcattttcagtctaattggtgttggcttttagcagctgatggaaaccagttcgtgattagccaggcagtggtgaaacaggctgtgcattctgaatgcctaggtatctaggcattcagaatggtggcgctctttgagttagcatcttcttctttcttgattcttttttttttttttttgagatggactttcgctcttgttgcccaggtaacaactccagtgcaatggcgccatctcggctcactgtaacctctgcctccctggttcaagcgattctcctgcctcagcctctcaagtagctgggattacaggtgtgcgccaccacgcctggctaattttgtatttttggtagagatggggtttcactatattggtcaggctggtcttgaactcctgacctcaagtgatgcacctgcctcgatctcccaaaatgctgggattacaggcgtgagccaccactcccagccccttcttgattcttgaaaaggacattgggtgctgtacatctcgttatagatgttgataaaaatgcttgtgagaagagtaacattaaggtagttatttggtcatttttgcagattattttaagacaattctaggactgatttgtggtaaatcacacattgctgtatcatagttgtgttcactgaacatattcaggggctctacagatgcagggctcttagctgctttgcacacttctgaattcctgccctgcgaacaggactggatacctaatagacaacaggtacttgataacagtttattgaattaatgagtgaatgaacagatacataaatgcatgaaagaatggttgtaatgtatataacttggatttcaagactttttactgactgttcaaaataagaaattgaaaactttcctctgattttcctctactatttacacaatttaaatggaagttatcttgtaccttcaatttctgtctaggattcgtacaataacgggtcatctctgagtcgcttaatgtctcacttgtctttctacagtgtgttgaagagatcctaggatacctgaaatcctgctttagtcgagaaccaatgatggcaactgtttgtgttcaacaagtaagagcttcattcttttcctcttctgttaagacgttcgggtatgacagcaaaacgctgctactccttaagaggcaggcgctgttggcataatcagctgggaggattgtggggtccagcgcagcactttttggctcagtccatgattgagccaagaggccatccttcccttcactccccaggaggacgaggtctgtcactgtggagggcagaggacaccagaagctcctctgcaacctcgctagttaacttccagtccctcggagtttctgtttagaatgctcaatctcatttagaattgcaaggaaacccaaaacgcctatttaaggtacaaacagcacttcatacaatatctcatgaggtattaatagtgattcacaggaagaatttcacgctgtgagtctttgctaacatatccagttatttacagatggatttgatatttgtgtgggagattcttaaaagtgttgttcacgccacattgttgatgcctcatttttttcactgtagttgttgaagactctctttggcacaaacttggcctcccagtttgatggcttatcttccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagaacgacacctcggggtaacagttgtggcaagaatgctgtcgttggtggaagcacgaaagagcaagcaggaaatactttgtaaaagaataaaaacgaaaaatgttagcgaacatcttctaatagtctgctgtattcagagaactctaggagatatatatggttgatgcaaagatgatttaaggcatagcccggccttccaagaagtgtgtggccagtgagtgagatgggcttgggacttacacatctcagaggtgggggtagaggaggaggaacactgagtgggctgagaagcagccagctctcattgccaaagtgtgtcagcaaaccagaatgcagttcataatgtccccacccattcaaagcacaggacctgtagagtggtgtggcatgtgttggtggcacttttcaggcctgtaacaaggatgaaagaacagcttcatagcagcacagtagtgctggtgttcagaggtgtgtgaaggccatagaagcatcttggatatattaccttgtgttttgtcagctttatgactagaagtctcttttcacttaaatttgttttttttttttttgagacggagtcttgctctgtcgcccaggctggagtgcagtggtgcaatctcagctcactgcaagctctgcatcctgggttcatgccattctcctgcctcagcctcccgagtagctgggactacaggcgcctgccatcacgcctggctaacttttttttgtatttttagtagagacggggtttcaccatgttagccaggatggtctcgatctcctgacctcgtgatctgcccgtcccggcctcccaaagtgctgggattacaggcgtgagccaccgcgcccggcctcttttcacttaaatttatgtttgtgtttttaatgcctagtatacaggacttcttaaattgccttaagtatgaacaggtatttgagttgctaatctgtatagtagcaataatagaatcccttgtttttccttttataaatttagcgattaaatagctacaattaaaacactagagtcaggagtcaaggaaaatacccatgttccaggctgtatgttagtgatgtacttactatatattggagtttcaggagtaagtctgtttcaatgctttctgtaaccatttggggtattaataagcatgtgagtgtgtgcatgtttgggttaatttcatatatgtttcttagaagggatatcattgatgtaaatattttaaaggcttgtcctccaaaaaaatcatgtaatttcttctaaattactgatcttttaaatgaccttcacctttctctcaaatctcacttaagactgggctgagtagtcagtttcctgtagcagaaaaaagctcagacttgagtagccttctgcgagtgaggagacttgatggctgtcaggcagctgtaaactctaaatagagtgtcattatctgaagagggcgatgctgccacactgagtggcctttcaagttgtttctcaatctgacacgttctgatcgtgtgaatgtgaaattggtttgagcaggagtatatctgagtgcagaggagattatttaaagatattctcattctctgcttcccttttattcccatttggcagatggtttgatgtcctccagaaagtgtctacccagttgaagacaaacctcacgagtgtcacaaagaaccgtgcagataaggtaaatggtgccgtttgtggcatgtgaactcaggcgtgtcagtgctagagaggaaactggagctgagactttccaggtattttgcttgaagcttttagttgaaggcttacttatggattctttctttctttttttcttttttatagaatgctattcataatcacattcgtttgtttgaacctcttgttataaaagctttaaaacagtacacgactacaacatgtgtgcagttacagaagcaggttttagatttgctggcgcagctggttcagttacgggttaattactgtcttctggattcagatcaggtttgtcacttttatctttcatccatcatacctgttcctaatttagtacaaattaccctaaaagacactgaaatctactttaaagaaatgtggtctgcatgtttccctcatcagttgctgctgcttatctttttcatgcacctagctggtgcagaaggcctggggcatagccagcctcagcaagtcagcatccttgccccagctccctggactcaaggctaacctggggttggctgttagggatttccaaaggtttgtcccatccacttgcctcccctccaaaataagtttgaatttaaattgtgagatacaattaagatttattgtttggggaacatttttgcaaaatctagagttagtttaaacagattatcaattattaccataattgatcatctgcagtttcaagctatctaacaggttcacttacctctttaaaaaggaatggaatttagcaggacagtaactgagacccgtgctcctggagtccatgtgggagctgtgtggctctgcacaagcatttgcacgcttcccctcttgactgcattaccttcctcctatagttgctgtgggcaccagattctggctagtcctgtcccttcatgatgcacattttcctcaagattcgtcccagttaaatcactgcagatgaaactgccttttcatcgtcaaaatttaactgtcatttttgagccgtgatcttgggctactttcttatgtggggtaggaatatttgtgagttagaaatattacacttctctatttccttctagacgtaaatctgttaatcctgtcagcactgttactcacctgaaagggtctgtttccctaggagaactgagggcactcggtcaacactgattttccacagtgggtattggggtggtatctgcttgttttttttgttgttgttgtttgtttttttttgttttttttttgagatggagtctcgctctgtcacccaggctggagtgcaggggtgcgatctcggctcactgccagctccgcctcagaggttcacgccattctcctgcctcagcctcccgagtagctgggactacaggcacccaccactacgccaggctaattttttgtatttttagtagagacgaggtttcactgtgttagccaggatggtctccatctcctgacctcgtgatctgcccgcctcggcctcccaaagtgctgggatgacaggcgtgagccaccgcgcccggcctggggtctgcttttaatgaaggaggcatcaaggggtgggctttgcgttggcctgatgctttcatctttctttcacaaaacctgtccgaagaaaatccgtctaaatgggccattgctctcctcaggaaatagtcattgggaacttcttttcctttcctttgacactaggaggctgactggggagaagccctggtctatggctgtgggcagcaggggctgagaggagcaggctctcaggggggcacgggtaccccaagggaagccagagccctgatttgttccattctagtaagaacaaagactgctctggtttcatgtttgttctgattgcctttcatcaaccggtcccctttctcccagttcttaagattcagtacagtgacagttttatgaacaagaatagaacactagaacagacaaaccattgaactctatgctgataaagatttattgagctcctgctgtatgtttgcattctgcccagaggctctgagaaaaccaggccatatgctccatgctttatccatggaagctccccgtcaggttgggaaagctgacagctgcagggaatacagtgtgacacaaaactggctcccatgcagcccttacgtgtcgcctctcagatggttgggggacgaaggtcgactcctttgggtatcttattactaaaccagtttcagggaatctgtgccaccctatctgccattaacgtgaacagatgagtccccaaggtgtaattttgggtattgtctgatgtctcttggaatttattatttgtttttccaatgagatttcacctcagggtatagtaaagttgttgaggggattcctggatgtgttctgcaattatctaggctgatttcagaatagagttatgcttatagtcaaatttatcagctgtcaagaattttatttaaaatttatgcagataagcaggaggaaaagaagcctggtttttacattttaatcctattattgatgtgaaattttattttccttcctgtaggtgtttattggctttgtattgaaacagtttgaatacattgaagtgggccagttcaggtaatagcattttattattttagatttttttcttcttcttgtgtacttacatgtaatttaggttattaagtgaatgtttaaactactgttaggcatttttgctgttttctttaaatggaaatctgactaacatactgtgcatttttgcttctcttaaaaattaatgtatatctcaagacttgtttggaagtagttatgtatctgaaaattccatatgttgtcagtattcattgcacatttcaaagcatttaattgtgttgacagatggtggaatgaaatcttgtggtggagcactagtttttaaatcttcttagagaaagcagttttatataatgttgtctttagtaattattatgcatttgtattctctgcagctttttcttgctagatgttgaggttttaatacttcttgctagtccattacaggtttataattattaaaagttaaaattcttttagtacctaaaatgcttaataaacattgtaattaggaaaatttagtgcagaaggaaagtgttcccagattccctggggtctggaaacatagtgtttattctaattacatgacacctccactgtgttttggggcaagttactgtttctcttttgagtttcaatttcttcaagagcaaagaggcagaggagagctaggaagatcgtagctgctgtgcccctgtgccgtcgggtgccttctacctgctgcctccgaacctttacacatgtccctgctctgcgcgagggcacagatgggatgcactgtggcaggggtggggttagagtagatcacggacacctgttagcttgatgtgtgcttgctgtcaaggttgaatcatgaattattttatgttgcttatattgatatgtatcttaattttaaaagaaaggtctaaatggatgtttttgtttttagggaatcagaggcaatcattccaaacatctttttcttcttggtattactatcttatgaacgctatcattcaaaacagatcattggaattcctaaaatcattcagctctgtgatggcatcatggccagtggaaggaaggctgtgacacatggtaacgggacacacctttcactgtcgtcttcggtgtcgtgatgtgcttggcagtgttcgttttcatatacccactttgaacgttgtcagtggcagccatgtgcttctcaggctctgcatgtgtgtctgtgtatgtgaaggtactggttagagacgtttcaaaagagaagagagcatattctttactctcagcaatttgtaatcttctcagggaaaaaaattcaagaaacagtaagataacctaaggtacagatagattctgaatataaagttcctgttcattcacatgaaacgctaaaagttcttcacttgatcttagccaaaaggccaagaagcgatgcaacactaaaaattcttaaatcgaacttgccgtgaattaaattttgatctctcatccagtggtattggagatatagtttgacttgggttcagggctttctgttttgcctgatgattttgctggagcttaaataaggaacccaggagatggccagctgtgcaagcccccagcctgtggaaggagctagtgtggttttatgaatgagttgcaaatctttctttgagctttttgaactgatcttccagcattgccctattgacccctccctgactcctttgctggaatctgtaggcttttgaactttgacagggacacatcctaagacccttgcaaactcccagatgtgagaatggcactactacttagagtcttttcgactcagcgtgtgtgcagaagagcatcaaccgggctgtgttgcgaggcagggccttggctgacctctcagtgtttacatagctaagccagttagtgtttgccacggcctcacaagggcttcagattcacacagccaaagtatagattattaaaggcataggtgtttggtttcctggacttggagggtctttggacagaaaatcagtaggcaaccacacccagtactttgtgctgggaagcttggtcatctgtgagagggtcagagagtatacccatgcgtgcatgccaccgaagggtcagtgagtattcctgtgtgtgcatgtctcagggccggagagagtatgtgtcactgagaggtcagagtgtttgtgtgtgtgtcaaagagggttgcattgtgcccttcactgaggggtcagagggtgcctcgcgtgtgtgtgtgtgtacgtgtgtgtgtgtcactgaggggtcagagtgtgcctgtgtgtgtgcttgtgtgtgcgtacatgtcactgaggggtcagagtgtgcctctgtgtgtgtgctcatgtgtgtgcatacgtgtcactgaggggtcagagtgtgcctctgtgtgtgctcatttgtgagcgtatgtgtcactgagggggtcagagtgtgcctctgtgtgtgtgctcatgtgtgagcgtatgtgtcactgagggggtcagagtgtgcctctgtgtgtgtgctcatgtgtgagcgtatgtgtcactgaggggtcagtgttcctatgtgctcatgacattgagggtcagagtgtgcctgtgtgccaatgaaaggcatttcttatatttttttatatgtggtcatagtagaccagttaatttattttgactcctgtgttagaccaaaataagacttgggggaaagtcccttatctatctaatgacagagtgagtttacttaaaaaagcataataatccagtggctttgactaaatgtattatgtggaagtctttattgtcttttcagatgaatcaagtagattattcttgagaccaggaatgttgctgttttggttatttggaaagttttatcattttcaaattgacttttgaatttgagtcaccttttttcagaagtggtgttaaattataggagccctaggttttttttctttttttagaagtcatcacaaaatgatcagtgttcagaggaagagctttgaccttccacatggtataatgattgataaccttaattcatctcttaccataaaccaagtatgtgtaagggttttctttatttcttgaaagcattttgtagatgttgagagcagttttccaaatgtaatttccatgaaatgcctgataagggtacccttttgtccccacagccataccggctctgcagcccatagtccacgacctctttgtattaagaggaacaaataaagctgatgcaggaaaagagcttgaaacccaaaaagaggtggtggtgtcaatgttactgagactcatccagtaccatcaggtaagaggaatgtatgttggaactgtcgtggatactttattgacccgtgcagatggaaggaagtgccatgtggtaacgctcactgttaactgtgttactttgaaccaggtttgggctttctggggcctgggtagatgccggtgcagggggatggggagggaggcggggggtgggggggtgtggtggagttggggaggtgcagtggcaggaggtgttgttggtgtgtatcctttttttttttttgagatggagtctctctccgtcgcccaggctggagtgtggtggcacgatcttggctcattgcaagctccacctcccgggtttaagcaattctcctgcctccacctcccgagtagctgggattacaggcatgcaccaccatgcccagcaaatttttttttttgtatttttagtagagatggggtttcaccatgatggccaagctgtttcgaactcctgacctcaagtgatcctcctgccttggcctcccaaagtgctaggattacaggcgtgagccaccatgcccagcctggtgtttatctttaaagtgggcacagccacaggagttcacctgactcctggtctgagagtcacgagatcgttcaagatagtgaggccctcttttccaaaacgaggaccaaaaatcaattgacagtgttggtcaagatggtagaaaccttaaaatgatagaaatctcaactctgaaataaaaactttatttgtatatttatttaccactattttgacatagggctaaggtctttttctttgagctgatttctggttttgttttcttaaagtggcataagaattcaaagacattttgaggaaggctgagtgcagaaatctctctttttaaatgacttctcctttcttttaacttgcactgttgtctagccctcacttattttgtcaattctttttagctgtttgtctttgaatcttcataaagccatagcttttctcataagaagcagcactttctttgttcattcatattttaatgaacccctgtagtatttaattaaatacttaatgcctaattaaatcacataattgcaatgcaaaagtacatgtatcataaagaggtctgaaaatgagcaactggcaagcaggtggtggcaggcagagctgcttgggtgggtgggtgtcatggagaggagttcatcagccacatgttcagtgagctctggatatgtctgtttagaaatgatcactaataaacttgtgctcaaccatgtatacctctgggaagcaggtgctcttcagtagattgcctctgcagagaacacagaattgaagtgaatgtccacaaaggcaatgagccacctgcagaatagtttagtcaaggctgtgtttgaagtttgccaaagattaatatacatttgattttcatgttgtgccttttctctgattgtgaaatattacaaattctatacaaataacaatgatggcaaatcctcctgagcaaagtgtgcaccttgtatgtgccctagaggaacttgtgtttcgttctgattcccctacatttctcatgtcatagagtgggggttgcattagtgtccccctgtcctcgctgggatcacatctgtttggatcctagagtcttccagctgaactgggacaagtataacagacggacacgtaggggtggaaaggcgtctcttggcagcagactttctaattgtgcacgctcttataggtgttggagatgttcattcttgtcctgcagcagtgccacaaggagaatgaagacaagtggaagcgactgtctcgacagatagctgacatcatcctcccaatgttagccaaacagcaggtttgtccccgcagccttggcttgttgttgcatagtgatggtagcttaaggtccttgtgaaaggtgggtggctggaatcagctcttccttcagtcctaatctgtgccttgatagcagttctccgtgctagtcatgggacagctgacttcatttcttctcacaatgccatctcaggttggtattgcccacctactttacaggggggatcccacagctccgagaggttatggaggtgatcaggcagcacacagctttagagtgctggggtgagggcgggccaaggctaactctaaagcccgaacccttacctcctacactgcctcctgcattctggtcaacccagtgttttatttggtggttagatttttgtttttgttaccttactgcttgtaatttagcagttttcctttcctttcccttcctttcctttccgacagggtctcactctgtcacccaggctagagtgcagtcgtgtaatctcactgcaacaacctctgcctcccaggttcaaccaattctcccacctcagcctcctgagtagcaaggaccacaggtgtgcaccactacgcctggctagttttttgtatttttagtagagatgaggtctcgctgtgttgcccaggctggttttaaactcctgggcgcaagtgatccaccaaccttggcctgccaaagtgctggcattacaggtgtgagccacctcgcctggcctattcatcactaatcagaatttctatgatcaaatgacatgaatcattgtttccacaactgcagtggaaggaaatggcctggcagtgccagtttcagaagcagcctgcccccagtcaggcacaggccactgtgcccccagtgtagcagcacctctgtagctcacagagaagggtggtggggacctccttgaggcagctctgccagaaaatctcatgagctgcctggcacagcttgaggttgccttttaagtggactcagcaaatacatgtttgttcatcttgattatacacaataaacaactactctgtatagtacgagtagtccgtggtttttggcatttgatttaaacttagaggcatgtgatattgatgttactgccttcatgactgcacccccattctgatttcataatggaatgttatcttgagaccagttagacaacaggacagggatcttggcttctggtgagattgacagcagttttagtgtggtcagggtctccctgcctacagatggttttagaatggtgccctggaagctttatcccattcttttctgtgcgtaatctgagtagagtggagatcgaaggcctgaatacatagtaaatacctgacttaatatctgccgcaatggaaattgtgtgatacaacatttatgaaacgcttagtgcagcacctgccaggtagctcaccacaggtgcatgttgcattcagaagtagtgctagatactatcctgttactggcagtgcatacatcagtgatcaaagcagattaaagaaagaccccctgccttcttggagtgaagattttgttgggatgcgggtaaggggacagacaatagaaaagcaagtgagtgaagtctataccatggcggctgatcaggaacaccgtacagaagaatccaggagggaagagagttaggtggtgtctgcggtgggagtggcattgttcagctggtgatgagaagaagctttggtgatctggtgacatttgagtgaatttgcagaaaggaaagatacaagcctaggagatacctggggaaggaacattccaggcagagcaaatagcagtgcaaaggccctggcggggggcggacatgctgttagggtacaagcaatgagggtggaggagtggggcagccatggggagggaagggagtgaggcctggtggggtgaggccagtgtggaggagccttgagagggtttgcgctgatgtggtgtaggttttagcaggatcattcttattcctgagttgagaatagccttgagggggaggtgagggcagagcagggccacccatgtgagacccggcactggagtggaatggcccaagtcagcatcccttggcagcatgaaagcaaaaccagcaaggtttgctggtggcttagatgtggcatgtgagagagagcagggctttgggggtgatttcagggtgaggacagggtggctgtggacaaggtagggcagacattgggggcagcaggaggtcagagcctgtctggatgtagcagttgagaccccataggtgcctaatgaggtgaggccagcatcaggtgtatgagcctggagttgtcgagagactgtggggcagggggtcagcatctgagatgtccactcacagtggacccagactggctggagaggaggaggagcttgaataccgagcctgctgagtcccagctccaaggtcaggtaggtgaggggagccagtgctggggcagggggagtaggcaggtgtggggttcctaaagccaagattttttttaaggcattttgtgcaggagggcgacatctgctgtcagcaccttgggaacttggcccaggtttggcagcaccgagggcactgatgagtgcttttggaggagcaaagggagccaaaccctaatgggaatgtgttcctgaaaggacaggagagagacttgggaaaaggttttacttgaagagggaacggagaaatagggcagtagccagaggaggagaggagtcggcaatgggttaagttggcagaaatgaaggcctgtttacgcactgagggcagaagcaacagggaggatcagttcatgacacaggagacacaaatcgccgttgtggtgttcacagacatgggttaggattggctgcatggatgacagagcactgtgggttctcccagagttgctggggaggaggcagagttggtgagcacaggcgagggtccaggatgcaggaatcctggagctcaagtcagttgttcccttgttgtaagatgtggccagtgttgtgagcttcacatctgtgccttgaaaaacaccacatctgtttgcagagttgtttactatgtatacacactcagtagaaacaaaaattggaaacagtcagtgcccaccatcaataagtaatggttgaacacactgtggtataagcttagactattttagcttgggctattttgcatgattaaaaatgttctggccaggtgtggtggctcatgcctgtaatcccagcactttgggaggccaaggcaggcagattgcttgagctcaggagtttgagaccagcctgggcaacatggtgaaaccctgtctctactagaaatacaaaaagtagctgggtgtggtggtgtgcgcctgtagtcctggctaactcaggaggctgaggtgggaggatcacttgagcccattcgtgcgccactgcactcctggggcacagagtgagactctgttagaaagagagagagagaaagaagagagagggagggaggaaggaaggaaggaaataaatggaagaaatggaagggaggaaggggagggaggaaggaagaaaggaagttcagccagttgccttgggagttctccattgcactgggttaagtgagaagagcagagacgtttatgatttttcaaaacaactaaaacaaaacctctgtgggtgagggggcaaggatatggctataggaacatggggcagattaagaaagggatatacacacaccacttagcatttgttacaactgttgtgggagggatggagtgcagaaaaagaaaaaaaaaagtgcacaccatcccatgtatgtgtatacaaagggacgcttggaagactggtccccaaaatgttggtaatgattgtgtcagggtgctgcagtgctagttgattttttttcacacttttgtatatttgagtcttttacagaaagcatttattatttatgtaataaaaatctaaatgacaagatttctgttatgggaaaaatgtagctatacagtgttgttgtaaaaatgtttgcttggttcaccactgaacttaaaatgcttttaaatgagggaaggtgacgatgagatgattatgatgatttgcccttgagttacatagctggtgtacaggaagctgtcgtttcttttggcttacgtagaaatgtttgtggtgtctaattccacagatgcacattgactctcatgaagcccttggagtgttaaatacattatttgagattttggccccttcctccctccgtccggtagacatgcttttacggagtatgttcgtcactccaaacacaatggtgagtctctcgcctggctcagcagatgaatctggacggcttgttcaggctctgattactgggaccacccccagaatgtctgagtcagtcagtttgggtagggcttcttgagagtttgcttttttttttttttttttttttggtgtgggggtggtgcggaacagagtctcactctgtcgcccaggctggagtacagtgtcatgatctcggctcactgcaagctctgccttccagcttcacaccattctcctgcctcagcctcccgagttgctgggactacaagcgcccaccaccacgcccggctaatttttttgtatttttagtagagatggggtttcaccgtgttagccaggatggtcttgatctcctgacctcgtgacccgcccatctcagcctcccaaagtgctgggattacaggcgtgagccaccgcacccggcctttttattttttttggagatggagccttgctctgtcacccaggctggagtacagtggcgctacctcgactcactgcaacctccgcctcccgggttcaagcaattttcctgcctcagcctcccgagtagctgggactacaggtgcgtgccactgtgcccggctaattttttgtatttttagtagagacggggtttcactgtgttagccaggatggtcgcgatctcctgaccttgtgatccgcccgcctcggcctcccaaagtgttgggattacaggtggctctcgcaccaagccaagagtttgcatttttagcaaattcccaggtgaaactaatgcctgcttttctgggagcacactttgggactcagtgatagagaggtttattggtaggatagtaaaataggagttattttctttcacaaaattggcaattgggggaaatttaatcttccttttttcttcagctgtgacttatgtattatgtttattttaggcgtccgtgagcactgttcaactgtggatatcgggaattctggccattttgagggttctgatttcccagtcaactgaagatattgttctttctcgtattcaggagctctccttctctccgtatttaatctcctgtacagtaattaataggttaagagatggggacagtacttcaacgctagaagaacacagtgaagggaaacaaataaagaatttgccagaagaaacattttcaaggtatgctttctatctgagcctataactaacccatgccttttgggaagtcacgtgatgtttcacagtcagtaagtctggaataatacctggtcttgcttcacttctgagttgggtaaagaagtctgtatcagtgtaattttctaatccgtcctgcattatctatggctcttggttcatacctgtcttgaagttctgtcatgttctgtctcttgtcctcagtagagatgctacagcagtggctcgcctcaggcagggcagggcagtggggtggctgtcctgggggcaggcagtaggggcacgctgacgtcagggaagttgaaacccaagagaagccagtaaaagtgagtctcagattgtcaccatgtgctggcagttttacacgctgtcagtaataaaagtcttctccctgcagggcagcctgcctccaataaatacgtgtagtatcaaatcctgtcttccctcataaattgtttggaagctccccaaggacagtgatgaggcactcgtaagtgcttgctgcctagatgggtccctctccacctttgctagattctgagcattcactgagttagagctgcttctgcaaatgtgctgcttctgctaagtggctgtgacttcatgcagccttcacttggtttgtcatcagtggagatgccctgtgttgtcgaaggagataagcccagtaagcctgctgggcaccttttggtttgcaggttcagcaggcagcccatggctttccctgtgtcgcattgaagcagctggctaaaattgatgatacattaaattcctgtgacagatgatcagcttgtatttgtgtaatggtgtacagttcacaaagcttaaaaaaatgctacctgccatttcatcctcagtgaggaaggtgatacacagagagaccaagtgactgtgtccacggcgacggcgctctgcatttcactttagcggttaatgtactctacctatatttttactttatatttaccatatatcttttcatgtatacttggcgtaagtgctttatagtagtcacctaattcactgtcatcttttttgtttcttggaaggtttctattacaactggttggtattcttttagaagacattgttacaaaacagctgaaggtggaaatgagtgagcagcaacatactttctattgccaggaactaggcacactgctaatgtgtctgatccacatcttcaagtctggtaggtgaatcacattagtcttcctggagtgtctcgttccccattctgcactatacactctcagagtgtaggagctgtgctgcccggtagaaactctgccttgcccagtgtgccagttgaaaatatttgttgctgtaagagtacacctgataccatgtgacccagcagttccactcttgggtatatacccaaaagaatggaaagcagggtggtgaaaagatatttgcatgccagcattcatagcagcattattcacgatagctaaaatgtggaaccaactgaagtgtccctcgatggatgaatggataagcaaaatctggtgtatatttacagtggaatattattcagccttaaaaaaaggacattctgacacatgctacaacatgggtgacccttaaggacattatgctaaatgaaataagccagtcacaaaaggacaaatactatgtgattccacttacatgagggacctggagtagttaattcatagatatagaaagtagaatggtggttgccaggggctgcaggggaggggagttatttttacaagatgaagagagttattctagaaatgaatggtggtgatggttgtataacattatgaatgtacttaatgctactgaactgtacagttaaaaatagttaagaggaccaggtgtcatggctcatgcctgaaatccaagcactttgagaggccaaggcaggaggattgcttgagccaaggagtttgagaccagcctcagcaacatggtaggaccccatctgtacaaacaaactagccggggatagtggtgtgcatgtggtcccagctactcaggagactgaggctggaggatcgcttgagcccaggaggttaagtctctagtgagatgtgttcatgccactgcactccagcctcggctatagagtaagaccctgcctcaaaaaaacaaaacaaaacaagacaagagccaaaaatggttaagatgggccaatcacagtggcttatgcctgtaatcccaacactttgggaggtcaaggtaaaaggatcacttgaagccaggagcttgggaccagcctgagcaacatatcgagacccctatctctacaaagaaaatcaaaaactagctagatatggtgggcacatgcctgtagtcccagctacttgggaggctgaggtgggaggatctcttgagctcaggagttcgaggctgcagggagctattattgcactccagcctgggctacagaatgataccctgcctcttattaaaaaaaaatccaaaaaaaaaaaaaagtaaacctgagagcttcctcctcctgtgttaaatttggaggccaagatgtttttgttacttttacaaatgatcaaggacggtgaaggttgggcatggtagctcacacctgaaatcccagcactttgggaggctgaggcggggtgatcgcttgagcttgagaccagcctggacaacatagcaagagaccccatctccacaaaaataaaaaaataaaaaaaaatagccaggagtagtggcatgagcctgagcccaggaggtcaagctgtagtgagccatgatcatgccactgcactccagcctgggcgagatcgagaccatgtctctagagaaagaaaatgacaaggacagtgaacccaagaaagtcataagatgccagctgtgcagcaagcatggaaagcagccagtccaaattaggacagtgtgttttccaagaagaacgatcgtttgtaatgagaatgctttgctttaaataaatgactaaatagctagaagcctagttctaggggataggcacgtctttcttctctcaagaaaatagaaaggcaattctaatttctagtaacagcaaacagcattaagtcatggtccaaatatgaggcaaaccaaaatgtggcttgattgttcagcagttgatctgttggaagcccttgatattaaaaaggttctcctttaagcggcttaggagtcacgatcaaagacctatagaaagagatgccatccttctaggatccttggctctcttgggaactagattcagatagtcataatgtaaatactgcttgagctttctttctttctttctttctttctttttttttttgagacagagtttcactcttgttgcccatcctggagtgcaatggtgccatctcggctcaccgcaacctctgcctcccaggttcaagcaattctcctgcctcagcctcccgagtagctgggattacgggcatgcaccaccacgcctggctaattttttgtatttttagtagagacagggtttctccatgttgaggctggtctcgaactcctgacctcaggtgatccacccgcctcggcctcccaaagtgctgggattacaggtgtgagccaccgcacccggcccgagctttcatttttgaaatcaatgtatgactgaaacactgaagacttactgacttaattatggtttcagaacagaatgaaaatgtcttcggttctgatgaatataaaaggaaaactaaccaagttaatttggcaagtagatggtagagatagaggtggggagtggaaggggaactaaaatcttcacctagcattgttgggattatatggttacatcatctgaagttgacagaccaaaatatagaggcttcagaggtctccaaatagaactaaacatgtaattcagattgttaggaggtagtataaatgagctaaatctcatctttattacggtagagttaatgggtgatgtctaaagttgtctgaagtctataaatcatgacaaattatgatgtggtgattgtattcaacagtctttcagttgcagggataaaaccccagtttaaactagagtaagagaaagaatgtgttggtttaagctcctggaaagtgcaggcaagggtagttggtaggactgcatctagtgttgtaattctgtggtctgcattgtatatttatgcatctcagctctgctttcttcttttcatttatataatttttaaattttattttaaagatagggtctcactttgtcgcctaggctgaagtgcagtggcatgaagtgcagtgcgaggctcactctagcctcgaactcctgggctctagagttcttcctgcctcagccttctaagtagctgagacaataggcatgtaccaacatgcctggataggttttaaaatttttttgtagaaatggaagtcttgctgtgttgcccaggcgggtctttaactcttagcttcaggcgatcctcctgcctctgcctcccaaaatgctgaggttataggtgtcacccaccacgcccagtctcatctctgcttcctgtgttagttttgttctctggtgggctgttttcacatgaccgaagatgacctctagcaggctgtgttctcagcccctcaagtaggcctatgtgattggccttgcatgagtaatatgggtgaccataaacccctgaatgctctggtccacatgggccaaatgggagactggacagcattccattgatgaggaggtggggctggtctccgggagtaagggagaggagcacatgcagtaactgatggtctgctgcaagggatagcagcacagcagttagaattttggaggtaactaccagaactgaaaacagaaatgataacaagtagttgccttaaaaagggatgggagcagggtgcttttgtgatcaaagctcctttctcttactggatttttgtacacattttgcatacatatcttagagtaaaagatagcattttcagccttggtccatttgaggatactcttggcgtggcccgcctccatgctagcaggctctggttgtgccaagttcagttgagcatcctggctcttgcctgcacggaacttccagtcagtgcgtcagtatcacaagtcttgatatttcctatgaagaagaacagtagtgcagtgacagacgaaatgggtgggcaggcagaggcaggatttctgagggagagaagtagctagctttttgcagagaagagttccggcacccaagagagcagctgagagtacaggcaggcaggcaggatgccggtagggcccggccgcacggcgccacagaatcctggagaaaggggcctcttcatggcctctgcattcagctgctgtcaccctccgcacaggccatggccaaaatttaattttcatagtggactctagtttttgagccttacttgctattattgaaataattttcttgtttctttttaaagatcttcggattatgcttcactgaccactgtaataagtttaaagttgagaaaatatggcttgttaatgaatgataggtcaattttagtatgttggtcattttaatattttgccaccagttggtttggatttgatgccaggaggagacagcctcatttctaaggactagtcttgcctttgtgggataagggtggtgtgttctgtgtccttctacatgtccgagcgatctctgtgcagctcaaatgtggtcactgtcttattgcgctgatttcctctccttccatctcacaattgaggcaaaatattgttactgttgaagtgttgtccaataggacttccagcagagacaggatgtctgcactgtctaatttagttgcctttagccacatgtggtgttctgtacctgaaatgtggctggtctgattggatagcttaatttataattttatttaattttaattaacttaaatttaaacagctctgtgtggatagtggctcctgtatgagacagtgcaggtctgttgagaagcagctttactggtgggagtggagggcttggagagggcacgtgggtttcctgctggtatcttttgaccttatttaatctgcccaacatttgcaagtaagttgtgtgtgtgtgtatatataaatgtgtgtttctgtcttcttgtttcctttgactgcatttatttgaaagacactaggtggcagaattactgtatttgattggtttcaagataagagttgaaataattcatctcgtgtttttatataagtaaggtgtgtttagcatgtaaaattggtaatatgtattcacgtactgcttaaacaaaggctatgaattccacccataaaccgaaaatgaagacctttaaatttgtccatttcaggcgtgggtacttcttaaataatacctggttcaggaactagtcagaatggcacccttgactttttgtttcctgcttttcctcttgttgggagaggagggtattcatcccaaagtggtttgcctatttcacattccatctaggataagcagaatagccaagaaagatagctgtcctcctgtttacaacatttggggtaaccagcatccctctcttttggtccaagatagactggtttagaaacagatgatggcaccagaggcccaggaggtggaaacatcagctttgtttgttgtccatgtggctgaattagagctgtctggccttgtagcctcaacacggccttccagctttgctcaccgtgattttcaaggacacatcttgtgctcttccctgcctgccatccagactatacccagtcagggtggcaggagctgctgccccttcctccctgagtcctggtcgtgggtggtggagatgtgccatgacgctcacggaggcatgctcaccccttcctctgtggcagaggggatggctgcacgacagctcttccctgtcctttccaaagcgtctgtggttccactttttggggcaaagcaggaatactggaagagagagaaagtggtcctttctatagtaataaagttgacattgattcaagttcatgcttggggaaaggacagggctactaacaattataatgctgggagcaatggaattttctcatgggtatgtggtaggtttaattttaattatcccagttaattcttagaactgctctgtgaagtatttcccgctttgtgcttaagttctaaaagatcctgtgccaaaaccaagaatgaaaacccaagcattctttcttgcccatcgatctttctctcatcaggccacttcttgggttgatagtggtgagtgtagccgctgccactttcagaatacccaccatgggccccagtcactgtgtggcgtggagaagagatggttctctctgtgtcatagctgaacaagcccagcccagagaggtttctgccctaggagctctcgatggtggaattgggatgcgatcccacatcctgcctgttttgaaaacagcattctttatttccaattcctgcttccattgttccttttaatatttctttgtttagctcacaaaaacacggcttgcggagctgctgcgtgcagctgtagctgtttctctgggtgcagcctgcatccgccttcctgcccgcctcctttcctgcactgccatcgtggtctccgggcacttggtccctttctcttcccctgagtccctttggctcccctgtgccacccttgtgatccacaggctctgccttctttctgtctcagactgctgctcatcactactcgggaccctaggaagggaggttccaccgagaagcatcttctcatctcagccacgttctcagtgccactgttgtctttgttaggtaatggtagctactgtaacaaataaaccaacatttccatggcttcacaccagagaaggttgtttcttggttttatgacaatgtattgagggtgttcttggttcacggatggttttcctccatgtgggaattcggggacccaggctcctttccttcttttggttctgttctccaggccttcacatcctctgtgtctggttggggacaaggagagggaaggtaaagaaggctttgtggccttggataagtgacaggcatgcctttgctggtgttctctcgtggtgacaggtcacagccccaccctgtaaaaggggactgagagacgtcgtcctgctgcttcccagcagcagcactgtggtctctgatgtgttttctgtgaggataaaaacaggtgattccaggatgaggaaagtcagggaaacccttggaaggaggggaccaggcgggtgtcaccatgggattagtggtggcttcagaatgagctgcagcgagtgccatgccttctaaagcttttgctattctgatatgcccacaccatgcccagcaggtgtctgccttgctctccgcagagagagtgatgaatccttctcatgagcctctgtccagttgttcctccctccacctggaagggaccctgggttcctcataacatcccagcggaacaggggaccttctatcctgtccccaagttcatcctcatcctcctgccggcttcctggcccctcttatgtctgcttcctgacgccacatccttctggattctctggaattgaattttgcctttgatgcttatttaaaaatatccattgcaggccaggtgtggtggctcacacctgtaatcctgtgcactttgggaagccaaggtgggcagattgcttgagcccaggagtttgagattagcctgagcaacatgttgaaatcctgtttctatagaaaatacaaaaattagctgggcatggtggcgcacacctatactcccagctactcaggaacctgagacaggaggatcaattgagccccggaggccaaagctacagtgggctgtgatcgtgccactgtactccagtctggtcaaacagagtgagaccctgtctgaaaaaaaaaaaaaaatccattgcatacttcaccgtagcgaaacatgtatgtcttacctttcctttcctgcctgtagctgctcttttacacttaacagccacactaagccagccttaaatgaaaaacaaaccagcacttcctgtgccctcctgcttccttcatgaggggtccctccctctgtgtacactccattctcattgcccatggtggtttgtttccctcttgtttctcaagccatggcagcctgcctcttgccctctttactaaaaaggcctttgcagaggctgcctgtgttctttctttctaggtctctctcatcctaggccctccagcttgattctgtggagctgccctcttgtcactcagtagcttgtggggtcttctctgtctagccacttaattgattgtgttcctcgagttgctgtccatggtctctcgttactgttttctctgtgtttctgcctctctccttggccttggtaggtccatcccctttgtgaccttggctgttgctctcatggacaactttctcttgctggtccttgtagtcctggcatccagcttctcgacacgggacttgtcctgccagtacctcagacttgcacttaaaattgaactagcaccactgtcactctccagggcctcttcttgttaattagatcattagggatgttcagaatcccagcatcatagtatgttcctcctcccgctaccccaggaaccctaaccttacctcctcctctctatctactaggaggtggccctcagagtccgtctcatcttccacctgaacttccctaataggctccagcagctgccaccccgggggctgagtacttcctccatgccttgtgcagtgctgagccctttacctgggttctcctgtttgctccttattacagccctgcgaacagatactgctcttaattccatcttacacctaaggaagctgaggccccaggtaaggtgcatccaaggtcacccaggtagtagacagtagagccacgatctgaaccaggcagtctgattcagagcctgtgttgacactcagccacctagaacacagcttggattgtgggtttctattacctgttcaaaacccctacatcccgggtctgtccctgcacgtgctctgtggcctggctgcatcttccttgaaggcagtgcatgcctcttcactcagggggcccatgcaggaacagagggccccacagaaggatgaggccagtgcagaatgggctggaggggacaatgctgaccaggaagcaagtgtagagaaatcccaggaaacctggaggagccagagacaaggcattagaactcctcgtcgtgacctggtctgcattctctgagtgtgctgcttctgttagctcgcttccttggtctcaggttatagtttaaggcattgtggagccctaaaaagcctgtactctgtttttacctgttttaggaccctttcactttggggatgtgttgattttttttttttttttttttttttttttgagatagagtctcgctccattgcccaggctagagtgcagtggcacgatcttggccactgctgcccctgcctcctgggttcaagcaattcttgtgctcccgcctcccaaatacctgggattacaggcacccgccaccacactcggccaatttttgtatttttagtggagacagggttttaccatgttggtcaggctggtctcgaactcctgacctcaagtgatctgcccaccttggcctcccaaagtgctgtgattataggcgtgagccaccacacccggcctgaaatttaaatcagaaataaaattttgatcccaacagtgatgccaggcagcccagatctgggggagagggtggccttggccagctgggcctttctctgtttcccaagtcttgctgcctctccctgctgggctttgcagcctgtgcatgtctctgtgcctttgaccttgtttatccaaaggagaggatagaatgaagtcatgattcctggagccctgagaaggatgctgtggagaaatttgccggtagaatctagctgagtgtgttgctgaggtgccagcattgtgtgtggggaggctgaccgcttggcctgcctaggcccaggatgctccatggccgggcacagaggccacttggctgtcaggtgtcaggagcctgcagagggcacacagagcctggaccgcaggggggtcctgctttctcacctggcctccttcagcatttctgtccctcagtccttagcaagcccaggagctgttgagtttggcaggtgccgagtgctgttcctgcctgtgtagctgtggctcagtcctgtgggggccccgctgtggcccgagtgcagtgattcgaggcgctgagtgttccctgactccttctccaggagctgtgttcagactttcgcagctcttggcttggagctcctggagggcttggcattgccgaccaatgtggaggtcgacagtgagagaggaggaatgctagctttcttgaccagtccattaaataagtgggatattggccaggcacggcggctcacgccttaatcccagcactttgggaggctgaggcgggtggatcacgagctcaggagttcaagaccagcctggccaacatggtgaaaccccctctatactaaaaatacaaatattagctgggcgtggtggcaggcgcctgtaatcctagctacttgggaggctgaggcaggagaacagcttgaaaccggaaggtggagtttgcagtgagccaagattgcgccactgcactccaacctgggcaacaagagcaaaactctatctcaaaaaaaaaaaaaaaagtaggatatctgtttctgcttagaaaaatcagaattttctaaatgccaggtgttctgaatacgtaagtatgggagacgactcagcctgtttcatttttatgtaaaatcttcgcgtagccatgtggcactggaccgagatgaaagcaaagacatttctccttaactttgtttctaggaatgttccggagaatcacagcagctgccactaggctgttccgcagtgatggctgtggcggcagtttctacaccctggacagcttgaacttgcgggctcgttccatgatcaccacccacccggccctggtgctgctctggtgtcagatactgctgcttgtcaaccacaccgactaccgctggtgggcagaagtgcagcagaccccgaagtaggttcataatgccccacagcccagggcgccagcccagcaccctgtcctgagactcccagtaacctgagctttggccaccgttaaagcattttcattttccattttttgtgagggcttgtgaaatttctgctgcatattaatattcctttcatggacagcatattattgggacaaacatgcggtccagctaaaggcattcaaaatagcagttgctttctaaatgcgattttctttggcaggttctttgacaccattgcatcttgtgggatatgcttgtcatgctctgtggctcctactaagttctagtccttaaattggttccatagccagacatgttgcaatgtcttaacctcattataaagtaaatgtggttctggttatccttagataatgaagtaacagtgtagcaaatttcaaaacctcttggaaatgttattttaccattcaaaaaggcttactaaggttctcgttatgggtggccctctttttgcaaaaggttttcaggcttaagctccatttctaggtgctccaacactccattatttgtatatgtatggaaataaaagctgtgaccacccccaaccctggcccccgcccagctgaatcctcagcacagtatttctggaaggctcaagatcccacgctggggaaaagaagttctggagacaaaagagggcaggtgctgccgtgcctctctgctcagtatggatactggaccttgtgctgccagggctcccagtagggccagttcatggcactcagctggaaagtccactgttgggaggcattcttaaccatccactctgtgccgtatgtagtggggtctggtcattctgttggaggagacagaccagtgacgacatttgaaatgcttggtggatgtcttaggcctgttacgatgactgagcactgtgggggcaggagacagaaagtcagtgtctcctagttctgtgctgctttaacgtgcatagaaatcagctgcggattcagcagatcactccttttctgacagatgggcctgcttactctgatgttatatcagaaagctctgaatctgggaattgtgtcccctgaattggagtaacagaaatgcttagatgatgagtgtttaaaagaaataaaccaaaggtaaatttagtttggaattcagcaagcgtcttcattcagccctctgagggcaaactacagctttttgtaaatgtaggtaaattctgtgactgtttcgtgaccccctctgatccagttttcctttataaccttctgtattgttccttctattatcctgaaataacattaatagattaggctgggcgtggtggctcatgcctataatcccagcaccttgggaagccaaggcgggcagatcacctgaggccaggacttcgagaccagcctggccaacatgatgaaatgctgtctctactgaaaataacaaaaattagccgagcatggtgacaggtgcctgtagtccctgctactcagaaggctgaggcgggagaatcgcttgaacctaggaggaaaaggttgcagtgagctgagatcgcgccactgcactctagcctgggtgacagagtgagactccatctcaaaaaaaaaaaaaaaaaaaaaaaattaatggatcaatggatttttaacctaataattaaatttcaaaaaatatcgttctttaatggtaatgtaaaggtaaaattaagataatatgtaacaagcatgtgagtgtctaaggtgtccccgtggtggaaggaaaaaataaatccccataagtgtccaagatgcccatagagagcagagctgttctggtttaaacccctgctcttagcactgtgtttttccagctgtgggtggtgggggatgagtatctttttatttccatgagatgagaaaaatgaattactagaagtgtgaaatacaaaacacagctgctctttttttagccatagactcagcagccataaaattgctgtatccagttgcagaaattcctgctgcttactcttgaccctctctcggtttgtgtgcatctcctctcaggctggctcccagatgggagctggctccaggcgacactgggtgctctgctccaggaggtccttatgtgggtcctgccctagcctagcccctctcttatggactctgtcactgtgggtttatgattcactctcaatctgtcttacctcttggtgaactgttagagtcctgcctatactttggcgcttgtgggtgtgttgtggtacacatgatgtgttggtcacttcccagctcatcttgttctgagtcaccctagatttgggacattcattcgccaccagtaccgggcggtgtatggcctgagatttgggggggcttgtgctgctacaaattggggctgaatttgagttgacagtggaccttctttatgtctactgctcatatttgaattgcaaatactgcctcttctctttcagaggctcattaccctatagctgtattattgcaaagtgcacaattacagcttgagtgtaagtcacactgcgctggcaggacggcccactgagaaagggcacgtttcctgttcgttagttttcacattgacacataatttacaatacagtaaaatgtacttttctatcaactgtagtcagtaacagcccccctcccccaaccacatcaagatatagaggagtgctgtcacttcaaacagttccctcttcctctgccacatcctgcccctccccaggtctaaccaccaatccgtgctctgtccctctgttcagcccattgcagaaggccatagaaatagaatctataggctaggtgtggtggctcatgcctgtaatcccagtattttgagaggctgaagtgggaggatgacttgaggctgggagttcaagactagcctgggctgcctagcaagaccccatctccagaaaaaaaaaatttaaaaattacaatcacgtccctgtagttcagctgcttgggaggctgaggcaggaggatcacttgagctcaggagttagaggttacagtgagctatgatcgtgccactgtgctccagcctaggtgacacagcaagacgttgtctctggggaaaaaagaaagaaacggaaccacgcggtgtgcagccttctgagtctggcccctttcggtgagcagtgtctaaagttctgtcgcgtgttgcccacgcgtcggtggctcgctccttgcaactgctgagcattgtatggctaggctgtagtttgttttcacttcaccagttgggaaacagagaaaaggcactttttaaaaagtttaaatctgtagaattttggtttttaccagttctcttctaaatcctgagggattacaggaaaagttgttgtatttcagaatattcttagcttgatgtgacctctgtccccgttaaggccctttgccgcaatgggaaggacgtcgctcggtcagaccctgaaggtcagaggggcagtttgggagtgtgtcaacattttaactgtatggactagagccaagagtctcaaggtttataattcccacgtattcaaaaagaaaaaaacaataaagtgagaagtcagtgtagagtgaaataacctgtgttagtggggaagaagtgtttttaaacaggatttccataacgtataacatcaacatgtttagagtggtgatgtttcattgggaaacgaacagtaaaacatgaaagcagggaggttttcattctggcagttggcaactttcacggcagatggagaatttcaaaagcaattgctcaattatcaaacatagccagtgtgagttctgaaataaaggtgctgattgaatgtgcagctttatggtggattttgctattcaggcaagcattttaattttctgcctgttaaattctgttttctttagtttttcatatgtggtttattgtagcttaggaatagataactgagagtatatattacacatacaacattctgatatggcaatatttaaaacaacttgtctgttttagaactagaattaaacataatcatcttcagtattttgcaaataagctcactgccatccagaaacattgtcaatgcatctgttgctccttctagaagacacagtctgtccagcacaaagttacttagtccccagatgtctggagaagaggaggattctgacttggcagccaaacttggaatgtgcaatagagaaatagtacgaagaggggctctcattctcttctgtgattatgtcgtaagtttgaaatgcctgtaaacggggttgagggaggtggggaccaggagaacatcctgtgtagatgacacttgcatggaccctctggaacccagaccgcccggtgtcctgccaagctccatcgaaactaaatctagaatgaatgtttacttctgctgtgacatataattggagaccaggcctggccttccagtcactggattctaagttggactgtgagagtttttgcagctgactcatttatcaaatgcccggctattggctcacgcctacatgatgctgggtatgtttgttaatttgagggaagcaatggaataataataactaatgatttaaaaaacaaagtaagtgcattgactgtagtggggttctgattttaaatttttttaaaaattaataccaggagcagtggcttatgcctaaattccagcaactcgagaggctgaggtaggaagatcacttgagcccaggagtttgagacaagcctgggctatggtgtgagacacccatctctaaaaaaataaaaaataaaaaattatccaagtgtggtggctcgtgcctgtaatcacagctctttgagaagctgagggcggaggatggcttgagcctgggagttcgagaccagcctggcaacacagagaaaccctgcctctaccaaaaaaagaaagagaggaagaaagaaaaattagcctggcgtggtggtgcatgcctgtggtcccagccacctgagagactgagaagggaggattgcttgagcccagaagtttgaggctgcagtgagctgtgactgtgtcactgcactccggcctgggtgacaaggcgagacccctgctctaaaataatttttttaagttaatttgtagaaaaggtgttagatgttctttgtcacattttatgatggattcctgtttaaatgccgttctctttaaagaaaaaaaaataacttgtgggagtttttaaccataaaactagcatcacatatttaccatggagaatttacaaaaaaacaaataaacggaggaaaataaaacctcctgtaatcatactactcagagataacttgctgttagattttggtctagatttaatactttttctatatttatattaaaaatatttaaaacatatgcatttctttgtcacaaacatggtatcttatagatactactgtcacatagcaaaacagtgttaaatattctgaatcagaaaaggaagccgactctccaactgaaagaggtgttatcctagagactttttctggtgatgacaatttattaatagtcactttttgctttactttctctattgaagtagtttttctattttgttctacttttaaggataatataatttataatgctgtttttcacagaaatataagaaaaaagatactaattttataagttaataaagtttgatcatcccaaatccaaaaatctgaaatccaaaatgctccaaattctgaagctttttgagtgctgacattatgttcaaaggaaatgttcattggaaggtttcagattttcggatttagggagctcaacaaataagtataatgcacatatttcaaaacctgaaaaaaatcctaaattcagaatacttctgatcccaaacatttcagataagggttattcaacctgtactgtcagatgatcccaaatgaaaaatattaatcgttaaccaaatatcaaggaattgatcacattttacagtttctgcctaggattatgaatcaagatgaaaaggctctgcatgtttaaaaatatatatttttattttcttataaatcttaaatatctacacttaagatttatttgatatgtgggatccattcatattttggattcaacagttctgtcaaaactgtggcagtgataggggattctttttttcccactgaactatcacaaaattggaaaaagagtaattggagaaccccactggcttagccggcccgaagcccgggagagggcaggcagtgctgtggatggggtcatcccagcgcaacgctgcccctgctacctgcggatctcgctgaggcctgcctttgtcctttgacccttggccatttgttagtgtctctgagagctggactgctgtaccctacttccccagggggcctaacttcacacagcctctgccgcagtgcgtggttggaggtgacggccttggtaaatcgagtttcctacctcctcaattatttgtgctcatacactgtatatttttagtgaggtttatatttgggatgtgttttctccttcttaccctttctggcctttctatggcattaatacctggtctcttcttgtgtacttgaaaatgaatctctcatcatatttttccttagtgtcagaacctccatgactccgagcacttaacgtggctcattgtaaatcacattcaagatctgatcagcctttcccacgagcctccagtacaggacttcatcagtgccgttcatcggaactctgctgccagcggcctgttcatccaggcaattcagtctcgttgtgaaaacctttcaactgtacgtcttcatcctgccgactattgccagttgcagttttccctgccttaaaaatggagtattgaaatttttaactttaatttctgatttgcaaaatagtcatcttttgttcttttccttcttgctgttagccaaccatgctgaagaaaactcttcagtgcttggaggggatccatctcagccagtcgggagctgtgctcacgctgtatgtggacaggcttctgtgcacccctttccgtgtgctggctcgcatggtcgacatccttgcttgtcgccgggtagaaatgcttctggctgcaaatttacaggtattgggaagagaaaccctgatattgatttatattgaaaatttagcaggccaagcaaaacaggtggctggctttttcctccgtaagtatggtcttgacatggtcaccgatagaaacatggaaacatctgcaaacttgccgttactcgtgtgtccgatctgactgtttcttgtatttttttctagtctgcccttactaggatgaactgtacacatcagttcatcctttttaaatgagcatgaggttattttgggttgttaggtgttacaaacacactaatgtgtttttgtctattagagcagcatggcccagttgccaatggaagaactcaacagaatccaggaataccttcagagcagcgggctcgctcagaggtaatgctggaaacacaggtcgtccttgtgttaggacaacccaggatataaaggatatagatttgtacgggaataaattcacaggacaagaaatcgatgtgccttataggtgggtttactgcagaagtgccataatagaaccttcctacttttaaaacaaccagatctcactttctaaagagtaaaggatgaccggcaggatcacgtctgtgacgtgagtggaggcagtttgcactcctggtggctgtttgagaggtagcatttagaatgcctgtattcactgtcctgtgatgagtgggaaaataggttatcaggtttatcttagcaaaatcaaagcatgtcatctaattgctaaacaagagttggcaaatctgagagacattactcaatccttggcatgcaggacttacatctgcatcctgttgccattttatgtcttcaaagcatttaatcatttagttgtgtttgcaaagtctttgagaagcctttgtcagaaatccctacatctcctatgtgagtgtatttccatgactgcagaataagttaaacttttacctttttccttcccttgcggggcggggtggggggcagggattgtgtgtgtgagagggagagagagacagcagagaaggagaatataattatcatgctgtgtactttgagctgaaactgcaaaaaaggaaaaacacacaaaaattattatgcttttcagtctttagagtaccttgtctattatgcttttcagtctttagagtaccttgttgatggtgtttttaaatgggattgggcacaattaggtggacagtttgggatgatttttcagtctgtagggccaagctcttttgtaatttgcattatgaagttgtcactctcatagcagatggcgggagataaactattattactttttgaccctagacttagtcttcagtccagatgagggagattaaaagattataaatatcttgtgccagatgaggtgattttattttgaaatgaccatgaattcctatcagttgtcttactgggatatttgatagtggaatttgtgcatttgagtcttagatgatctgttttacatttattaagaaagcctttattagcttttatactgtgtattgcctgttgcagtgtttgagtataaatgaaatttctggaaaatattaatggagtacaaactgtgatacttaaaagtaaactagggcctgcatttgtatcatgacctgtttgagtattgatgagaagatagctgtgaagaaaaaggtttaaacaagtgtattttcctttaagaagccactaatagtgcatctccttagagtgtatatttctagaatcctagtgtgcagagtttagactaagactaaaaaaaaaaaaaaacaaattatactgtaatttcatttttatttgtattttagacaccaaaggctctattccctgctggacaggtttcgtctctccaccatgcaagactcacttagtccctctcctccagtctcttcccacccgctggacggggatgggcacgtgtcactggaaacagtgagtccggacaaagtaagtgtccagcgtgtctgcatgggaggcacagggcgctgagtgcctctgtcacctgtggcagatacagagagtgcagaggaggtgccgtggacccaaggagttctggcgctcggctcggctcagtgaagctgtggttagagacgtggggggccatcaaggtctgagggagccaagcagtgctgatgtgggacccttttggtaggagtgtggggtgagtagttagtgggtgaatcaaggaatagtcggccgtggcctgcaggcccctgactgcacaggccttcaagcacatgtcaatgccgttagcctccctccatctcctcataccttctggccacctgtgagttgcactgccactgccagccattctggtatgttgtcagcacctccactgctcatacctcatggttagggaccacctggagccttggtagagccttggtagagccttggtactctactttcctggacaaagttcagcttatgaatatgaatttagatttcaaaaaccagcagcccaagtataagaaagcgaaggttcagtcctgccttcttaggctctattcgctaagcacctgccctgccctggttgctggggagagatgagtaaagcagacaacccaggagaggatggcaaaggggccgctaacccttagtggtttagctatatttggaaggcctattggaagttcaccaggtgaagggggaggctgtgagggtgcccaggcaggtaacagaagtccaaaggggaaaacctgtggtgtggtgagccgtatagccacagcctgccggccggcagccctctcagcctagtgcggtgttcccaagcactggcctaggcctgtagctccagggatgtgaagtccccttgaacgccgcccatcatgttccccttatccatttttttcttcccaggactggtacgttcatcttgtcaaatcccagtgttggaccaggtcagattctgcactgctggaaggtgcagagctggtgaatcggattcctgctgaagatatgaatgccttcatgatgaactcggtacggggggagcagtggaggcaaggaatcctcagcttttcttgtgacttccaagtgggatttgtctcatcatcatgtgacccacttgttgacaacacatgttggggactccagtctgggcagggacgggatgtcggagagactccactctgaatggggccgggaagtggggaggactccatttcagatggggtcgggacatgggggttatgctgatcgagacagaaaagcacattgtttcagccacattagaatccacggaggtgttgttttgaaatccagctggccccaaggctgggtgtatggtttgggatgagaactatctggcctccactggaggaacaaacacaggatgttatcatctaagctccatggccaagacagaatggaagtcaaggttgcgtatttgccgtagacttcaacacagtgtcgtaatgcgtgacgtcaataacttgtttctagtgtcttggaagttgatctttagtcgtaaaagagacccttggatgcagcgagatttcctctactcacacctctgttagatgtagtgaggttcttcaccccccaaccccagatgtcagagggcaccctgcgcagagctaggaggccatgcaaagccttggtgtccctgtccctcacccgtgggcaggtcctgtgagcagtgggggggccacctcttgggtatggtgcagccatggcccaagcagggcttcttctcagacctactaggacgggagaaacctcctggtgctttagccctgcgttgatatgcagcaaatgggagggaagtgggcacctgggaggacaaatgcctgtagaggccgggagtgacggcaggtgttcatgaaaagagaccttgtggggagggcaacacaacagtgtgttctgatgtactgaagagctcaactgaaaacaacaggagaattagcccaaaatccatttactaaaattgtttatctttttttttttttttgagacaaagtctcgctgttgtcccccaggctggagtgcaatggcgctatcttggctcactgcaacctccgcctcctgggttcatacgattctcctgcctcagcctcccaaatagctggtattaacaggcatgcaccaccacgcccggctaatttttgtatttttagtagagacgggatttcaccatgttggccaggctggtctcaaactcctgacctcaggtgatccgcccacctcggcctcccaaagtgctgggattataggcctgagccaccacgcccggcctaaaattgtttatcttaagattcatgcagtgaaagctaacttactgagtgataaatttgcttagtgatctgtttattaggttttccaaatttgctaattgggctttgaacagctgtaaaagttctgactgtaaaagaaagcttcaacttttggcattcatgatgcttttctgagtattaaactaagatagatgttttacctgaaggatcggccaccaatctttaaatggctaaacaaaagggttgctaaaacataatccaaattgacataagaaataccatttttccaaccaaaattttggcattcatatggctacttttacgtatttcagctgcatttgaacatctttttcaaactttagggtggttggtgtatcactgaggtcttggatgacactttagctttgattttgtttttatgaattaaaattgtcataccaaaatttttatttcaagcaaatccaagagcataaaaaattaaaatattacttaaaatactaagagagaacagatatatattttactaagcatatgttgaatgaaattgttcaaatatttataacaggcatagagtagaattttcttaaaaatatttttgatggtataccaatttgtattttctcagaaacatttgccttattcttttttctgttgtgtttttcttacctgattgaaagctcataatctgttgttattgtttgttaacctttaatgctctgatttcaggagttcaacctaagcctgctagctccatgcttaagcctagggatgagtgaaatttctggtggccagaagagtgccctttttgaagcagcccgtgaggtgactctggcccgtgtgagcggcaccgtgcagcagctccctgctgtccatcatgtcttccagcccgagctgcctgcagagccggcggcctactggagcaagttgaatgatctgtttggtaattaaaattaaaatttatcttatttttaaaaagcattccagggccagtatagtactttgcaccaagtaaatgtacaataaaggcagtggatctaatacattgaaagcgtttacagaggtagctaaagagcagcacgggtgtcctcggctcagaatttcttcctgtgtgtttgccactttgccattcattgacatggtcatggacatagggctctaagcccttgaggaaggctgggccagacctcaggggagatgcagccccaaaccacgtgcagtcctgtggacggatgtgtagatgtgccactgaggaacaatgtcttgagctttcatcagattctcagagaattgcttgactgcctttcgaagttgatgcatctgtgctcacgtttgcacccacccacgaggtccttctgtttcaggggatgctgcactgtatcagtccctgcccactctggcccgggccctggcacagtacctggtggtggtctccaaactgcccagtcatttgcaccttcctcctgagaaagagaaggacattgtgaaattcgtggtggcaacccttgaggtaagaggcagctcgggagctcagtgttgctgtggggagggggcatggggctgacactgaagagggtaaagcagttttatttgaaaagcaagatctctgaccagtccagtcacttttccatctcagcctggcagtaagtcttgtcaccgtcaagttattgtagccatccttcaccctcacctcgccactcctcatggtggcctgtgaggtcagccaggtccccttctcatctgcacctaccatgttaggtggatcctaattttagagacatgaaaaataatcatctggaagtactttatgtcttaagttggcctggacatgtcagccaaggaatacttacttggtttgtgttagtgcttgtaattcgcccccagaatgtgtacacgttctggatgcattaaagtctggcctgtatccttaaagggccatcgctgtgctgcctgccctcagcaaggacacactttgcagacccacagaggctccgcctccacctcacaccaaagaaagggaggagtccaaagggcatcagtgccattactcacaaaatgataaatacacccttattctgaaccacgtggagtcatatggtttgtgatccctgtccttcaggtttcagcttagtggggaagtgggaaagtcagcgtgtgatcacagcacagggtgattgctgctgattatattatgtgcctgctgtatgcaggatgaaatactttatatgcgtcatcttatttgactctcacaaccccctgtgagataggctctgttactcccatttgacaggtgaggaaagcaaggcttagagaatttcagtgacttgcccaggtcctctgagctaggaagtagccattctggcatttgaacccaaggcctgctatccctagaacccacgctctcaaattcaacctatgacagaggcaagccctggtgctgtgggagccccaaggaagagcctctggcctggtggccacgtagcccaggagagatttctacaggagcccacagcgctgaaggagagagaggcagcagagtaagggggctttgtggcagagaggggactggcactttggggaataggtgggtcaggactgaatgtaatggagccatgtcagagctgtccttctggaagggcaagggcacctggacgcgctgcccctcagtgctttggacggttccacaactgtgattcacacggcttccccaaacgaaggtacacgagtgggcattctgtgactcggtacttccctttaggccctgtcctggcatttgatccatgagcagatcccgctgagtctggatctccaggcagggctggactgctgctgcctggccctgcagctgcctggcctctggagcgtggtctcctccacagagtttgtgacccacgcctgctccctcatctactgtgtgcacttcatcctggaggccggtgagtccccgtccatgaacggtgggttcctatcatagttcctgtctgcttcaccatgtttttattttgtgctgcctgtttgccaggtactaagctaggaattggggatggagaggtagataaaatatgcatcaggaagggctgggccccatctcttactctccaatatattggagtctacactggaatttaactggaatttgcttttttagtcattttatttagattttgaagtttcagctttcatcaaaaatacctctaaactttatgtctctgtgatctttggtcttagctgttttatgtatttagtcttatatgatcataagattaataacattacattcagaagattatttgttttctgtcagagttaaaatgtttgtttttatactgcattgtaatattaacgtactgtaaaataaaagtggcttgttcttttcaaggaacagtatcctcaacaagggtcattagccacaatttttaaaaaattggacgtcatagtttacatgttagagggcgttttgaagctttgtatttttaaattaaatgttatagagtgatgttttcatgtttcataattgttttcatctgtgcatttgtagccaacttgaaaacaaagatccagggattactacttaaaagccagacttcttggaggttatagtgatgattttgatagtatcttgagccgtctcataataacctcagggtgagagatggccaacaggagacagtcgagggacttagaaatctgaatgaaatctgaagttcaaatcttcagacatataccactaaccaagagattggtacctcagtctagtattgtctgtttgtctaaaattggttctaaggaatctaggctagtctgtctatccctttcaacttttgtgaggctgcacaaatgtaaaatgttgaataaaaagcactgatggaagtgtgtagaaattcttctctttgttctgttgtaattttagttgcagtgcagcctggagagcagcttcttagtccagaaagaaggacaaataccccaaaagccatcagcgaggaggaggaggaagtagatccaaacacacagagtaagtctcaggacccatttttttcttacatgttgttcctccaggacttaaaaatcattcacagagacgtgcaccgcggtgagtgtggactcctggaagcgcaccgtagctccgctgtgtcctgctgctcctccctagctgtcagggaggctgtagtccattgctttgccagctcttttgtttccgagtgaacaccttatccgtacacatgcggctgtctctgaccctacagaccagctgggatgccactgggggagcgctcccttccccccgcacttcccacactctgcagttattctgagatccttgagggcagggaacaggtttgtcttctttgtgttctcagaaattaatgctcggcctctggtcagcaagcaacaaccttttgttgagtgataatgaataaataaatgtttcccacatgagtattcagtaacctcagtgtcaggttcagccatctgttttggtggatatttaaaagaaaattccgcttttcctacagaaaaaaaaaaaaatccaaatcccagtgatttaagccagttatagacttagacatatactacggcttttcatgcactttcctcccaattctagagtaggtattttactaggaaaatggtggcagtgcctgttgggaggaagattctttggccaagtgtcttttgttcttgccagggcccctaggctgctggggtgcttcagcttctttagcccagtgtctggtggggaatggcccctgttgcctgtcccacagaggtgggggtgcctcacctggagcctgtccacacattttacacagcacgcttacctggagcatcaggcatcttttccatgctctgtggctcaggaaacacgccttttcaatcatgagtgcaccagtgcttttgggctttttctccccgcttttgtgcaatcctggttgtggatggagttttcctgtctttagtcttctgcatagtacttttctcttctggttcccggttcaaggttttgtaattagagaatgacccagaagcaatggcattttaatgcacagccaaggacttctctgaatttgtatctcaaacctctgtgggtccttcaggcttcagtttgtgatttcatgatttcttgttgctacctaaggaatatgaaaacacccacctccctactctgcatcttccagccgagtggcacctcaggctgtggatcctgtgcttctgtggtgaggataagaatagtgccaaccgtgtggattgaaatcaatcagttaatccctccatgtaaagcacctggaacggatgacagtcttgttatgaatactcaacaaatgctatcatgatttttagttagatttccattgctttaaaacagttgagacatcttggcggtttgagttagagcaacgggccctgaagtgggttctgtttgggtgaagatgattatgcttattccccatggccctctttaggcaagagtgggaagctttctttgtttttttaatcacctcgataggacgttacttcttaaaggtcatccaataaatattaataggccgggcgcggtggctcacgcctgtaatcccagcactttgggaggccgaggcgggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcaagactccgtctcaaaaaaaaaaaaaaatattaataaagccaactcgttagcgtggggcttaattgcttaagtccaatgagaagtccttctctatcctaggaagttgcccaaactgtagaatctcgtggcctgtgggtaatagccacgtaatacacactcactgcctcaacaaatcatattttagtaggtatgatattctagactcaagacaccattctgtggatcttcccaagggtgtgaagtgtccacagcgtctgccttgggagtttccatgcccaccagaaccatgccccaagcccctcaagcactctgacctaggaaagccagtgaagcaaggatgacaacatggccctttgatactagctgagggacagacacaggtcctgggagaccagagaaagacgaggggcagaggaggtgtcctaaaggaagtctgaggctgaggagccacaggatggcttccagctgtcacaggctgctgctggccttatcacagagagtgggccagagggctgggaaccaaggccagagctcaggttcaggaccattccagcaatcccagcagaaaatggggagaattgtatggtataggcggatatgaaggtagaatctgcaggccttcagtggccaactcagagtctaagtggattccacagttacagcttgagcagctggttgtaggtcatgctttctacactgggcatataggatgtgttttttaaaaagtcctctcttaaccgttgcttgtttagatcctaagtatatcactgcagcctgtgagatggtggcagaaatggtggagtctctgcagtcggtgttggccttgggtcataaaaggaatagcggcgtgccggcgtttctcacgccattgctaaggaacatcatcatcagcctggcccgcctgccccttgtcaacagctacacacgtgtgcccccactggtgagtctgctcgttccttgcagaagaccaagtacggtgaaaggcaccggtaggccctgggctgggcacacgtgagagggcgggacagaatccccgcagcccagaggctgcctgctgtggttctggtgcccactgtggttctggtgccaggctgctttcctcaggcaccacgtgtggaggtcgctagtagaaatactgggttttctaaaatgaactgaggccctacatccctaagagattagtgttagacctgattctagagcaactagaccactttgcttaatagcagaccagaaaccacaccccctcgagtgagtgagattttcctttggagataattcatgtttttctacacagttttgcagttgtcttcagaattggtttaaagtaggtgttattgccaggcgcagtagctcatgcctgtaatcccagcactttgggaagccaaggtgggcggatcacttgaggtcaggatttcgagaccagcctggccaacatggtgaaaccccatctctactaaaaatataaaaattagccaggtgtggtggtgtacgcctgtaatcccagctactcaggagactgagacaggagaatcgcttgaacccaggaggcgaaggttgcagtaagccgagatcgcgccactgcactctagcctgggcaacagagcaagactccgtctcaaaaaaaaaaaaggtaggtgttattgatcagaacccttgtttcagataacatgaggagcttagcttgaggagagtgagggttgatggagggggactgacttctgcccagtgaaatggcatcatctcccaccagcccgctgaaataagatgatggggcctgttccttagggcctgcagcatcctcaggcaggaaagaaaggccgacctggcagggtgtgagccagcaggtgtaggtcagggagaatggagccaggtcccagggaagaggcttgtggctgcctgagaagggtgcgtgcctgcctgtgtgtgtgtgtgcacgtgtgtgtatgtatgctggagagtctagggaggcttgctccaaggacgcagtattgtttgatcctgagagataaggattctgccgcagggaatgaaggtattccagatggcgggcttattccgaagaagaggccagtgcctggcggtgctggaagcagttgcagaacagggagttgtaggctttcctgggaagagagcagcaggggtgctggagaagcaggccacacttgctgcatggggttgctctcggccccactcttggtgcacagcgagtcactgtgggttcattagcatctggttatgagacagtaactgctcctttggaggggctcgtggagaccatgcaggagggcacggtcttgaggtcatgccgtccagagcacacctgaggataggccaggacgggctgcacgctgtaggtaaaattcctccagcaagctcttcactggcattgaggagttccctgagtgcggtcatctggaaggcagctgtaacaggcactgcagtctctccctgggtgggtaccagagaggagcataggggagcataaccgatttaaagagagggctttcctgtggtgaggtaagagattagctggtcattatcatagagccccctctgcctttgtgcagatgggctgtgggaatcctggggttccgttgggtcctttgtcacctcactgaaggcatgtaagctgagctggccagaccgtgagctgatcctgccacttgaacagcatcaagcctgcctctggattcttctgtgcatggcacttgtctgagcacctcacgcacagagaactggacttcagagtttacagaaataagctgtatggttcattttcatgcctgcttgccaataaacatatctgagctgaacctcattgaacgcctgcctttattctagcacagcacctgctgtttgtgggcgaggggtgctgtctctaactcctgcctgcttctcccagcactccctgagtggggtgtgccagcagcctcaggatgaggacaggaagtgggagggcagagcagatttgggagggccacttgatggggaaggaagtcccaggaagcagttggagctgttttctgggggagaaggtgccagctctgggacagtgttggggtagtgaggagggagcccagtggagagaagtcgggcttcctgcttcctcacagtatgtctgtcctgactcaactcggatgatgtcacttccttttcatcttctcaggtgtggaagcttggatggtcacccaaaccgggaggggattttggcacagcattccctgagatccccgtggagttcctccaggaaaaggaagtctttaaggagttcatctaccgcatcaacacactaggtactcttggggcctctccttcaggtcaccattgtcggacatctaccgggaggaaatccagagcccccagtactgggatcttctcatttgactccagaaaagatttaagcatgataataatacaaacctatgtgaatacattttgcagtgttggcaaaactccttttatactgagaaaatagatcccagttcctgtgttttgtggcttgaatcccagctttgtgtattccgggcttgtttgaagtcaggaaaggttcatgtgtagtggacaacgtgagaccaaattctgccttagattttgcatttaggctaaacagtggcagcacttgtctcagaatgttttcttgtgttcaccagtctgatcctgttgtgtctcagtggtccattttctcatatgggaacaagcagacgggagcagatggagtcaggtttcttggcactcgccttccccagagcctagaggcagcatggggagaaagcaggcttggggctcagacagtcctggtctgcttccagccctcctacctgagcagcgcagggcaagtccgtctaacctctagagaccctcagttttgtcatatgtaaaatgggggtcgtgtctatttcatagaattgttgcagatttagaaattacatttctaaacaaatgttaccccttatttctaaataagtgtctaaatgaataagtcaccacttttgcccctatttgatggcaagaggtgtgatcttgtggtgggactgtaatcagtcagttctcagtgactgtgccctgctgtggtgtttcctggaatgttcctgtcttgtcctagaaagtctggcaggggcaccctgactccactgtccagtcctctccccagtccctcgggcttctgcagatttgaggcttgtttggatcccagaaggttgtggcaggagacaccttgcctctactttcccctttataattcaatgtccaaagagagccctgagcaggtacctcacgccagctgcctcacggagctcctcctcttcctggctgtgaggatcggtatcagtggcctcctgctctctcccccttgcctaacacgagcacctttgcttacttgggtgcccttgctcttgaactgcccatcggacgtgcgtgacccaagactgtgccgcagtccttgccttgtctgtgctcattttctttgttcatttttttccctgtaacgtaaattgttatatttgtctgtatctgtgtctgaatcagtcctgcacgctctccttctctctgtctcttgttctttctttaccccgtttatcacggggaccccgatgtccattgctctagttctcctgtcctaagcaccccatcccgtctctctggccttaccacaagtggcgtggctgcctcagacatcatgatggggacatgaagcacagctgtcagaaacaactgttcgttagatacactcgaatgcagctcatcaatagggatggagggtctgtcggatgtattttcactgaatccccgttcctaccttgatacactctttttaatctattcttctagacaggtcagaggaaccattactttgacttttaaatttttagcagctttattgaggtagaattcacatactacagatttcacccactctaagcggacagcttggtggccattagttttatccacagagttgtgcagccagctgcacagtctcagggctggactccagggaagattttagcccatttagtgagtggggcagaagtggccctggccctgcacgaggttgcctgcatgggcgtccctgccctgtccctgtgtctgctccactgggggttgaccaggctgccagggccgacttgggcctgtgccacctgcctctcatgtgtctcggacagtgcagccgatgtctatacttcggtttcctcaatgatgaaatggaggggatagtgttccccgcatcatagaactgtgtgaggtttaagggactcactgcccttggcgtggagccttctccaggggccgtgctgtgtcggcgtagctgtcagctctccgttacaggcttgagaagggttgacactctctcatgtaacatttatatttctaggctggaccagtcgtactcagtttgaagaaacttgggccaccctccttggtgtcctggtgacgcagcccctcgtgatggagcaggaggagagcccaccagaagtaaggccacaccctgtgctggttggcacatgggcagttatggccgcttgcaggcctttggtggggaataaaataaggcagcaagctggtgttctttttttctcttaccttatttttgaaagagtagctgaatggtgtcttgactgatattccagagcagggacaaagcctgctgaggtctgggggctgcgattaccaatggctggaatgcattttattacggtgcattccatgttaaggatcaatacgattgtgccctttctggaaaatatcttttagtttatcaatattcagaggagtgtaggttgaattaaaatgaaaaggcactttataaaggccatgagtagtacctggtttcatttttctaatgtcttgcagagattttatcaggcttcttgaagtgttcacgtacattacgctaacacgatattaataataactgtgctctggtacagcggagccagcagaatgggaagttgtggaatgcaggcccttgattctgatagaaggtgtggtttgaactcacagaaatgacagtttggagggtagacatatgtcacaagtcatcaagattgtctttaaattcatgcatagaagctaacagggtgtcataagcaaggcctgtaaaatgtatgagggaattcaaagataatttattaaaaagtaattcatgtttggagttttgtgcccaaaggagtccttgatttgaaaaatgggcttttgcccatcagattgtttcagggcccgtgtgtgcggaggccctgccttgtgccccgtgagctcagcctgacagaaatcctttggtagcacttaaggctcctcttcctcccattgaggcagggaagactctgggttctgcaggcagaggtggttgtgggtgtcttgctgctcttgttgacatgtgggctctccttccaggaagacacagagaggacccagatcaacgtcctggccgtgcaggccatcacctcactggtgctcagtgcaatgactgtgcctgtggccggcaacccagctgtaagctgcttggagcagcagccccggaacaagcctctgaaagctctcgacaccaggtttgcttgagttcccacgtgtctctgggacatagcaggtgctggggacagtgggttccccgctgaagcgtccagcagcttcaaccaggccgttttccttcattgctagaattgaaaacaccgtccgtgtggcctgtgcaggagatgcagacccaaaggtggcctcctggtcagtgagaagctggaaacgtgacaggaactgacgtggggttattgagcatttaggggaagacgttagcagagcaggaatgagcaggcaactagtagaacacccacttaagggctcacggacaggtgctcacttaggaagtgagtttcatttggtattacaccaggttcctttaggcaaagcggagggaaagttctggtgtttttcacttgtaagattttgaaggaaacaaaacactctttaccttttttctaaaatgtaggtttgggaggaagctgagcattatcagagggattgtggagcaagagattcaagcaatggtttcaaagagagagaatattgccacccatcatttatatcaggcatgggatcctgtcccttctctgtctccggctactacaggtacctgagggaaagggtgcgggggagcggttgtacttgggctagaatgagagaagactggcatgctcaccacaccagtgatgcgggaagacctgagtgtggtctgagttggaggctgtggtgctaaatacgctgcccctttcataagcaggagtcttagtcaggcccagggaggaagtaaaatctggaaatgaatgagaagcattctctcctgccagtcaagaaatgagaagcgaaagaattctcacgggctgtaagaccagcaggatttaaaagttgaattagttgcttatgttaagaactcaaccaagttcatctacacaagctgaatctccagcttttcctaagaaaccatgtgtggcagtggctgcagggcagggcacagctgggcctgagcaccccgctccctgcacctctcccctccctgggccctgcctgtcactgcccactctcccaccaagccttccggttgtgtgcctgccctatcacaggcatcggagcttgtcacctggtttaaaagaagagagttgtgtggggatttgggatgcacgtttttcactcaaaagtattttagcgtagagctctgtgattccgtagctatttaggagtttaagcaccttgaaggctttaattgcagaaagttctatgtggacgtgcaatgtgttatacgcagtgtctatgagactcaaatgtttattagggcgttgaagtaaactgagcacttggagggccatggatccagccttcaaggagctcataagtcaggaggacccaggagcaatgacctgtcatagaaggcagaaaagaggggcacagaggtgggtgggaggcatacacaggcagctcctggagctccaaggggagcaagtgcttccagggaagggggcgtggaggcccctttggaggaggcaagttgatctggggtctggcagagggttagctggggacatttagcgggaggctggtgcccgggaattggggggatgcccagcagaaagacatgaggaggctggcctggggcgtgggggggtgtgaaaggttaagtgggggcattatcctgctcccgctcctgccggctgtatctggtcagcctgggcaccgaggtggggttctggaaggcactgttcaccaaaatgcttatctgggtcccccagagagcttgcctgcctggactgtcggctcgcctgcaactgctgactcctaagcttttgcagctcagcccacaaccagttcctattcacagaggtgggagctgaggggtgacaagtgactgctgcagtcttatttgtcatagagaaaaagtgacagagtccagcttgcccactggccctgccagcttaactggttataaagtgacaaatccccaagacccacagggctctgcacaacctgggccctcctgccagtggcggcgagggcaggtggctcacggctgggtgcctgtctgggcaggagctgggctggtatggggtgggcctgcggccctgcccccctgtgcagatcaagactcagggtgctggtgttcacaggtgccctcatcagccacgagaagctgctgctacagatcaaccccgagcgggagctggggagcatgagctacaaactcggccaggtcagtctcgcgcccccgccgcctggcctctgtccgtttctgtcctcagactttggcgcttgacacacccaggagaaaagctcagtgcactttttaaatgaaaggaagttttccttttttttaaaaaaaaatttaatgttcattgtttttatctgttttattcctaggtcccgcaagcagaggaagcattagttttgtttttatttatgttctgtattccagaaagtagttaagagacctcacatgtagcgatagagatgtgtgtaagagacagtgagagggcgtgacttggacttaagcaaggaccgtgagacacaaaaaggggggtgaggacagagtggagtcagctgaaatgctcaggaggaagtagacgccatgaagggccatggtatggggggccgcaggcgtggccgtgagtgtccctggggccagctcttggggggctccctgagtgtccctgtccctgtggccagttctgggtgggagccccgtgtgcaggcagacagctcggccacttcctagcaggtcacattggtctgtgcttctgtttcctcctcagataagtgaagggattcaagggtctgggtgtggtggctaacacctgtaatctataacattttaggaggctgaggcaggaggcttacctgagctcaggaggttgaggctgcagtgagccatgattgcaccactgcactccagcctgggcaacagaccagtactctgtcccttaaaaaaaaatgtaaacagaaacgtagggccatttgcatatgatggcacatggcgtggagccctacaggtgtatgctgggcggggcccggctgtgctggccgacttgcacctttccctccaccccggtgctgtgtctttcgctcaccgggttcctgatttagtgaaagcagttgtgcaggacagttctctttgtagcttttgtttctgtggaaatgggtcagaatatggtgtttagaaacacttatgagctctgagagtttcctcttctgagttcctggcctgcagccttcacagcagaaaccctgtgatgtcacaagcctgtttctgttccctgctctctgcctgtactgtcctgttttgtgcctgccggtttcagtgacaggaagcagggagctactggaccagcctgtatttttctagacatagttggaaaaagaagtcccactcttctgtcctttcacctttgacagatgtttccaccccaagataagtgaaaatgaccaataggatgcactgtatttttcatgaaagtgtttctgaagggcaggctgagagtgagaggcctggggctcactgggtgcctctggccttgtcctgggcccagggacactggtctgtgcccgaggtattccctatccccccaaccccgctgcatttggccacatccttcaatgtttgcgttgtgtccagcgtccgcaaaccaactgtcatgggatcatactggggctgaagtacggtcccacccctgccctgtctggggctgaagtacagtgccacccctgccctgtctggggctgaaggacagtgccacccctgccctgtctggggctgaagtacagtgccacccctgccctgtctggggctgaaggacagtgccaccccttccctgtctggggctgaaggacagtgccacccctgccctgtctggggctgaaggacagtgccacccctgccctgtctggggctgaaggacagtgccacccctgccctgtctggggctgaaggacagtgccacccctgccctgtctggggctgaaggacagtgccacccctgccctgtctggggctgaaggacagtgccacccctgccctgtctggggctgaaggacagtgccacccctgccctgtctggggctgaaggacagtgccacccctgccctgtctggggctgaaggacagtgccacccctgccctgtctggggctgaaggacagtgccacccctgccctgtctggggctgaaggacagtgccacccctgccctgtctggggctgaaggacagtgccacccctgccctgtctggggctgaaggacagtgccacccctgccctgtctggggctgaaggacagtgccacccctgccctgtctgggatgtttagcccctagatgccactggactgagccgctacttgcttttgggaaagaggggtgggggttaggggtctgggcgaggggagtgcaggggctcctccttggcctgagagctgttcatacagactcctcgcccactccctgcagggtgctgggtcccaggggggaaatggcccttggtgccaagaacgtgagttggggctagtgccagtgatgatggagaacagctttttatgggcacacagcccacagcactgtgccaagtgctcgaggcttcccgagaaccaggcagaaaggaggacagtcgaggtgtgctgactgcgtggtggctgcgtgatctagagcgcgggtcacaaaggcgcgagggagctctggccttgggtttaccgcaatgactgccagtgcgggagactggaaaaggaatctcacgtattggttccgtgttttggggactccattcagatgtcacttaggagtgaaagcatcccttcgtagagcctctttctgtgtcaccctcctcagctgctcctggggttgactggcccctgattcatgcctttagcatgtgctggagcttcccagcagctgtccagcccctgccccaccctctctgtgggctcccttgcccgtaacctggggtgtctgaacgacccttgctaaggggcagactgttagacggtaggcatgtgctgagtcccagtggccacacccacccaccaggagcctggcactgtggccgcagcactgagcagtgccccgtttctgtggcaggtgtccatacactccgtgtggctggggaacagcatcacacccctgagggaggaggaatgggacgaggaagaggaggaggaggccgacgcccctgcaccttcgtcaccacccacgtctccagtcaactccaggttttccaatggcctttttctttttaacagaaatttgaaatttcttatcagtcatttgatttgtttgaggtgcttcttgaaatgagcctctcatctcatgtacttggaaaatacccatctcgcatattccacaggaaacaccgggctggagttgacatccactcctgttcgcagtttttgcttgagttgtacagccgctggatcctgccgtccagctcagccaggaggaccccggccatcctgatcagtgaggtggtcagatccgtaagtgagccttcccattcccctcacacctgcacgtgccacacgcaccacacacgccacacaccccacacacacacaccgcccacacacatgccacttgcacacacacccctcatgcatgcaacacacacacaggccacacgcaccatagacaccacacacacatgccacatgcacacacatacacggcatgcaccatacacacaacacacacagcacacatgccacacacacacgccacaccacatgcaccacacacatgccacatgcacacacactccacatgcatgcaccacacacacacacacacaccacacacaccacatgcaccacaccacacaggttacatgcacacaacacacacatgccacgtgcacacaccccacacaccacatgtatgtgccacacacagcacacaaccacacacatgcaccacacacatgccacatgtgcatgcaccagacacatggcacacactacacacacgccacgtgcacacaccccacacacatgtacgcaccacacacatgccacacacacatgcaccacacacatgccacatgtacacacatgtatatacacaccccacaccacacacacaccacttgcacaccacgcacacacaccacatgcgcacacacacaccacatacgccacatgtacacaccatacacacaccatacatgcaccacgtgtaccacgcacccacacagacacagcacacgcatacaccacacacacacgcacacatgcgtcccgcacagtaatgtctcttgggtgtaagaacacgacttgccagtagtagcgttctggatgcgttgcctggattctaacagcgcgattctccccttgccctcctggttttccacatctccagcttctagtggtctcagacttgttcaccgagcgcaaccagtttgagctgatgtatgtgacgctgacagaactgcgaagggtgcacccttcagaagacgagatcctcgctcagtacctggtgcctgccacctgcaaggcagctgccgtccttgggatggtaagtgacaggtggcacagaggtttctgtgctgaagccacgggggcccatctgccttgggacctggtgttggccagaggtgccgggtgcggctgcctccttccaagagttgacccgaaccggactccacggcccacgtgagctgcagtgcttctcagatggagggggttcagcgacggtcagtgccattcacaggtcactgtgatgtgggttgtggcggccaagccatggtttggggtcccgtatccctgggcttatgacatcattgtagtagcccatccccacagaaccacggtgtgtggtggcgctgaggcatcgtagatggtggaaatgctactggcttccccatgctctgccctgaggcctgactgcctcactccccttctcagttatgttccaggccccccgagcttcctggctggacagcttctctcctgggggccgttttgtcacagtgaccctgtgtttctagtcccaaatctgggtgctatagtctctttttagcgtggtggttgtcttagtcttttttggctgctaccacaagttaccttagactgggtaatttataaacagtggaaatttacttctcaccgttctgggggctggaagttttcatggtcaaggtgccagcagatttggtgtgtgatgagggctgctctctgcttcatagatggcatcttctggctgggtcctcacggtggaaggagtgaacaagctccctcaggccttttagaagggccccaatccacaagggctctcccatcatgacctcatcacctcccaaggccccaccttcttgtactgtggcactgcaaattaggtgtcagtgtaggagtttcaggagggatagaaacattcagaccatcccagcggtcaagtgttcatcctcttgagttcctccttattctgcttctggtttatcaggattcagccagtgcagcatggtacctgtattctgtggcacatcaccacatggtatttgccaagtatccatcacctgcacacgtgaaatcattgcccgtgggtcccgacatctggcgaagcatattcaaggatggcagaactgtcagagctggcacctctggttccttgtcatgtggcattacctagtaatccattttatgatagcaatggaaactcatttcttcaacaaacacctgagtggctgccgtgtgccagccgtctggggcccttggtgagaatggcatggtggtgcccatcagggcctgcctagcccgtgctctggacgggctcctgtgtgtcaggaacgacaatgctgtcatgacggtgaatgatttttttttttgccatcactccagccgctaacatttgcggagctcttcctcccgcacccccacctgacaaggccaagggtgaccttggccccaccctaggcggccaaggtcagaggttagctggcttgtctgggtcacacaaaatgcagcagaggttgaggtgagcacatgtccgtgacctggagcctgactccctctctgcgagtcttgactgctcttgcctagactctgtcctccccgagcccaaacgccagtcatcttcccttgtgggtgtccttcagcctggtgccatgctggtgactcagcagccgtccagggagtggaaacaattgagtgtgtgggttccctgtgtgggcatctctcttcacggcgaacaccctctgggtgttgcccacacgatgtcaaagcggctcttggaaggggtccttctcctttgtgggaagtttcagctgctgggctaacttgaattgtaactgtggttttgtgctcaggcccagatccccctaggcaagtgttgtgccatcagtaatcaaatgagaaataatcattttgaaaagcagatcctaaggcaggatggtcatggacactcactcccagctctttgtgcactcatgctttctggaagatggccatcctctgtgaaggttttcagcgcgtcatgcttggtacccacgtatccagagcatgtcgttttgaggtatttgcccaccgttgtgaaatccgtgccacccgagagcaggtcctgatgtggggctttcagaagtgggacctggggccgtacgcagtccttagggaggggccgtgtggcgttgtgcgtgtgaggggatagcacagggtgaggtgggggcccaagaaggaagtgacccacaaagaacagcctcctcttttggtccttgttcctgggatggctgggagtggcttctgtgtcgtccggccatttcccctgcggagaggctcctaccactgccgagaacctcatcattccacaaaaacaagaggccgcctggccatccagcgctccatgggaattctgtgtccccatagtcttgggctgaaggagggtgacattccttgctgacttctgcaggggtctcctcactgttaaagagcagattgaaagtgaagaacgtgggctaagtgtttaggtcgatatttaaccctgctaggttttggatactaagtgaaattgaggccattttggttgaagttgacagaaaccactatcagggatccccaagactaccccaggcttttctagaaagactctcagctaagatgtgttatggtaaaagcacacaaaacaaaatcagcaaagaaaattagcaagggcagaggcccatggggcgatgtcccgaggacaccaggcttgagcttccagaatcctctcccagcggggtcgtgcaggacgcacttaactccccgcacagtgagccgtgacagcgcgtgtgcagtgtcgtcgccaggaaagcacactagagactcggtgccagggtttttactgggggctgggcacatgggcaccctctgcctgcctcgtgcccagactctggactcccggagggaaggcaagttctcagcaccaaccctggtgcccacacaagcagctgagcacagggagcccctcctcagtgaggatggtgggcaccgtcccaacaccagccaggggccagccttgcacacaggcctctcaggatggtctccggcctgctgtgtagtctcttctgcacacaagcgtgagggcagcgcccccgcctcggctgtggggaggagccactgggacgtgagctctggtggcatgcagcagcttttgtctgtgtgtgcctaggacaaggccgtggcggagcctgtcagccgcctgctggagagcacgctcaggagcagccacctgcccagcagggttggagccctgcacggcgtcctctatgtgctggagtgcgacctgctggacgacactgccaagcagctcatcccggtcatcagcgactatctcctctccaacctgaaagggatcgcccagtgagtgggagcctggctggggctggggcgggggtctcagaatgagctgtgaaggaagcagcatcaccctctccaagtgcccaggctcctggccagatggcaggccaggtatcagtgggaacccaggtgggtgccatggctgaggtcagtgagacgcaagagcacaggtgcgtcctagaggcttcctcgggcacctccagcgagctggagctctcgcctctgctgctgtctcatgtggcgcttagcacactctcccacgtgcccattcctgactctgctctcgaggccatcggctctcattctctgctcccagaaccctgttattacccaggctagcctcctctctgcaccttccccgccctggcccagtacctccctcttgtttccactgtgattccgacctcaccttatcttaaagctgctggacggcaggttctgtacacacgtgtccttgacaaagcacggctggtgccgcaacccctcagcgagcaagtcaagctcttcacagcgatgtcttacaagcgcagagggctctgtgacaccctggtctcaccgccactcttccaaagtcgcagaggctttagcagagatgggcccagcctctctgagtcataggcttctgcacacgggagctgtctttagagggagggtggaatttcatcagccacccacatgggggagttgagggcaagaattaggagcaaagatgggaaggggtctgggaggaatggccagtgatcccctttgacaagtgggcaggaaacgggggctaggtcaaagttgagtggaagacctggagggagacgggaaggtctctgtaggcacagttcagacaggagggaggtgtgagccagggcacatgccggtggccgtctggcaggatttgggacatgctggagcagggacagcggctcatcaggggccattgccctcatccaggccagagtgtcacaagcccgtggggaggcccttctcgcctgtcatccttgctgggcagtgggtgctgtgctagcaggacaggcggacggctggcaactgtctctgcatccctggagcctggcatagggccaagtcacacggggcacaggcctgcaaatcaggcacatatgttggtgcagtgacgtgattttggggggcagccccagaacaggccccagacacaggccaaagccctgcctgtgctggtgtgttgggctgttctatggctcttgctgtgggcatggaggactcagggaaggagagttgaggtggtccaggagttgcgtttgggatgcagagagcttgtggcatccaggtagaaatggtgcgtggggctgacctcagcaccatgggcagaggggccgtgtcacgtgcctccgaggtggaggtgggaccacgtggtgacagatatacgcatcactgggcacgtttttgtgggtgttggggggcatcgtattggctcctctgttcacagtggccactcattcagtccctggctaccaggtcctcactgtgccatggggaaggccggcgctgtcgggggatcacagaaggcagcacgtcatgatggcatgtgccatgaaggaaaagcacagggcactcaggaagtagaggggactggcctggggtgtgggaatctagggcctcgttgagggacagagagaggaagtgtgtggtggccagcatggaggtggccacaggggaggctgagttaggccgagagggcagggcgttggggaggtagacgggctcagccactcagggagtggtcaagcagaggctgaagggtcaggccaggttgcaggggcctgggggagccactcagggtaggcgctcccgggagcccgcctggcccatagctctacactcccgcgtggggccggacatgctgtgaagccctctccacgttggatgggggtggctgagcctggatgctgtctcccgttttcagctgcgtgaacattcacagccagcagcacgtactggtcatgtgtgccactgcgttttacctcattgagaactatcctctggacgtagggccggaattttcagcatcaataatacaggtgagtgggccctggctgtcttcctctgcacacggggagtgggcttcccttctcttttccttgcaggatcataccagtgggccagttttgacttggtcgggaggaggcatgaacacctgagactgtgcagcgattctttgacacagaggcctttctccctgtgcagatgtgtggggtgatgctgtctggaagtgaggagtccaccccctccatcatttaccactgtgccctcagaggcctggagcgcctcctgctctctgagcagctctcccgcctggatgcagaatcgctggtcaagctgagtgtggacagagtgaacgtgcacagcccgcaccgggccatggcggctctgggcctgatgctcacctgcatgtacacaggtgagcatgtacacggtgcccataaggccagcccaagtcctgttcaagggaggcaggagcatgctcactcaagggacctcgactaggtgccctctgatttcacacttctggtgttgccccaagccggccccatcaccttgcaagaaaggctctggagcccccagggctggagtacctggtcagggttgaccgtccctgtggtcactcatcccatgtggctgagctgggctgggtcctgggcaagcaaggggctgatatcacctgctttcagatctccagggactcactggacccctgtgtacaaagcactgtctacagagcctattgggttgtatagaggtaaccttcgtactgaacacttttgttacaggaaaggagaaagtcagtccgggtagaacttcagaccctaatcctgcagcccccgacagcgagtcagtgattgttgctatggagcgggtatctgttctttttgataggtaagaagcgaagccccatccctcagccgttagcttccctagaactttggcctgaagctgtgcttttgtgtgtgtctgctgatcccctggcgctgttgctggagtcctgccagtgattccccaccacagcctgaccatgggctgccttggctcagggttccactggcgagctggtggtccttggaccccagcactcaggtgtagcgttgaccagttccaaggttgtcccagtgcctgcccatctctcctgagggctcagggacagtacctggcagttgggggtgtggcagggggcaggaatgaccagcctctgggagggtggggcagaagcctgtacagtgaggaggagctggctcagcctggctgcctatcgtgagaggggagcccacggggctgtgggaggggggccgtggtgcctgtgagcagggtgaggagcagcggcaggaggatgaaggtggaacccacacatgcatctttgagacccgtgtggtcagtggcttctgccccccaccaccccccactgctgtgcgtgcatagaattggcttccctcacctgctctggaagtgggttaggagcttggtagggctttttctcaaggacaagggcccctgatttgctctcaggcctcagtcctggcgacatggtggatctggagccttgttgcactgccttgcctgtgctctccaatcagggtggccagtggggagccatttggcttttctcaagagcatactcaggtggaccttgctccactgtttgaccagatgaggcattctgaacagccaagcctgtgctggtctgttttcatgttgatttttttttttcttttctttttgagatggagtttttcccttgtcacccaggctggagtgcaatggtgtgatctcggctcactgcaacctccgcctcccgggttcaagtgattctcctgcctcagcctccctagtagctgggattacaggcacacaccaccatgcccagctaatttttgtgtttttagtagagacggggtttcaccgtgttggctgggctggtctcgaactcctgaactcaagtgatccaccctccttggcctcccaaagtgctgggattgcaggcgtgagccactgcgcccggcccccatgtcgatttttaaatgcacctctgcatcgttcttcagtccccatatgctcactgagcaccactgcgactggcagacgggcacagggaggcgccacgaccagtcctggccttcaaggggcttgtggtctagtgggcccaatgctaggtggcgagtgctccaaagagtgtggtgcacgccttccgcttgaccgctctccagacgccacagggaggcacctcgcagctgaccacagatttctctctgtggagcagtgtcttcagagcggctgccatgccactgctgggcgagggtctgcgggcgggtagagccaggagcacctgtgaggaagtgcactgccattttcgtagctgcttcccgtgtgtctcagttacacacggctggcatgtgtgcactgatgagacgggaacgtgatggttgcttttcagcactgaaagggatactgctcagggggcgtgtttcaggatctggttagggaagaagcagcgagagcacagatggggccctgtgtggtaacaagaaaaaagtcctggttgacaacagtgccacgaagcgttagaacacatagggatgtttgtggagcatttgcatgtggaaagcagcaaaaacataatgggaacgggttcttttgttatgatttttaaaaatctcttttgtaacatccttcccgctgcgccgtttctgcatattcctttatgtagctttcaaactcctcttaggagttctggtccctacagggcgtgggagcccaggctttacgtagctttcaaactcctcttaggagttctggtccctacagggtgtgggagcccagggcctgtgccgagcagcctgcctccacgagctagacagaggaagggctggggttttgcctttttagtctcaaaattcgtactccagttgcttaggctctgactttccccacttggaaagtccctcacggccgagggtccctcccagccctgatttcacatcggcattttccccagtattagagccaaggccctccgcgggcaggtggggcagctgtgggagctggtgccagtctctgacctgcgtccctcctcccaggatcaggaaaggctttccttgtgaagccagagtggtggccaggatcctgccccagtttctagacgacttcttcccaccccaggacatcatgaacaaagtcatcggagagtttctgtccaaccagcagccatacccccagttcatggccaccgtggtgtataaggtgaggttgcatgtgggatggggatggagtgggaaagcctggaggtggagttgcctccgacttcccagcagattcgccagcagagcccagctcctccgctttaaagcagcaatgcctctggcccccaccccacccccgccacccaggcgcagcaggtgcttcccgtccccccagccctgacactcaggcacctgcttgctccttgcaggtgtttcagactctgcacagcaccgggcagtcgtccatggtccgggactgggtcatgctgtccctctccaacttcacgcagagggccccggtcgccatggccacgtggagcctctcctgcttctttgtcagcgcgtccaccagcccgtgggtcgcggcgatgtatcctctctgggtccctggtgctggccccgtttcccttgtcaacaccgaggctcatgtttcatgataaggttttgaaacctaacctttgcaaaaaccccacagatgccagggtgacaggccctcagccccagggaagtaaaatgctgacaggggtacagaaaggagcacgtccagacatttgctgaccagggcctctcagaggggccggtgtatggcaggagggtcgcagctgaggggcctttctgtggagggcctgggtgaggggagcgagggtgggcggtggtctctgcagacgtcccgcccactcgcgggctctgtgtggctgggcttctcctgacactgcttctcattagctttggtcattgtgcctcgatcgccctctcggggaaaggcttaagtaaagatccagttcccacccccagatgctggctgccaggagtttccctttccacagcccttccccaagacagaccacaagagcctccaagcagcacagttgtcctggtgctgacagcacagccttgcccggcgtgcctggcacggctctgccctcactgcattggagcagggctagtggaggccagcggaagcaccggccaccagcgctgcacaggagccaggccaggtgagtgctgccgagtgggtgccctgcctgcagggcatccagccagccaagggttgcaggaatggaggtggaggcgctgatgcagctggaggcatccaggtggcccttccggggctctgctcgctctccaggctccctggacccctttgtagactgtttcaggagaggaactcccaggtgaggacagggaggcagcattcccctcatttgccggcctttttccttaactcctgcaccagcctcccacatgtcatcagcaggatgggcaagctggagcaggtggacgtgaaccttttctgcctggtcgccacagacttctacagacaccagatagaggaggagctcgaccgcagggccttccagtctgtgcttgaggtggttgcagccccaggaagcccatatcaccggctgctgacttgtttacgaaatgtccacaaggtcaccacctgctgagcgccatggtgggagagactgtgaggcggcagctggggccggagcctttggaagtctgcgcccttgtgccctgcctccaccgagccagcttggtccctatgggcttccgcacatgccgcgggcggccaggcaacgtgcgtgtctctgccatgtggcagaagtgctctttgtggcagtggccaggcagggagtgtctgcagtcctggtggggctgagcctgaggccttccagaaagcaggagcagctgtgctgcaccccatgtgggtgaccaggtcctttctcctgatagtcacctgctggttgttgccaggttgcagctgctcttgcatctgggccagaagtcctccctcctgcaggctggctgttggcccctctgctgtcctgcagtagaaggtgccgtgagcaggctttgggaacactggcctgggtctccctggtggggtgtgcatgccacgccccgtgtctggatgcacagatgccatggcctgtgctgggccagtggctgggggtgctagacacccggcaccattctcccttctctcttttcttctcaggatttaaaatttaattatatcagtaaagagattaattttaacgtaactctttctatgcccgtgtaaagtatgtgaatcgcaaggcctgtgctgcatgcgacagcgtccggggtggtggacagggcccccggccacgctccctctcctgtagccactggcatagccctcctgagcacccgctgacatttccgttgtacatgttcctgtttatgcattcacaaggtgactgggatgtagagaggcgttagtgggcaggtggccacagcaggactgaggacaggcccccattatcctaggggtgcgctcacctgcagcccctcctcctcgggcacagacgactgtcgttctccacccaccagtcagggacagcagcctccctgtcactcagctgagaaggccagccctccctggctgtgagcagcctccactgtgtccagagacatgggcctcccactcctgttccttgctagccctggggtggcgtctgcctaggagctggctggcaggtgttgggacctgctgctccatggatgcatgccctaagagtgtcactgagctgtgttttgtctgagcctctctcggtcaacagcaaagcttggtgtcttggcactgttagtgacagagcccagcatcccttctgcccccgttccagctgacatcttgcacggtgaccccttttagtcaggagagtgcagatctgtgctcatcggagactgccccacggccctgtcagagccgccactcctatccccaggccaggtccctggaccagcctcctgtttgcaggcccagaggagccaagtcattaaaatggaagtggattctggatggccgggctgctgctgatgtaggagctggatttgggagctctgcttgccgactggctgtgagacgaggcaggggctctgcttcctcagccctagaggcgagccaggcaaggttggcgactgtcatgtggcttggtttggtcatgcccgtcgatgttttgggtattgaatgtggtaagtggaggaaatgttggaactctgtgcaggtgctgccttgagacccccaagcttccacctgtccctctcctatgtggcagctggggagcagctgagatgtggacttgtatgctgcccacatacgtgagggggagctgaaagggagcccctcctctgagcagcctctgccaggcctgtatgaggcttttcccaccagctcccaacagaggcctcccccagccaggaccacctcgtcctcgtggcggggcagcaggagcggtagaaaggggtccgatgtttgaggaggcccttaagggaagctactgaattataacacgtaagaaaatcaccattccgtattggttgggggctcctgtttctcatcctagctttttcctggaaagcccgctagaaggtttgggaacgaggggaaagttctcagaactgttggctgctccccacccgcctcccgcctcccccgcaggttatgtcagcagctctgagacagcagtatcacaggccagatgttgttcctggctagatgtttacatttgtaagaaataacactgtgaatgtaaaacagagccattcccttggaatgcatatcgctgggctcaacatagagtttgtcttcctcttgtttacgacgtgatctaaaccagtccttagcaaggggctcagaacaccccgctctggcagtaggtgtcccccacccccaaagacctgcctgtgtgctccggagatgaatatgagctcattagtaaaaatgacttcacccacgcatatacataaagtatccatgcatgtgcatatagacacatctataattttacacacacacctctcaagacggagatgcatggcctctaagagtgcccgtgtcggttcttcctggaagttgactttccttagacccgccaggtcaagttagccgcgtgacggacatccaggcgtgggacgtggtcagggcagggctcattcattgcccactaggatcccactggcgaagatggtctccatatcagctctctgcagaagggaggaagactttatcatgttcctaaaaatctgtggcaagcacccatcgtattatccaaattttgttgcaaatgtgattaatttggttgtcaagttttgggggtgggctgtggggagattgcttttgttttcctgctggtaatatcgggaaagattttaatgaaaccagggtagaattgtttggcaatgcactgaagcgtgtttctttcccaaaatgtgcctcccttccgctgcgggcccagctgagtctatgtaggtgatgtttccagctgccaagtgctctttgttactgtccaccctcatttctgccagcgcatgtgtcctttcaaggggaaaatgtgaagctgaaccccctccagacacccagaatgtagcatctgagaaggccctgtgccctaaaggacacccctcgcccccatcttcatggagggggtcatttcagagccctcggagccaatgaacagctcctcctcttggagctgagatgagccccacgtggagctcgggacggatagtagacagcaataactcggtgtgtggccgcctggcaggtggaacttcctcccgttgcggggtggagtgaggttagttctgtgtgtctggtgggtggagtcaggcttctcttgctacctgtgagcatccttcccagcagacatcctcatcgggctttgtccctcccccgcttcctccctctgcggggaggacccgggaccacagctgctggccagggtagacttggagctgtcctccagaggggtcacgtgtaggagtgagaagaaggaagatcttgagagctgctgagggaccttggagagctcaggatggctcagacgaggacactcgcttgccgggcctgggcctcctgggaaggagggagctgctcagaatgccgcatgacaactgaaggcaacctggaaggttcaggggccgctcttcccccatgtgcctgtcacgctctggtgcagtcaaaggaacgccttcccctcagttgtttctaagagcagagtctcccgctgcaatctgggtggtaactgccagccttggaggatcgtggccaacgtggacctgcctacggagggtgggctctgacccaagtggggcctccttgtccaggtctcactgctttgcaccgtggtcagagggactgtcagctgagcttgagctcccctggagccagcagggctgtgatgggcgagtcccggagccccacccagacctgaatgcttctgagagcaaagggaaggactgacgagagatgtatatttaattttttaactgctgcaaacattgtacatccaaattaaaggaaaaaaatggaaaccatcagttgttgctgtgtgaggcttgctttgcttcatgagaacctagaccttgctgagctggagtcttaggaagcagtctcctaagtgcttctccagcaggggcagaaactgtcccaccagctaacatctggcattatggagggtcccccaggcagctgccagcagggacaggccccgtgttttctgtagccagggatgaggaagtggccccagggcatgggcctggctgggtgcttctgcaagggccttcccaaaccacagtacaggtggtcttcctgccctgcagatgggagctgtgggagctgctggagctgctggagccttcatggtcaagtgacatcataagcttatatgacatacacaagcctcaggacttggcccatggcactgaagcaggtcatcaggcccagcacagagactagagctgtgttctcacagggcccaccacccttccacctccttggccattgacacctgcgtccctggcccagctgctcccaggtaacccccaaagcagctggcacatcccacctctggtgtggccggggctgctgtgtgtccgcagggcctgccccgtctattctagcttgtttgtcctgtctgaaccagcgcctactccaagaagcctctgctcagcccagcggggatgcttctaagctccggacgagcctctcggaagccttggtgattggtggtgtagtcatcttgggatgcagatgtcttaccaacctgcaagaacaaaaaccctgtggcttcctctggtgcagggtatttagtcaatgtttgctgaggtcccgtctggttctggctaattggcaggggtcgtccacccattctttccctgctctgctgtctgtgccaggagagacgggggccagtcggccaaggggccagctcctgctgcctgctcctcttgggcacgtgcgggggccccctttctctgagcagggatagggatcagtctgccggagggatgtggtggacaggcctaaagcatttggggcggggcatgccacttgagctccctaaatctgtctcctcataggtgacaccgctccagggccccccagtggcctctcctttcagagctacctaaattctggtcacttcagagaaatggagcacccccttctccctggtccaggtgtggacagcctggcacactgagcacacctggcatggctggtaatttcagaaagaagaggggccggggtccagtgggaagcagcggtgaacccctcgtgagtgggctttgcagtccctccccatgccacggcagagctgccctcaacacagccttcctcttcctcatcggagagcacaccctgtccccttgccgagctgtgccctgtgccttcggtggtatttgattttggctgctactggctttgttgggatctggaagtcgcttcccctgcgtggtgcgtggagcactgtaagtcagatgagggaagtagccagggtgaggtgagtaccgggtggagccgccactgaagggactgggtaggggggccttgcctctacatgatgtgacacagccaaccgaggacagaggaagccccgttcctgggggtgtggggtgcacccctcagggaagcctgcagtggggcctgaggaaaggcatcctccgcgagcccacgagtctggtccatgagcaccgtgacagtgtctgtgggtagaggtggacccggccttgtgtcatcaccaggacctcttttgggaaaccatgtggacatcgcttgcgggtcccccaggctctgcagccccagcagcctggctgccttttgggcaagtggcttgagccacagaggacccagtcctgttgcagccacatcctctgggggggcccgccagtgtggccggctttctccaccctacaccaggcctccaggtgtcctggtcgggggtgtctgggccctgggtgggccctgtggacctgtgaggtcagggtcagggcatcactggaggcagagggctgaagttgtgggtctgggttccccttgtgtgcacaggcccctgccctccatgcttggtcaggcagctacccccaaaactgctaggacaggctggtcctgaggtggatcctggcccctgtaccctctggacagcccacccgcccaaccttctaccctgccccagcggcggcagtgttggccacatccttcccctcctggccccaattgctctggggaagtccaggctccggagcctgcccaggggccccccgtgatttgggcccaggactccacgtggttctctgccttcacccaagccctgaactcctcagctgccaaatccccacccatctgcacaggctgtgctcaccactgctgctcctggaaggtgcccctcagtgggacgcccacctcctctctgggcttctgtgtttgggagccctgctgcccccacccttggtcagtccccatgtcctgctggcctgtcaggcagggcagaaaatccacccagaaatgctgagcaggatgagagtctagttgggcccagcctcattatttagaagggatggaggcctagggagcatgcttctagcctgagcccagcagggccccgcccatgtcccaggtctgcaccagggacagctcctgccgaggcctgacctgccccttctccctcaggtgctgctggttgaccagcctctggccctaggagaccccgtagcgactgagggtcccagcaggccatgcagctttgccaaggtacgagcccctccccagcaggggacagatgtggggaccctcccaggcaggagcagctgggtgcctggtgctgccatctgctgcctgcctggttcttgtcctcacattggaggtcagtgtgagggctctgcctcgggaaaggccatggagcttgccctgtccagggcctcccatgtgcactgagcctgggaagagagggttggagttgagccttttaccctgggaatgctgcctggaggatggtgcgggtgtggggtggcaccctgccaggcagggccctgcctccctgcgcccactggaactcgggcaggcaggggtgtaggtgcctcctctagagccgtccggtgggggcccccggcagtggtggtggtgtccactggccagcagctgccccttcagccaggacagtaggcctgacgctgtccccagcagctccaaggtggatttgtggaagggggtagagggcacgtagaggccccatgacctccccagggttctgggagggctgtgcccccttagccagcaccatgctgggtgatatagtcagatcctgttacccctgttgtggaggtgaggaaacaggttagtggggaggacatgactaaggtccatgctgagtcgctagagctgcacccagaaccactgctgggaccccatgcctttctgcttaccccttgtgccgggagatgccaagagatgctgggagccagccccacctctgcccttggagtcatggctacggaaagggcattcggaccggtccctgacctcaccggggagggccgaaccctgttcctgaggagccagggcttcctagaggaggtaggccttctagtcactccttcatctgcaggcactccacagagctctctgtgccagcccccagcacggagggctgaccttagtcgagtggagatgccccagtgccaggcagtagggatgatgtctcctgaggcccagatggaagggactggactagtctcatggggctgatggtggggccaggccttgaccagggacccagtgtagggggtgcagagacccctctgagttcctcacacatccctggggccctccccatacacttcctatcctgactgcgggcaagagggagccccagttcgccttccctatgctgggcacccacagtggggctgggcacccccgccatgcccctgccctgtccttcccctgagagcctcggtcccacctccaaggtgcctcagaggacagcaggggcagcgggcagaggccgagatgcctcctcattccaggctcagctgcccttcttggggcagcccacacctgagagtctcctgcagttggtcaggcctgaggagggcaggggggtgcctgctgtccctctgctgaccacagtggcatttagcctgggcaccgcgcccagcacagtccatgctgcacaggtgccgtgggctccacagagccctgcctgacatgcatgtgttacgtttcgggtgccgatgcccttgggcggcacttctccgggcagaacccccaggccaccgctccggttccggttccgctgcatctggggctctcggcaggctgtggtcctccggccagcctgggggcatctcagtccctcagccccacaggggcctgccccgcagcctgggcctcgagccccgtctccgcacgctgtgccgaatctggctgcccatcagctccctgcgtacccagactgtgccctgccatgcccgtggctcttcccaggagtgccctgtggcctccccctggcttgctgggctgattccctcctgtgtctcaaacagagctcacctttgccatcactgctgtcctcaccggccggtgccagaggcccgtgtctgtgtaccctgtgtctgcacctctgggcagggcctggctctgaccaacccgggcttccagtgtccacagacctaaggcccagggcgcctgggggctggagcaagagaagcaaaaggagccaagggtgggggtttggggttcttgtgagggcccagccccaggaccccaggaccaggacacccaggagccccagggcccagccccagttcagaaggcaggggccttctgagggagcttaagggtcccacagcccaggacccccaccagggccagtggccagcgttgggggactcagcctcctcgtcgctcgtcctctctgtttctcccaccttttgccccctttctccttgcctgttcccacccgaggccccctcttggcctgcgtgagccggggcggcactgaactgggggccgatccgcctgggcggcggtgagaggcagggccgggagccgggccgctgggtttgggcctggcccgctcgccgcaatattgatggcccgtcagtgcagccctgattcctgtgctttcagttaaaaggtttctgttgttgtagcttatgcagttgctctgttgctatggaaacgtgacatcaaaatgacgtttcccgtttaaaagcttttaactaaattcctgcctgtcagatgtaggccccattttgagcgtggagctgccttcgagcgagcgtgagcggcgcctcccgcccatggtgcgtggggccgggccggggccctcgctgagcgcgctctctcaccccacaggcgcctccggcatggcggcggccgaggggcccggctacctcgtgtctccccaggcggagaagcaccggcgggcccgcaactggacggacgccgagatgcgcggcctcatgctggtctgggaggagttcttcgacgagctcaagcagaccaagcgcaacgccaaggtgtacgagaagatggccagcaagctcttcgagatgaccggcgagcgcaggctgggcgaggagatcaagatcaagatcaccaacatgaccttccagtacaggtgggcgagcgggcagtgtgggccccaccaggacgggcgggcccgggcgtggcgggccgctcctgactttcttggagctctgagtcgggacgatgtgtgggtcgtggcctgcctgtcggtctcctctggccgggtatgggcagaaccccacggggtgagacggggcccacggaaaccgtgtgtgcagccttccattggggaagtggggaaactgaggcccagcaagggcaggaaaccagtctaagagctgaggggtagcaggggtggggctggtgctgggcagaggccaggatggctcccaggacgtatgggcggtctgggcactgtccctcggaggcagcaacactcatggtggtgcccactgacctcacaccctgctcccccatagggaggcggcggctgccagtgccctccccaccaccaagctcccaagctcagcaggggtttcaggggcctactgcgtcattggggaaattgagactgcaagtgagaaggaggctcagtgctctgcgacttggagcatccactgagcctctgccatgagccggtgagccccactggggctggccctagggtcacggtggggtatttccagaaatcaccaggtgaggtgcaggaccagccagcgcatgggtggggcttacggtgcgaagaagaaagaggtggaggcctgccctggcccaggactcccagcgtgggggctcccggcctggccccacctctgctcctgctacatggcaggtgggcccttcctgccctggcaacctgcagggaaggccggaggggaccacccagccagggagatgttggcgtctaggaggggacaggtgtggtcccacacacccagcatcttaaagtgcgtgggtccccagcccattaggacagggtcccgggtgggcaggggtcatggtggggtgaaggtctcaggcacaggcaaggtcacaggtgcggtgagggtcttgcagggtgtgaaggtcataggtgtgcggtgaaggtcacaggtgtggggtgatggttttgggtgtggggagggtcttgcacggagcgagggtggcagcaagagctggaagctgcagggggagaatggcagcagagagcacccggccctgtgggcggcctggacagggctgggcctggggctgccggagagcctgtcagcttccaggatgggagtggcctcactcagctgctccacctccgggtcaggcaggtgagcctggggcagagaggctgagagcacctgagccacttgtgggagaggccacccccactgcccccctcaggcgaggagccggcctccagcacagcagaagggaacccccagtccccagccctagtgggagtggggaagaggcccagcaaggccccggacagaccgccagcctgtgaggtctccgctttcagttgcgttgatttgattttttctgagccttgaaggaggggtccggggcctggccctgcccaaaggcccctaggcaggccccaaagccgggacctagggtgctgagcatgacggatgttgggtttgagcggctggcttgcgacgtgagggctgaggtgtgagcctgggtatcttcagaggttcggtggacacaggcagctgcccgcggccccactgttcccgtggcctcctagtcctgctcaggcacctggtgaggaagggacgcagagggcagtgggaggtggccacgactgttccagcaggctcccctctgactcaggaattcacgggcaccacctccctggctggctctggttggtgtctggccaggttattcattatttatgctgaaagcctcttcagagtcccaggggagggtttctgtctccattcctggaggctgagagatgagggtgcagcagagtgggggcctccactccagaccctgcagtctgggctggccaagggctgcaccggtgcactgcacgtcatggctgatgaagcacttccacaccgcagcccctcagagctgccacagtcagccttagttcaccgagggggaagctgaggcccagagcatgagagggacttgcccagggccacatagtccttagcagaggaagctgtggctgggtgactcgatctttgtcctttttctttatacccgcagtctccccatagcagaggcttttcttttttttttctttttcttttttttttttttacaagaactctttatatattaaggctgttgggctgaagaagcctgagagggtggctggttctgtggagcatggtttgttgaagtacagtttgggggcctcctacactgagaataggccttttctcgtttctccaaagagtgggctggctcaagtagggcagagagagaagcctggggcagaggttagggatgggcacccagcgcctgccctcacacgctctgtgctggtgtcttcacagccacgtgccaccctgggcagcatcccctgctcaccatctggctgtgcctgtttgctgggggcacctcattcagaatccagcttattgtttccaacggccaatggccacaccctggcaggtagcaagagtaggagagaggagacacccactccgagcacaggttgggtttggagcccggccttggggcactctgtcactcaaaggcagagtggggagtgggcactgggccttaggaggtactgggtccagtgaggcagagatgcccctgccccacccccaccttgtggcttcttccctggcctggccagagctgtctggccgccatggggccctgtgtctcctgccttgacctcccagagggcagccgaggcccaggggaggcctggggacttagcctctcagggcaggacctgtctgcaggagtaggtgggtgctgggggtcccagtggtaatgaggcatcaggcagtgtgggaaggggcccatccggcccaccccagggcctctgggcaggttgcaggttgtagcgctggatctaggctcctgcccagactgtaggttcaaccaagaatggcatgggagcccagcctgctgtttgctttattaaatctgccctgtagctgggggaggggcttactttgatcatcactatgtcattgatataaaaatagaggctcagagaggtgaatgaacctgcccaaagtcacacagcaaagtgtggagatgagatactgactcagggctgtggacactgaagcctgtgctctaacgccagtggctgtcgctccctgaggcattctctcccgaacaacacagttattatattacaaaatattatcactatatttatatatcttataataccttattattacaataaaaccttattactctacctttcaaaatgaattatttaaaaagcagtatttgctcattgcagagagtctagaaactatagaaaagcaagggaaaagcaataggaccagccccaaggtcccagcatgcacagataaccttagtaatactgggacgtgtgcttcctttttaacatctgagcccgtgtaggtcctgaagcccagcttctttctaagtccattgtcatcttgaccctggagcctggccgattttgctggggaggcccttgccagccgagagcggctcctgcctgtgccggcgtggcgcgcccctctgctgaggctgggcaggacaggggctgggccagctctgtttctcacccttggctcttgtgtctctcgtttcaggaaattaaaatgcatgacagatagcgagtccgccccgcccgactggccctattacctagccattgatgggattctggccaaggtccccgagtcctgtgatggcaaactgccggacagccagccgccggggccctccacgtcccagaccgaggcgtccctgtcgccgcccgctaagtccacccctctgtacttcccgtataaccagtgctcctacgaaggccgcttcgaggatgatcgctccgacagctcctccagcttactgtcccttaagttcaggtagtgtgtctgcttgtccttcccctgccctggggtatctcagcccccaccatttagagaaagggactgggagtggcaaggccggcggcggcggccacagtggttgcagaggccgtggctgcgggcagcgcctccagggacaggcggcctcagaccagggagggctttagtgtccacaggcagaccgagtttgtctcccagctccatcacttttgagctgcacggaaagttccttgacttctctggcctcagtctccctcctataaaatgggggtaaatcagtacctttctcagagggtggctgggagcatcacaggagagaagacgcagcatggggcccggcacacggagggagaccaagccccagaccccagaatgcgccccctggcctcccttagcccacacagaccccaccctcacaggctagctgccctctcagcactggggagggtgtcgggctgcacctcatcacgtgttgccgtgggcatgacccgtcccctctgccatccatcccacacctcagacccgtcccgtgctggccacgtgactgtgcctgcaagatgctcacagggcagccgggagccaggcagcatgcaggacagacacctgcggggtgggcctggggagcccagagaaggtgcttttgaggaggggacatttggggtgggctttcaaggtaaaatagaagttggccatttggaggcaagaacaggaagattgtggatttgagtcacagcttctcccctgccctggtcttcaagtctttctgacaggaggtgtcagaaaagtatctttagtagagaaggcgtctccgaggagggtccctctcatgccgggggccgctgcttgactcaggatttctcattgaagacctgagacaaaaacgcttttgctggcagctagaaggaaccagcaggaggcctgagatttgtggctgttgttcccgtggactgagcccagttctcagactcagctgcctggggccttgcacaggactggggcgtgggggctgccctccctgatcaggcccaaagcgcggatctcacgcccctgaggttggctgtaccctctcagctcagagcagagtgtgggccagggatgagcaggcactggagcagggccctggggtctgtgggttttggcagctccctgcccttcagggaggtctgctgagaccacgggtggcccctaccccagcagcagagctctcaggaggcgcccacagggctggactgcctttactcaccacctctaccagagctctgaggtcctggggagagagcccaggcctcttgtgggccccacaccctctaggtgcctgtccttctgcctctctaccaaggtgtgccggccccatttctaggccgccgggagataagggggctcacatctcaggcccttccttctgggacctcagtttccccatctgcctaaggccgggtggggctggtggtcttggcttccctacaggggtcctgagtactctgcactacccagcaccccccacccctgccttcatctctccctgggggtggtctctccacccctggcccccaactggggctgagcccccacctgcccagtttggtgggtgaagggtgctccctggcaggatatgcccctctgcagcccagaacatcccaccctttccagaccgaaggggtgtggattgtcctgggaccctggtcattggggtcatccgctagtcgcaaaggacggcaatgcctgtggcctctctttctttctttttctttttttttttttttgagacggagtctcgctcttgtgcagagagcagtggcgcgatcttggctcactgcaacctccgcctcgtgggttcaagcgattctcctgcctcagcctcccgagtagctgggattacaggcacccgccacaacgcctggctaatttttgtatttttagtagagatggggtttcaccatgttggccaggctggtcttgaactcctgacctcaggtgatccacctgcctctgcctcccaaagtgctgggattacaggcataagcctccacacccggccacccctgttactttctgtcaaaggcggtgggttctggcccctcctttgcacatggaatatgagaccctgagtaagtgacctgactccctggggcctcagtttccccatttgcccagtaggattgtcgggagggtccggtgaggcccctggtgtgcccaggctctgtggccagcacgtccacagccggcactgtccttccaggtcggaggagcggccggtgaagaagcgcaaggtgcagagctgccacctgcagaagaagcagctgcggctgctggaggccatggtggaggagcagcgccggctgagccgcgccgtggaggagacctgccgcgaggtgcgccgcgtgctggaccagcagcacatcctgcaggtgcagagcctgcagctgcaggagcgcatgatgagtctgctggagaggatcatcaccaagtccagcgtctaggccagcaggcggcggcggcggcggggccgggcggctggtggtactgctcaggccacccagggcaggccactcaggccaggcgggcaagggggccgccccgcgagcggagaccgccttccacctggcctctggcaggatgtcccttctgaggggtattttgaggaacccccaggccctggggaccgtgaggctccagtctccagcatgaatgcccttcctcggacacaggccagggcctctggggttcactccgagtaagaacgtcctagagccactctccagtgtcgttactatcaatgatacttgacgtggctttgatattaaacgtatactttttcattcttgcctggaacgcacagtttgctgttgctggcttggtgaggatgccctgattgatggatcccgaaaatgaaagcagatggaaacgggttggggcaggctggagctgggggagctctctcctgaagggaaccctgtgtcctccctcaccaggacctctgcgtctctccttaaatggcctctgacgcctgatgaaaaccccagcgaccttccaggaggcttttattcagctctgtttggagcatcaggtgtttccactgcctccttagcaatgacactaataaaagtcgtaacacctgttcacatgcacagccctgttgagtgttctgggtgctggagatatcatggtggatgacacaaaggccctggcctcttggagcttatgctcccatgcggggaagacacatgggtcagtagagaaatggttgcaggttgtgataagtgctggaagggaggggttggcctgaggacacggaggcagacatacgtggagctgggaacagtggccacacagggaacggccagtgcgaaggcccagaggcagaggacactggagcaagcccaggagcagctaggaggctggtggccagcagccaggccacggaagcccgtgcagcccgtggggaggagtgttcatgcttttcaagcttagtgggagtcttttggccagtgcagctctgggtctgacatcggtgggggacagaggggtggtggagcggccacagctgcaagctcacctcactgccggcccttccaccagtttcaaactctttctagaagctccagctttcccaaagctgaattctctatgagcctccttggccgggactcgggcgtctggttgccctggctgcaaaggaggctggggccaggtgtgtttgagtcacctcctggaattaggcaagttgctgcccaaatagaaggttgttggcaggtgggtcagcaggtgaacagcatggtttgactcagggttcagaaaaatctccctctggctgccaagcgagcaggccgtggagacaggtgcagaggcaggtgtggcagcaggcatcctgccaggcagtgctgcagtcatcctgcgacaagcagcagcagctcatcctaccctctagggggtcttgaggtcagccaggcaagagagcagcttggactccactgggtgtgggaccagcctgtggaccatggtggtgtggagggtgccctcggcctgcctgtgtgaaggagaggccggcgtgttctgtggagcccaaaggggagctgggcaagcaggattcacttcactctgagggtcctggagctcccaccctcctcagccatctccccagagcctgtgtgccgaggactcggcccatgttgctgtgggatgagaggcagagtgtcgtgagggtgtaaggagcggcggcagtggtgggaggagggagcagcagccagcgctacggtgccagtttccagctgccagatgacgccgctgaccctgtggttgagaagagatgcacagagccagctcttgcaagccagtgtggctgccatagcacctgccgagaagcagaaggaagggtggccccaggaggacagaggatgcgggcacatctgatgcgggcctgagttttgggagcttttgctctagccagtttccagctccgggacccacccgcctcgtaggcaagacaccacccaagaaatcatttgcttaacaaacacactgggctccaactggacacctgtgccaccctagatgctgggaacccagccatgacacaggcacctgcccccagctgctgaccactgaggctggctagcagctcccatggggccagtgtggggttccccagcctcctaacagggagccagtcacaagccctcgagagggaagggtgcccgcggccctggcaggaaggttaggctggacgctcccacaagacataacagatggaggttctaaatgatgtagcaacttcttcaccctgaaactgctgtagagtcagccatgacgcaccggtacttcagtaactgccaggcatccgggacagcacaccgcgagtcgctgctgtgcttgggttagaagtggtttggtctgttttcttctcgccctctctaatcagagtcagtgattcatgcccttccatcaccttagagaaggggcaggcgctgcccgaccttctccaggctggagcagcatcgcctcatgtcagcagaactcagctgtagaatatcgtggggttggtgcctttcatcagcagcatgtccttaacaactttctgatttcttccttagttgttggtccattaaggagaaaaaaaatgatctcagccattgctaaaatatttgataagattcagcaaagcagcatgttaacattgaaaactagaatcaggagccaggcagatgtgcttgcttttcacctgtagtatttcatgttgttttgacgtttttagctaatgcattaagataaataaacaaaagccgggcacggtggttcacgcctgtaatcccagcactttgggaggctgaggcgggaggatcctctgaggtcaggagttcaagaccagcctgaccaacatggagaaacctcgtcattactaaaaatacaaaattagctgggcgtggtggtgcatgcctgtaatcccagctacttgggaggctgaggcaggagaatcgcttgaacccgggaggcggaggttgcagtgagctgagattgcaccactgcactccagcctgggtgacagtgaaactcggtctcaaaaaaaaaaaaaaattaaaaaaagataaataaaataagcaggataagaaatgaagaaagtagagttacctttgttttcagatttcatttttgtatacccagaaagccaaatgtacaaaagactgggagctctttaaaccagcttaaacttgttgaaaatgaggatgaagaaatatcccattcagagttggaatgaatttaacccagaaggaacaggacctctactgaagagaactatgcagtcttactgaaaaatctaaataatacctgagcgctggagaaacttcgcacactcctgaaagctccaaagtcaatgtcatcattttattaatgtcattccaaacatagtctcaataatatcacttcttggttttgacatggacgcgatgatgtttaaattcatatgaaaaaagaacggggccaaaagtccaaggccagtcagcgtgagaagaccgctcggcctccctcggagtcggggagttggaaccgcagactgagatcatgtggctgctggaggccaggacgaacgtcgggaaatggagactcctgcgttgctggtgggatgtggtgcagccgcttccaggagcaatttggtgtcccgtcctaaagctgaagaaacgcatttcctctggtcagtgccactcctagacaggccaccctgcggcagccgtcctcaaactggtctgaggacccctcaacgctcttaaaaatcattaaaagtgggccaggtgcggtggctcacacctgtaatcccagcactttgggaggccaagacaggcggatcacgaggtcaggacattgagatcatcctggctaacacggtgaaaccccgtctctactaaaaatacaaaaaattagccgggcgtggtggcgggcgcctgtagtcccagctacttgggaggctgagccaggagaatggcgtgaacccaggaggtggagcttgcagtgagctgagatcactccactgcactccagcctgggcagcagagcgagactctgtctcaaaaaaaaataataaataaataaataaaaataaaataaaataaaattcattaaaagtgccaaagaacttttgcttatgtgagttctaatgaccaatattaatacacattagaatatcttattagaaattaaacctgagacctttagaaaacatgtattcatttcaaaatagcaataaacccatgacatattaacataaataacaattgtatgaaaaatatattttccaaaacaaaaagttttcgggagaagtgtggcatagttttacatggtcgtaaatctctggcttaagagaagcccactggcctctcagcaggctctgggtccgtccactttgggggtgttttggttgtgaagtataggagtgaatggagaagctcattcttacccagatgtgtatttgaaaagaaaaggaacattttaataacctttgcaaataatcggtatattcttccgtgatcctattccaacactggacaggtggtggtttgttttttttttttggagacggagtcccgctctgtcactcaggctggagtgcagtggcgcgatttcagctcactgcaagctccgcctcctgggttcactgcaagctctgcctcccgggttcacgccattctcctgcctcagcctcctgagtagctgggactacaggcgcccgccaccacacctggctaattttttgtatttttagtagagatggggtttcactgtgttagccaggatggtctcaatctcctgacatcgtgatccacccgcctcggcctcccaaagtgctggaattacaggtgttagcccggccgacaggtggtggttttttactggccggttgtgtgtggaatctgataccctatcaatgaacttctacttcatttcaggagaatccattggtccgtcttgtgcttcaaggactctgtccatcatgcctttgtgacctcacacgctgggcctttggttcactaagttatgcggatattccaaatgctgacacagttccttaatcagtattttaaaatcacttttggcgatatcaccaatcttagaaaagtctttcagttggaaaggtggtgaactcatggtggtgtctttcagaattctgatttttgcatgaaagcttgaattttatcattggtaacaaatgctgtcagctattttctttgaatgagacaggctcactttgttcgttttccaaaaaaaaaaagtctgccaggacacccaaggctgaacaaccagagtttttgcacatcctttttttgagtaaaaagtgtgctccatacgtgtgttccagatccagacggcagctcagcccattgcacacctgcatttcctcagcgtggacgtggggcaggcgcgccttccagttgctcgggcaggacgttgaaaagatgtggacccaggggtcaagacctcacacactcgaccattttcactccatcacggacatttggaagtgaccggcgtttcacactgcagctgtgcggtgcgaaaacccctcagggctgcgccggggctcggggcctgcctgcgttcctgctcaggtcttgccacatcagtgcgcatgtcagctccgtgaagaccccgtgaagaccccgtgatcatcagactatgatgaaagcagctgcaacctcagggacccttggtgacccacaggccgagacctgagaaccactgcctgaatgctggagcgggcacacaggtgacctgagcgagcctcgtctgtccttgcccggtacccagagctggctcactggcgattggtggacgcacgggcgctgtcacacaaaggggccctccgtgtgactgggtggcgtcatcacagacagcgtgtgggaaccgtgcccccaagcgggcccagagggactccctgctgtcttgtaggcactggggatagggtcaggtggaaagcagatacaaatctttgtctttacagggtttcgagttgagggtggggctagaccaacaataaacacgtaagtgtctagtatgttagaagagaggtgctttccagggaaataaggctgtagggggattggagccgtggggtgagagaaaaggccttcaaaaaatgtcatgtgagcggatggagtgggaggggcgccctcacctgagcactgggagctgcactgtctaggtgggagctggctctgagggcgaggtgggcctggacagggacaccctgctttctgctgggacaagagagtcccggagcagggagggtcaggtgtggcgtggagcctgggaggtgggtgaggggtgctcaggaggcatcctggcctaggggaggatagaatggttggactggcacaggccttggctgttgcccgggcatggggaaaaaccagaacctctgtgtgctggctttgcgctcgtggccatctccaggactcagaacatgcgagaggcacgcaaggtggagcgtgtgggagaaggtgctgcctgtggtttcagcccaagttcatctcagctgggtccggagggagagggcaccctacccctagaacacgagcatcttacagtagaaaaagccagttggaagcccctggggaccgccttaccttctaaaatagaagccaagaactgacacatctgtgagggacatgaccagccaagccgtgaacactgcgcacatgtgaattcctggtacatccgtggcttgtgcagggaccaccacaggctcccctcagctcagggaagtgggacccctgcacagcccctgccctgcatgcagcagtccacctggtgcctttcgctgccctctgtttatctccgccttgctgggcactagctcagcttcactgctttccgtcaaggctaatctgctctcctgctctgcaccaccatgtccagaccttgagcgcctcgtcccccacaaatgtcatatttaccccctagaggacctagaggacaggagggagtgggtatgctgggtagcgtggtaaaacccacacgtgtctcaggtctgccctccccgttggggccaagtgcccgaccttgcactccctaagaaaggctgtgacgtttggggaacgcctttggggctggagccacacttgggcctcatttggatgttttccctgatcctttttccaggtagcccacaggctacagctgagggtgtgcccagggcgagagaagactctgcggggctctgggctgcccttgcggcgtgagccgtgcactcctgctgccgggcgtgctgggcagaggggatgtctggggtcttggacagctcttcctaggaggtcacggaggaagccctgcagctttggaactaagctacaccagcactgggaagttctcctttggaaacggtttttagggtgtgcacctctcagcctgagtccgatctcacagagactgtgtgagctgctgctcgccctcgtgacccccttcagctcatgccagcctgcctgatctgccgctaagaaccagcgctggcacagtgtgcgtctgtcccctgcccaggcttttctcgcacaagtacctgctgctctgaaccttgccattttcggcaatatacctgcgttaaaaaggtttgcttcttgttaatgctggcagaatgccctcctcctcttgaacgggagaatcggattccagtgtgtggaggcacagtcatctcgtgggtcccttactgatggagagactgttccaggctttctctgcaataaaccgtggtgcagcggatgtctctctgtgtacttgtgtacactagtgagttttgaaggatgagacaaaacacttataactctaggggaaacgaaaagttgtacaggaaagggaaagtcaggctacaaatggcttacacgtgaggtcgggttgagatttacttttttccacacagatatcccgttgttacagcaccgtttgtagaagagggtgtcctgtcgctatggagtggctttggactctttcttgaagatggatggcctgtggatgtgtcgggcccgctctggagtctgcatcctgtccattgataatgatgtcagtcctcacgtcagtacacactttcctgattactgtaagtcttgaaacctggtctaataaatctttcaactgtattgttctttttagaaagtggatatttttaaagtctttagcatgtcctcatattctttttgttgtggtgaaatacactcaatatacaatttgcaattttaattattttatttatttatttattttgagacggagttttgctcttgtcccccaggctggagtgcagtggctcgatctcagctcactgcaacctccgccccccgggttcaagcgattctcctgcctcagcctcccgagtagctgggattactggcacgcagcaccacgcctggcaaatttctgtatttttagtagagacggggtttcaccatgctggccaggatggtctcgaactcctgacctcaagtgatccgcccgccttggcctcccaaagtgctggggttataggcgtgagccaccgcgcccggcccattttaacgatttagaagagaacagttcagtggcatcgaatacattcacatcgttatgcagccatcaccaccatccctccacagaattcttctcatcttgtcaaatggaaactctgtcccccttaaacacaaagtcccattatctccccaactccccagccccgggcacccaccactctttctgtctgtgcatttgactactctagggacctcatataagtggaatcacacaatatttgtccttttgtgctgcttatttcactcggcataatgtcccatccatgctgtaacatgtcagaggttccttccttctcaaggctgagtaatattccactgtcttccaccacgttttgtttatccattctttttttcttttttttttgagacaaggtctcactctgtcacccaggctgaatgaagtggtgccatcatagctcactgcagcctcgacccccccaggcttaggtgatcctcccacctcagcctcctcagtagctgggactacaggggctcgctgctacattcggttaatttttatattttttgtagagacgggttttcgccatgatgcccaggcttgtctggaactcttgggctcaagtgatctgcccacttcagcctcccgaagtgctggggtcacaggtgtgagccaccgtctctggccttgattcatcttttgttggatactcgagttgctgtgcctttgagctaatgtaagtagtgctgtcatgaacatgggctgtgtacgaatgtctcttagagaccctacgtccagtgcttgtgggaatactcagaagtggaattactgggtcgtatggtaaatctatatttaacttcttgaggaatcagtagcaaatatttttgtactattcctacatacagaatttctggatcaaaggaggatgcatttagatttttaatagattttgtcagaatgcctcctcaagatgctatttaaataatttcagatcctaaaaaagagaaaaatgtccccattcatgttatgaaccaatcaaagccttaataccaaaacccgattttttagaagtacaaaacaggccagatacggtggctcacacctgaaatccgagcactttgggagaccgaggtaggtgaatcgcttgagcccaggagttcgggaccagcctgggcaacatagcaagacctgtctctacaaaaaatacaaaaattagccaggcgtggtggcacatgcctgtagtcctggctactctggaggctgaggtgggaggatcacctgagtctgggatgtcagggctgcagtgagctgagattgtgtcgtgcactccagcctaggtgacagagcaagacattttctcaaacaaaacaaaacaaaacaaaaacagaaaaggagatttgccatgttcttgtgtgggtggataagaagaaaatgccaagctcccgaggcaggatgtaaatgtaattccaagtagagcctggcacatctgaacagtggaagctcagtgatgagaatgcatagacatagaggggagcaacgcacaccgtggctgtcggaggcgaggctgggaggggagaggatcagaaaaacaagtagtgggtccttggcttgacttaaaaggctgaacctgaaaaggaaagtgggataaaatgattttaagcttcttgtggaagaaaataaaggaaaagaggagcagcggccccaggccggttcactagggagagaaacctatgtcagttcccagcactcaaagccacgtggcgctgccacagaacaaacagtgtggggcacgcgcggccacacggggacagcccagctcgccacgagggtcaccctcatgtctagcggtgcataggtgtgctggtgcaaaaaataaggacctgtacaacctcgcacgtggctttccatatgggctctttattcaaagttggtgtcaggtggattaaaggctcatgtaaaaaacggagatattggccgggcgcggtggctcacgcctgtaatcccagcactttgggaggcggaggcgggtggatcacgaggtcaggagatcgagaccatcctggctaacatggtgaaaccccgtctctactaaaaatacaaaaaaattagccgggcgtggtggcgggcgcctgtagtcccagctacacgggaggctgaggcgggagaatggcgtgaacctgggaggcggagcttgcagtgagccgagatcgcgccactgcactccagcctgggcgacaaagcgagactctgtctcaaaaaaaaaaaaaaaaaaaaaaaaagtggagatattggccgggcatgatggctcaagcctgtaatcccagcactttgggaggcccaggcaggtggatcacctgaggtcaggagttcgagactagcctgaccaacatggagaaaccacgtctctactaaaaatacaaaattagccaggcatggtggtacacgcctgtaatcccggctactcgggaggctgaggcaggagaatctcttgagcccaggaggtggaggttgcagggagccaaagtggcgccattgcactgggcaaaaaagagtgaaactccatctcaaaaaacaaaacaaacaaacaccaaagaaatggagctcttctagaggaaacgtggaaagatgcacgcctctgctctgaggcctttctgagtgcatacggtgaaaatacagtgtctaacttgattaatattccataagtttctgtatagcaaaagggctttaaaaaggtgaaagaggccggaccatggctcatgcctgcaatcctagcactttgggaggctgaggtggacagatcacctgaggtcaggagttcgagaccagcctggccaacatggtgaagccccatctctactaaaaatacaaaaattagctgggtgtggtggtgcatgcctgtaatcccagctactcctcgggagactgagacaggagaatcacttgaacctgggaggcagaggtcgcagtgagccgagatcccgccactgcactccagcctgggtgacaagagtgagactccatctcagaaaaaaaaaaagggtgagatagctaccatgggcggtaacaacacttgagcagcatgcaggctggacagtggttattgtgggccagcgtttgaatggggctggaagtgtgcagccccagcgtcctgggaggaggggcctccatccccaccccgagagccaggcagggcctcaccttccagggcacccctttctcaccaccccttgcccagcccctccttccaggggcctctgctcttccttctcgaagcaggtgctgtgcctgagtgtccaaggccaatttctgacgctacattctggagtgttctactgacaccatctgccaggacccacacttccaagaatccccacctgtgtgcttctagagcagacagatggggtcagaggtgaggcagcggggatttgggaggcaggaggtcagggccatggttggcagaggccactgatggtcaggagaagcaagacagggatgcaggcatcccgcaggtgccggtttgtcggctcctcctgctgtgtgcagcctccttcctgccgggccctgctgaccagccctgacctcaggccgccctgaggtgcacagaggtcggcagccggggcagccagctgcagggatccagcaatcttatctaggagcctgcagggtcccatgagacaagtgagatacctgaagaagttcctgccaaatctggcaaactgccttaaaggggcaggcaggtaggcttttcctttccatattgcttcttgcgcaaacagacgaggtggaggaggtgtctggctctccatcggccttctagggccctgaggcagtcctgagggtgagggccacgcccaccagagcggaggggcctgagggcactgtgggctgtcacctgggcctggctgcttctgtgggagacagaaataaaattcccaaccatgccagcgttatttccacgtttgaagccaaatgcaatttttgagagggaatttagtgcccaaaaggggagggagtgttgaaaatgacaggttcaactcctacagcatggcattggctcgtgaggctgctgaatggggcgtggggaggaggtaaggttccacctgctgcaggctggaaggctgatgtggtgggaaacgtggggtcacactgtcacctgggcctcctgggccagcagaccacccacaggccgggagggcagcctgaggagaaaggcaggaaaaaccttcagaatgtggtgccactgtcagcaaagttccccaagaaggagatggccttggggcacagccagcgggcggggtggcaggagctgcagctgggctagggagcgctctctgcccgtggggtgctatgaaagccggtgtgattttgagctctgcagggctgtccccaggctgccgacattgcaggaggggtccagtcctaggcacacaccattgtcacttcaccaggctccacggggccccagatctggggactgtccagtcaccggactctgcggacacagagtcaaatctgaccccatcctgccttcaagccagcgtagatcaggtctgggtacactgggcctgtgggggaggggctgtgggttggccctcaaggaggggaagatgggggcggcaggcaggggtggcgttgtggaggtccatgaggagggcagggcagcctgggagcctggcattggttgtagatcctggcagcacgggtgagtaagggaagggccctgaggaggggagggcagggctcaggtcttgctcagccctagactggctctgaccccacacccagggttgcaacgtggtggggtgaggtcaggaccccacagcagcagggccacccaggaggacacagggtcccaggctgtggcccatgtaccccatgccccaggcctgcacagggtctccaagtcaggaggaaggaggccaggagtggagccaggcactgggctgtgctggctcggccctgccacgcagggttgttaggggctggctctgtcctactgctcggggtccaggttctggggctctgtcctctgcgagcacctctcagcctcgcacccctggggagcggctttgaaacaagcacagctcccaggtgcgcctgggaaccctgttctcacctgcgaaaggggagcggggaggggaagcacaggggcagcgggttcctcctgctcctcctcctgcaggcaccgcccctccaccccacagagggcttctgccagcttctagaaccttccccacagtgctgcactgaccacgtgttccttagttccccgcagggttagactcctgacttattcccttgtttaatcctcagctcagggcgggtggggtctggagtccggcctcccccaacagcccacctgctccccgcccggccgcctggcgcagaggccctagtttggagagcccattcacgctcggaatttggattcaaccacggggctgaccccccacctccctcattttccaaaacgcctttgtcttttcctgttcaaagaactttcaagagactttccaagttttgttcgggaacagtgtggctccccagggtgccagctggcatcttgtgcaattatcattaaattacagggacaattttaatttcatgataattagaaatatcaactgccgctcagccttcgaaactaatggaattttaatgggcagctgcttaggttacagctaagaatagcagcgctccaccgagcggctgcagcagggccctgagtgggcgccagcctccatgtgggagccgtgcccagggagccggggcacctggtgtgggctgcgggaggcaggccctgggtgaaccttcagcagctgcctgtaagggagaaaatgggaccgtcctggtcaggtggaggagacctgtgtcctggactttggaccccgaggccagcccattacccctgcaatgcagccccaggtccacctgccccacagccacagcctcagggcttggagctgagcctgcgacctcagactgtgccctctggggagcccacccactctgggcctcggcagcctgggctgaccaagaccttccactctgagcaaatctgcaagccgggggagccccaggccctcagacggaaggcgccctcactccttcctcttgtccttagaattacagtccaaggcccggaaacagtcattccccatgttctgtccagttttccagtcatttgaagcagggatggaggagaggtgaatccagagcttgtcactccatcctggtggaaagtggaattaatggtgtctttcaattgggcagattttgcttttgataatatcaaattttagctaattttttttatggctaaaacattttgtgtcctaagaaatcttcaccaaggccagggagatattttcccatattgtattctagaagctgtggttacatctgggtctctgtccatctcaattgctttgtaggaaatgaaatggatatcagagccattttttccacgtgattcccctgttattccagaactgtttgttagaaagcctgccctttccctatcgcgagtgtctggtgcctttgtcaaaaagcaattcacagaacaggagggggtctattattattattattttttttttttttgagatggagtttcattcttgtcacccaggctggagtgcagtggcacgatctcagctcgctgcaacctccgtctcccagattcaagcaattctcctgcctcagcctcccaagtacctgtgattacaggcatccaccatcatgcctggctaatttttttttttttgcatttttagtagaggcggggtttggctgcgttggccaggctggtcttgaactcctgacctcaggtgaacctcccgcctcgcctcccaaagtgctgggattacaggcgtgaggcaccacgcccggccgagcgggtctattttgagacaccattcggtcctgttggtctgtgcgtctgcattatcttggttactgtgcctttatagaaaatcttcaggtcacctagtgtaagtcttccaaacttcttcttttccaaaactgtttttgctaatccatatattttgccattctgtataaattttaaatcaccttattgatttctatccccaaaaaagcctgctgaaatttgtattgagatggaattgaattcatagtcccacttgataagaactgacatgttgaaaatattgtcttacaatttatgaacatggtgtatctcaccatttggagctgtctaatacatcctttattaaatttatttatcagtatattgattttctaactttttgctagtatctagaaatacagttgatttttgtatctgtagcctgcaaccctgctcaactcacttattcatcctaacagctttttcttttgtaattctttaggactttccatgtttacaataacatcttcttgatgacaagcttcttatctgtgtgtgaataaggacaagtttcttatctctatgtcttttatttctctttcttgccttattttctggctatgagctccagtacaatgttgaaaagaagttcggagagcagcaccattgccttagtcctgatcttagaaagaaagtattcagttgttcgccaatgagtatgacattagctgtaggtcttctttctttctttccttccttccttccttccttccttccttccttccttccttccttccgtgagatggagtcttgctctgtccctcgggctggaatgcagtgacgcgatctcagctcactgcaaacctccacctcccaggtgcaagtgattctcgtgcctcagcctcccaagtagctaggattacaggtgcccaccaccatgcctgactaatttttctgtttttagtagagatgggatttcatcatgtcggccaggctgttctcaaactcctgacctcaagtgatccacccgtcttgacctcccaaagtgttggaattacaggcgtgagccactgcacctggtcagctgtaggtttttcataggtgccctttatcaaatgaggaagttcccttctaattttagtttatgtagagtttctatcataagtggatgttgaatattaacaaatgctatctgtgcattcattaagatgaccataagatttttctcctttatttttattaatgtggtgactttgaagaattgcttttcgaatgttaaacccaccttgcgttccttggataaactgcacttgttcatgatgtgctattcaatgtagtaatattctgctaaggattttgtgtctgtgttcatgagggtcattgggctgtaatttctttttctcttgatgtccttgtcaggttttgatatcagagttacatgggtttcatacagtaagtgcaagagtgttccatctttctcttttttctgaaaaaaattgtgtaaggatggtattatttcttccttaaatatttgatctgttccaacaccacatggtcctggggttttatttctgaatcaatttccttgtggaaaacgttagcttttccccaaaatttttattatgaagaatttcagccactcagaaaaatgaatagaattgtgtaatgaatagtcatgctcatttcctagactgacattttattatattttccttatcacatatctatccatctatttatcattctgtcttattttttgatgcatccctttaaagttcttaattatattattattattattattttattttattttgagatggagtctcgctctggcgcccaggctggagtgcagtggcgcgatctcggctcactgcagcctctgcctcctgggttcaagcaattctcctgcctcagcctcctaagtagctgggactacaggcgtgcgctaccacgcccagctaatttttttgtatttttagtagagacgggggtttcaccctgttggccaggatggtcttgaactcctgaccttgtgatcgcctacctcgacctcccaaagtgctgggattacaggcatgagccatgaagttcttaactattaattcagtttctttgattgaaatagagctgtttaaactttctatttcctcttgtgtaatttttttgcagtttttaaaggaactttaaaattttatatcagttgtcaagtgtattgttataaagttgcttgtactgttctcttactatccttttattattatatctgtaggctcagtgtgatagcctaatgtttgtaacttgtattttccctctatttttcattagtcttactaagggtagatcaattttattagtcattttgaaaaaccaacttttggttcttttgtctttttctgcggtttggctgttttctgtttcagtgatttccactcttatttttgtcattcccttccttctatttactttaggtttaatttgctctttattttctagcttcttaatgtggaagctcagatcatttatttcaaactagtttttaaatataaacatttaaaaattataagtatctctataagaactttagttatatactacaaattttgatatattttgttttctttactattcagttaaaaataattttctagttttctttgtgatatcttgtttgacctgagttatttagaattatgttactttgtcatcaaaagtgaatggttttctagacattgttactgatttctgttgttgtcagagaatgcatgctgtatgacttcagtcctttagcatttaatgagatttattttatggcccagtaaatgttctttcttggtaaatgtaccatgtgctcttgaaaagagtatttattctatagttgatgggtatagtcttctatatgtgttaattaggttagattgttttatggtgttttaaaaatcttttatgttctttttttttttttttttttgagatggagtctcacactgtcgcccacgctggagtgcagtggcacgatctccgctcactgcaagctctgcctcccaggttcatgccattctcctgcctcagcctcccaagtagctgggactacaggcacccgccaccacgcctggctaatttttttgtatttttagtagagacgaggtttcaccatgttagccgggatggtctcgatctgctgatctcgtaatccgcccgcctcagtctcccaaagtgctgggattacaggcgtgagccaccgcacccggccttatgttcttactgattattttgtctggttttcccaacaatttataatagaataatgttaaatattcaactatatggtatggtcttatttctgattatttttctttttttagttcttacaatttttgcctcaaatgtttgaaaatatagccacccggctttcttatggtatttttccatggtatttctttttttttttttgttaattcttttacttttaacctaaacttgtttttatattttaagtgtgtctctgttaagcagaatatagagagttttggttttttaattcagtctgacatgctgtcttttaattgtactatgtagcccatttgtatttaaggtaattattgatgtagttgggtttaagtctacctgtaatcttgctaattgttttcaattgtttacgtttgttgtttacactattgtttctcctttcatgccttttttaaaatttttatttatttatttattctttttgagatgaagtttcactcttgtcacccaggctggagtacgatggcgtgttctcagctcactgcaacctctgcctctcaggttcaagcgattctcctgcctcagcttcctgagtagctgggattacaggtgtccaccaccacacctggctaatttttttgtatttttagtagagatggggtttcaccatgttggccaggctggtcttgaattcctgacctcaggtgatccacctgcctcggcctcccaaagtgctgggattacaggcatgagccactgcacctggcccctgccttctttttgattgactttttaacattaaaaaaaaattatctcctccattgggttttaatttacaacaatctttgtattatctttttgaaattgctctagggatcctaatgtatttccttaatttacctcaatctactttgaaatcatattatactatttgatatataatgtaaaaacctttcaacttataattccatttccctcccatcctttgtgctattgttgcatgtaatttacctgtatttataagcctcatggtacattgttagtatttttgctgtaggtgttcaattgttgttttaaaaaattaagaaagggaaaacaagtcttttatatatacacacacatttaccatttcttctgttcttcattttttgtgtgtgtgtagatccaggtttccctctgtcattacttcccttcagcctaaagaatttctttcagcattgtagtgtgcatctaccagcaatggattcctgcagcttttgtttatctgaaaacacctttattttgctttcattttttaaggatgtgttcactagatatagaaattctcagttgacagtccctcctcccatgctcctagttctttaaagatgttcttttgtcttctgggcttcattgtttctaataagaaccctgccatcatttttattattgtactaatgtatgtaatctatctttttttcctctggctgcttctaagattttagtttttgttttcaacaatttgtgcctgggtgtattttctctgtacttgtcctgcttgggatttattgagctttggggatctatgagtgatttttttaaattcagtttgagaaaattttggccacagtttctttagattctccccattttacctgtactctttctctggaactccagttacacatatgtcaccccacttgatattatcacacaggtcacaggtgctcttttcattttattctttccattttgtgctctgtgatttcgtttagattatttatgttgaaattttttttttttttgcagtgcacagaagcctcaccaatacatgttttatttcagataccatgatagtgtcatttttggcttgactttctttttgatattttatttagagtttctacttatcttctagtataccccatcgctttatgtttatgcatctttatcggtacattttttatgtattcataatacttctttacattatgtgtctgctaatttccattactggatcatctcggtctgcatcttttgattgtgctttcttttgattatgggtcaaactttcctacttcttaacatgtcttataattttttgtttcattccagacattggatgtaaataaacagtggaaactcataggtcatattttgttctgttttgattttgttatgcatgtttcccacataatgtaaaccctttcctcagtttgagtaaggggcttatcattcagattcctctaaaagtcaagtcatccttggagctgggccacaaattaattacattgagtttacccatgtttagcctaaccctctacttcccattccactgcagcctttttagatcttgtcagtatttgagctaggaagggttgagctttaggtatatttggttcaacttagatttcactctggcacagcaatggaatcgcagcactgtgacaatgcggaggactaagtgatttctgcctgcttcccagcctctcctccatcgctactttcatggcaaaaatggaggctggatgggagccagtaggctggctgggctgagtgacgcatcgtgtaggactgggctgctttctcttcatccctgcggtctcccgttttgtggcagccttgctccttcgtctgctaacatgcagaccagcctcctgttcggggatggaagctgctgttctataggaagggctggtctctcttgggaatttaggtcatcaaaatttccttgcatctactggactagtaatctcatagaaatgtataatattgtttctgggttcttctggttgttgccacgggagtgaaaatcttttccatcattctataccctaggtggaagaagtcttgttttctttccctcattaggcttcacatcgaaagtgctcagctaaggataaaagaagaattaatgaacttgtctcattcttcctctcaggtggtgcgaatgccatagagtctcgcataatgaaatactgtttcctaatagcaccagtgtctacttgtcttgtttttcttcatatttctatttgtgattgtttccagagcttctcacacatgagcagagcagtcactacaggatcgcgtggcagtggaagagtattttgcaagactggggttcttacctctccttgcaggcagaaagggccagaactcacacatcacagagttcctcactttcacactggcagccagtgggccattttatttaatgagtcaattaaattttcaaaaatcaaataaaaacaattttagatttatttagtttttttttttttttttttttttttttttttttttgagacagagtcttgttctgttgcccaggctggagagcagtggtgccatctcagctcactgcaacctctgcctctgggttcaagcaattctcctgcctcagcctcctgagtagctgggattacaggcatgcgccagcatgcccggctaatttttgtatttttagtagagatggggtttcaccatgttggtcgggctggtcttgaactcttgacctcagatgatctgcccccctcagcctcccaaagtgctgggattacaggggtgagccaccgcatctggctgatttagttagttttttttatttttaaaagattgtcaaggggaggctgtggaggctgtgataatggtgctatcacaatgggtaagggaagaggaagcctagaagccacctttcggccatgtacagcacagagtttgaatttgttgtcaggagatgtggttttgaggatgccaagagtgaggatgtgctttggaataccctgaggattatgtttgatagtttctgcatcttcccaaagatgggacatcttgactcaatgtgtatcatatttgaccttataatcaccctcagaaccacaaaagaatgtcaactaaatgctgttaaagcaattagattgaatttatacagtattcaagatgtattagaagagttaaaggaaacagcagaatattctcagataaaaataaatcatggtcttcagaagaaaatgaaattaattttagacatgctctgttctagtcatttgatatgttaatttttattggtaacatttgcaaaggcttacccccaaaaaaaggaaagaaaagaaggttgactattttatgtttaaaatgtttagatatattttttaattggaaaatggcttttgtctactacaaagacctcatgtaaaataagcaataaaaatagcattctagtaaaatctaaagaaatcagaacaaagaaatgaaaacatttgcatgatgattgatatggtttggctctgtgtccccactcaaatctcatctcaaattgtaatccccatgtgtccagggagggacccataatcaccacatgttgagggagggagatgattggatcatggcagtggtttcccccatgctgttctcgtgatagtgagtgagttctcatgagatctggtggttttataaggcagttttccctgctcttgctgactctcttgcctgccaccatgtgagatgtgcctgcttccccttccaccatgattgtaagtttcctgaggcctccccagccatgtggaactgtgagtcaattaaactctttcctttataaactacccagtctcagggaagttctttatagcagcatgagaacggactgataccatgatgaaaacaattcacatgtaaataatctttaatgattctatacagattattttctgccattttagattaaggaataatctcaattgaagagagatgtgaataaactgagtgatattctggtactttaaaaataatatctcagcactggcaaatttgaaagaagggctttagaaatactgtatgaatctaggtgttgctttaagagatggtgaaaatcttgctatacatcacagtgatttttgtgatgaaatttaagaagtttgggccaggcatggtggctcacacctgtaatcccagctctttgggaggcccaggtgggtggatcacttgagggtaggagttccaagaccagcctggccaacatggtgaaactctgtttctactaaaaatacaaaaactagccaggtgtggtggcgggcacctgtaatcctggctactcgggaggttgagccaggagaatcacttgagcctgggaagtggaggttgcagtgagtcaagattatgccactgcactccagcctgggcaacagagcaagaccctgtctcaaaaaaaaaaagtagggagtttgcaatattttctgcgataacaataatgtattataggcagtaccataataatgttagaattgatacataaaatttgtggctcttttccaacgataaatatttgcttgaaaaattttattgacagttatgtttgcttctgcttcatcagggaaaagttcttccaaattgaaaatagaacataaattatatggaaatgtagattataacaacataattagagattttgctgaaatgaatgcaggaaaagttattttggggaataaaatataatcatttgtgaacagtgtgtatccttctgctattactcaggcaggcacagctgacggtcactgttctgcagacacaggcaacaaacattgtcagtttggatatttgcttttgtgtggttatctgagaagccatagctttagctctgtttttcagttttgttgttttaaatgaatttgtgtcaaggtgggtggatagaagacattttatttcacattttattagctttatatttattctatatttgggcatgtgtggccagcattggagctcttactctggaaccatgaatattgggtggtgccatggaagggctgaggctggaatggatcctgcctgggaacaccgaaccacataggatgcctggctgtgtgtgagccacagctggagtcattcatgtgatctacctgtaaaagtgtaggaaagctggagagatccacccatctcaggacactgacattcatgcccaaggtagcactgaccagcagggcttcaggagggtcctggaggaggcttgtggctgggagcctgggagagaaggagaatgagggcctgggaccccttgggataggggtgagacactgacctcggtctcccaggtaatggcacgcaaggatcaggatcaggaacttggaggaatggagtaggtgtggtgaaacgttggcagctaggtgggtagggggtggattccaaattgaaggacaaatggcaacatcaccaggaggcctcacttccccagggcagacactacctggcctggggacccagtgtactccctgcccctcaggaagaaactgcatggaagtctaccctgtaacattcgatctacaggggcggagatggaagagcctacgaattttttttccccaagggcacgtcttaatctttacatggcttggggtggcagaagactgcagccttacaggcttgaggagtcagaagataagagtccaggtctaacaggaacaacagagtgaactgaacagagcttttagctgctgcccatcgtgggggagacagagtttgggatttgagtccagtgaaaatacgtttctcttagaagaaaatcaacacttctcagataaagataatagaatccagaagttctacagcagatcattaatgatatccagcatacagtaaaaagtgtgaagaaacaggtatgtaacctgttctctagagagaatgcagacaatggaaactgacccaaatgacctacatattgcaatcagcatgccagaatctttttttttttcttttgagacagaatctcactctgttgcccaggctggagtgcaatggtgcagtctcggctccctgcaacctctgcctctcgggttcaagcaattctcctgcctcagcctcccaagtagctgggattacaggcacctgccttcatgctcaggtaatttttgtatttttgtagggacagggtttcaccatgttggtcaggctgatcttgaactcctgagctcaggtaattcacccacctcagcctcccaaagtgctgggattacaggcatgagccactgcacctggcgcagcatgccagaatcttacatcagctgttctaagtatgttcaaggacttaaagaaaaacattcttataaggaatgaacagacgggagaatttaagaagaaaaacatatgctataaaaagaatcaa

SEQ ID NO: 359 - DNA, 71387 bp, Homo sapiens
aaatgactactggatgaataacgaaatgaagggagaaataaagatgttctttgaaaacaatgagaacaaagatacaacgcaccagcatccctgggacacatttaaaacagtgtgtagagggaaatttatgcactaaatgcccacaagagaaagcaggaaacatctaaaatcaacaccctaacatcacaattaaaagaactagagaagcaagagcaaacaaattcaaaagctagcagaaggcaagaaataactaagatcagagcagaactgaaggagatagagacataaaaaacccttcaaaaaaaatcaatgaatccaggagctagttttttgaaatgatcaacaaaattgatagaccgccagcaagactaataaagaaaaaaagagagaataatcaaatagacacaataaaaaatgataaaggggatatcgccaccaatcccacagaaatacaaactaccatcagagaatactttaaacacctctacggaaataaactagaaaatttagaagaaatggataaattcctggacacgtacaccttccctagactaaaccaggaaaaagttgaatctctgaatacactaataacaggctctgaaattgaggcaataattaatagcctatcaaccaaaaaaaggccaggaccagacagattcacagccaaattctaccagaggtacaaagaggagctgctaccatttcttctgaagctatgccaatcaatagaaaaagagggaatcctccctaactcattttatgaggccagcatcatcctgataccaaagcctggcagagacacaacaaaaaaagagaattttatatcaatatccctgatgaacatcgatgcaaaaatcctcaataaaatactggcaaactgaatccagcagcacatcaaaaagcttatccaccatgatcaagttggcttcatccctgggatgcaaggctggttcaacatacacaaatcgataaacgtaatgcatcatataaacagaaccaatgacaaaaaacacatgattatctcaatagatgcagaaaaggcctttgacaaaattcaacagcccttcatgctaaaaactctcaataaactaggtattgatggaatgtatctcaaaataataagagctatttatgacaaacccacagccaatatcataatgaatgggcaaaaactggaagcattccctttgaaaaccagcacaagacaaggatgccctctctcaccactcctattcaacatggtgttggaagttctgggcagagcaatcaggcaagggaaagaaataaagggtattcaattaggaaaagaggaagtcaaattgtccctgtctgcagatgacatgattgtatatttagaaaaccccatcatctcagcccaaaatctccttaagttgataaacaacttcagcaaagtctcaggttagaaaatcaatgtgcaaaattcacaagcattcctataccccaataacagataaacagccaaatcatgagtgaactcccattcacaattgctacaaagagagcaaaatacctaggaatccgacttacaagggatgtgaaggacctcttcaaggagaactacaaaccactgctcagtgaaataaaagaggacacaaacaaatggaagaacattccatgttcatggataggaagactcaatatcgtgaaaatggccatactgcccaaggtaatgtacagattcaatgccatccccatcaagctaccaatgactttcttcacagaattggaaaaaactactttaaagttcatatggaaccaaaaaagagcccgcatagccaagacaatcctaagcaaaaagaacaaagctggaggcatcacgctgtctgaattcaagctatattacaaggctacagtaaccaaaacagcatggcactggtacgaaaacagatatatagaccaatgcaacagaacagaggcctcagaaataacaccacacatctacaaccatttgatctttgacagacctgacaaaaacaagaaataacaagaaatggggaaaggaatccctatttaataaatggtgctgggaaaactggctagccatatgtagaaagctgaaattggatcccttccttacaccttatacaaaaattaattcaagatggattaaagacttagacgttaagatctaaaacgatgaaaacctgccaggcgcagtggctcacgcctgtaatcccagcacgttgggaggctgaggagggcggatcatgaggtcaggagatcgagaccatcctggctaagatggtgaaaccccatctctactaaaaatataaaaaattagccaggcgtagtggtgggtgcctgtagtcccagctactcgggaggctgaggcaggagaatggtgtgaacccagaagtcggaggttgcagtgagccgagattgcaccactgcactctagcctgggcgacagagtgagactgtctcaaaaaacaaaaacaaacaaacaaaaaaacaccataaaaacctagaagaaaacctagacaataccattcaggacacaggcatgggcaaggacttcatgaataaaacaccaaaagcaatggcaacaaaagccaaaaatgacaaatgggatctaattaaactaaagagcttctgcacagcaaaagaaactaccatcagagtgaacaggcaacctacagaacaggagaaaatttttgcaatctacccatctgaaaaagggctaatatctagaatctacaaagaacttaaacaattttacaagaaaaaaacaaacaggggcaaagtatatgaacagacacttctcaaaagaagacatttatgcaaccaatagacacatgaaaaaatgctcatcatcactgctcatcagagaaatgcaattcaaaattacaatgagatatctcacgccagttagaatggcgattattaaaaagtcaggaaacaacagatgctgcagaggatgtggagaaataggaaagcttttacactgttggtgggagtgtaaattagttcaaccattgtggaagacagtgtggcgattcctcaaggatctagaactagaaataccatttgacccagccatcccattactgggtatatacccaaaggattataaatcatgctactataaagacacatgcacacgtatgtttattgtggcactattcacaatagcaaagacttggaagcaacccagttgttcatcaatgatagactggattaagaaaatgtggcacatatacaccatggaatactatgcagccataaaaaaggatgagttcatgtcctttgcagggacatggataggctggaaaccatcattctcagcaaactctcacaacgacagaaaaccaaacaccacatggtctcactcataggtgggaattgaacaatgagaacacatggatacagggcagggaacattacacaccagggcctgtcagggggtgggaggctgagggaggggtagcattaggagaaatatctaatgtaaatgacaagttgatgggtgcagcaaaccaacatggcacatgtatacctatgtaacaaacctgcacattgtatacatgtaccctagaacttaaagtacttaaaaaaatatgctaaagggccaggcacagtggctcatgcctgtaatcccagcactttgggaggccaaggtgggcagatcacctgaggtttggagtttgagaccagcctggtcaatatggtgaaactctgcctctactaaaaatacaaaaattagccaggctggtggcacatgtctgtaatcccagctacttgggaggctgaggcatgagaatcactggaacttgggaggcagaggttgcagtgagctgagattgtgccactgcactccagcctggacaacagaacaaggagactccatctcaaaaaaaaaaaaaatgctaaagggagtctttcaggctaaaatgaaaggacactggccagtaacttgaatacttgaatctgcatgaaggaataatgaacatggggagaggtagatacctaagtaaatataaagggcagtattaatttttttcctaacctctcttttcctacataattttaaaagacaactgcataaagcaataattaaaaatttaggttgatgggcatacaatgtgtaaagatgtaatttgtggaaatataatataaagggagtagagctgaataagaacaaagtgtttgcatattattgaaattaacttggtattaatctaaaccaggttgttacaaattaatatatgaactgtaatctctagggcaattattaagaaaataaataaataatatatactttaaaaagatacagatttagaattatcctagaaaatatggatttaacacaaaagaaagcagtaatgaaggaattgaggagcaaaaaagataaaagacatagaaaacaaatagcaaaatggcaggagtaagcccttttcagtaattatattaaatgtaactcttcaattaaaaggcagagattcaccaaatagattttaaaatcatgatgcaactattatgatgtctacaacagtttcaatttagattcaaagacacaaataggttgaaaattaaaaggttggaaagatcttccatacaaataaccaaaagagagtttgaatggctgtattaatatcagacaaatagattttaacaagacaaagaaggtcattatattacgataaaagggtccaaacttcacatatttttaatgcatttcaactcctgatatgacacacttttagctctctatttctccttgacactcctgcctccatccatacgttgtcctgcttcatctctgattatcccaattctattcatgttcaaggtttaccccatgacaccctctttcttggaggcactatggctttggctaagtgcccagatccagagtagataaagtatatggtccaaaagtagatgtcttcacttactagctctataactttggggaagtcacttaactttcctgagactgtttcctcaactgtaaaattccttacctatatcaggtttctataaagattaaattagatcatgcatgtaaattataatgtaattattgactctacaaataattagtccttatcatattatgcttggttccatgagggaaattgtaactacctttggcggaaaagacaggcttatccctaaggtgcttaagtagtacactcactgtacatttggtagttttaaaaaaaaaaaacttaacaaatgcttttactcattcatccttgaatgagagacacagccctcagcaaaacatccttcatgaagcccacacctacttctttctctttttagaccaagcagactaatagtatctgggcttcctgacagcttgggaacaaagcatgtaaactcgcctactgtcagcctccacaccaccatgagatggatatgggctccctggggtgtgcagttggtgagggaaatgctatacttgactatgactgagtgccacgttcaaatattcatgtagtactcatgatttgtgttcaagcctccttccatgggaagaaccagcggtggacctgaagagctctgccttcaaacagatgattcactcagaacaggttgctggtgactgaacctcagtgacagggtcatcctttgacacccagctctccaagggcaccttgctcagggaggctaagctcagagcaaaagtgccttttggagtgctagcttctttctaccaacaatgacagatttccatctgtgctgccaaacatgtaagttctttccttaaggaacacttataaaagatgacttccaggccgggtgcagtgactcacacctgtaatcccagcactttgggaggctgaggtgggtggatcacctgaggtctggagttcgccaccagcttggccaacataaggaaaccccgtctctactaaaaatacaaaaattagccaggtgtggtggcgggtgcctgtaatcccagctacttgggaggctgaggtagaagaatcacttgaacctgggaggcagagattgtagtgagccaagaccacaccatcacattccagcctggggaacaagagcaaaactccatctcaaaaaaaaaaaaaaagacttccttttcccagaaaactaagggcccccctacatcaaaattatttccctttggctgttcaggaacaattgctcatctcctttcgattttttgacttttaactcctcctcaaggaagttaagggatgttttttgctattggtaggttgtgcttttctagagggaaatagttctagtattgagatctaaactgagaattgctgattatccatggaacaagcattttaaaaacaagaccagaccctagctcccacagaggacatggttgatagcttagtaccaaagcacaagcattatcttctgagtgggaaagcagatatggagcttccttgcccacctgacacctaagccaacatgtgcagaattggagccctccaaaacttgggcctcttccaaggttctccaagtcaatgaagggcatcattgtgtcagcttgggtcctcctagagcagacaccaagatggaattaaacctggaagagtttattggggaaaatgcctatgaagaataaagaggagcagaagcaagagtaagcagagagagccccacaccgtaatgcaggtctgacccctgtgaaagagaagagggaaggatggaggagtagataggaagagcctcagactgcagagccattctgagaaagtgctggccagactgacaggaagccccagagtacaggtggcccattagaggagttttgcctctggcattccctcttatagcgtcaaatgcatcttgtagtatttaggatggcattctatatttgaccaattatttgattgctttattacctcactcaagtgtgtttcccgagggcagagaccacatttatttttgctcatcactgaatccccagcattagcagggtggctgcattttgtagttgccacagaatatttgttgaatgaaatatctaaaagggttatttttttcatttttatctgaatcacacatcaggtatttttttttcctaaccagtgactcctaagttagatgctgcttgcaccatgctttcattccatttatatcattcttcagctgggttgcgtgatcatcagctgtgccccgccccccaaccctccattgcccgattctgtagtaaagtcttttgggactggccttggacttggacttttgcttcttttgtgtctttactgactatcagtgcaggcctggataaagttcttgttgcagaacttgctactgcacaaacttttgttccagggttagatcaggaaggatagtaaggaaaacagagctgtctccaaaaggtgggatagaaagctgtcctttagaagttaaattataaatcaagccaatcagagcaaagatacaaaatgtctccataaagaaaaataagggctgagagaccttactgagtaatgttactcagtaacgccttgctctatctaaaaatgtccatctgaggagaggcggcctgggtaccataatacagagagcctcatcgacacaaacagatggtgtccaccaggccccatctagggagaagggctggccaggccagcagggatgagtgaacagtacttcctataggttttgacctgtgttgtggaaagagacatcccacattgcccgagcctgatatcatcaaacatttaagtcagacaattcactcttccgattctgattttaggctcactaagccaccttctgactatggggctccaaactgcatggctacaagaagagaatgtgttcatcaggtggcctcgagtccagtgttcccgacagtcttgcttctaacaggaatggataagcttcaggttttggggtcagatggccttgattcaaaccctgccactaacatacatagtaactatgtgaccttgggatttccttcatctttttttctcccaaatgaaaaataaatagattataatataccacatgatagtagggagaaataatgaggtaataatgcatgtaatgcatttagcatagcacttctctagcaaatagtgaatgaaatcagtcagttgtcattctgactttatgcaacagtgctaatcgactctggtacactggaagtcagatgagatttttggccccacaaagtcaaggaccaaacctggaccttgggaagttgccaagatgaaaaacatcaggccggccttgacctcctgatgctctctgttcacatgtgtgatgtctataaaaggtaaccaggatttggcttatctgcttacatctcttcctgtcttttcctgatcttcatcttcccaaacatagtttttatgcagaagcagatttaactctactttgctatcttggagtcaagaattgtcctataaggaggaagaggctccaaggcttgccttttttgttttttctttttccttcatactacagactaaaagtagcatcttctggacagagaaacaggctgttgtttttctaaggtcatcatttggcctgccccactttcccacctgctcttgagggaactattgcaaggacacatacaagcccctacatcagtcacagaccagggcctccatcttgcagggaatgtgcccaaattacaaacaggtaaaccaaagtgactctgggcagatttaatagctcattttggtttcttgttccagttataacagactgctctgtgtttgctctatggcaaaaacttttatgtttgctttgcaacaaacgtacagacagggcaaactgtgtttggagtatggtgtcttaccaatgttttctaaaagcaagtgaatagaaatgcttgcaaaagtattttcagacctcagtggccagcgctgaacaccgctgtaggaatgtccatcaaacgttgtggccatgctccactctaacaaaaacctggttccgtggcataattgtgggggctaattgtcaggctaagtttcagacaccttccaaaaaaaattgcagggcttcctcagtctttaaactccagataatattgtccaaactttgacaactaacctgttatcatggagatagctccaagttgatggactggccattagagaatgtctatcaagcatccaggtaaatgacttggttgctgccctcaaggaacccacttagaggctgtcagaaaattttaagtattttcttccttctattgttcattcctaaaattctggcagtaggtatgattattattattcccatcccacaggggaagtaattaagtctaactacttgaatattttgccccaaatcactgacagtaagagacggccagacactgaaacctggaatctctaaatgtttagatattgatgggcaccgcttagaccagggagtccaaaccataggcttgctgttccagtttctcttatcggatgaagggacccccatttcaccgacgtcattgacttttgggttctccgctgaccccagatgagatgcctggtacctcatggtcaagtcccctccaacggggactcctcagaggcttggtcccagttgctcaggctgccatctgcctcctcaggccagagcccgaggcgccgccagcggtcaggtcccgggccggctgccagccacaggcccaagtaaacgctgaatgaagggcagatggaggaacctgtcccggtcggccgaagcgccgcgggcgcctttccacttacggcgggcctgcccagcctcccgcccagcccgggcccgggtcccgccgaggcaggtgtgcgtggcggactagctctcgggcactcggctggcccagctccaccccgaacgccaccgggccaggccacgcgcagacccgagcccggggcccccgcctctggctgccggcccgcgcccgccgcgcgccccgcgttcactgcgcgctcggccccggtcccgcctcccggagggtttcgctttcgctttcctgccgatgtcgttgaggaaaatgaaagcggtcgtggccaggactggcgcagctgccgtttcaggcgaggggcgcagaatgcagcggccgccagcctggagcgcgggccctggggccgcaacccgcgccgggcgaggtaagcacagccccttcgcggccgcctcgcgggctcctccttgcggacccggcgggcccgacgccaggcgtttgacccgggcagggtcaggggttctgccgtgggggcggggagggcctgagaagcggcacccttgggtttcgtggctttgagcctccaggccaggctggaagacctgggaggcctcagacaagcgtgccaaggggctagcagcccggggtcgagctggaaccgtggcaagtcgggccacctgagcacgcctttcccttttgtagagcaccgacctccctgggtgttggtaaaaatcaaaagtgggagggtgtacgtaaaatgctgaacagaatgcctaacctgagctcataatctactccctctgacctgtcagactcatttttcccactgggccccaccccatacctcatgtagtttgcttaagtttcctagatctggtgcacctgggggcacttggagtgccttccaagtgttccttgaccgagcaagctggcagctcatctcccttgatcacgggcatggagagcaactaggccaggatgtggcccccttgccctggccctgtccatgtgaagtcagggccttactctgctggggcccccatcccggggctagcatagatgtcagggataggtgcactcacagaccgagtccttcccagaccaggaaatttccagtccactgcatctgccagcagaagcatgaaagatgcgtgccaccttgtctttgcccttcgtcaagtatagccaactcattcttggtatgcaggaagggggttccaccccagggctgtggaaacagcccctgcccttagggcgttcccatcccctgaagagagaaaatatgtattcaagttacccatcaggcaggttgtgtagaacaaggacaggtgagtgaaagagctaagagctgagagtaaagtgactaaatcatcagaaactttacatttaagttatgacaggttttgcaggccaataccaagaatcccctttaactcaatttttgtctcaataataatgaattcagcctaatcacacagatctgatcatacggcccattactgaaacaaaacttgaatgatctttactttgagaaaaccatctgaatttgacaaaagatggtctaagttcctaagtttcaaaacatggagtccgccgctgccctacctcagcaggatggtgttgagtactgattgcttttagaaaatgctgctcttgccgggcacggtggctcacgcctgtaatcccagcacttcaggaggccgaggcgggctgattacctgaggtcgggagtttgagaccagcctgacaaacatggagaaaccccgtctctactaaaaatacaaaattagccaggcattgtggcacatgcctgtaatcccagctacttgggaggctgaggtaggagaattgcttgaacccgggaggcggaggttgcagtgagccaagatcgcgccactgcactccagcctcggcaacaagagctaaactccgtctaaaaaaaacaaagaaagaaaaaaagaaaatagagaaaatgctgctgttttcatgagccagaaaattagatgcacttccattcacattccattggcatggactagtctcatgggtctcacctaattgtaaggtggctgggaaatgtagcctggtggtgttcccaggaggaaaagaacgagagactggtgagcactagtaacctcttccacaatcgactaatgtggtgaattactttatcatgatgtatttgtaatacactttcgtatttgattagataatattttatttaggagtttaacatctatgtttataagtgaaactatcctgtatttttctttatttgtacagtccatatttaacatttcaaaatcaagtaacaaattgggcaatgttttctctttttttctattttctaaagcaactccattaagatagagattttctgctccttggaagttagtaggaggcacttgtaaaatcttctgggtctgaaactctatggggaagaggtttcaaaattatttgagtctcttaagtggttattcacatttttgtgccaaatttggcaatttttattgtctagaaattattcatttcatctgtattttcaaatgtattatcatgtgtttatattattcctttataagttttaaaatgtctgttttatttgtcatttcttcctttttctgtaatctcatttttaaaaaatcttctgtcagttattcttgatcagtctcactagaggtttgtctactttcaaataaatacttcaagttttgttaaccaccttttttttggtcctctatgtcctctattttgctgattctgcccttatgtttattattccattttttcatgtttctttagtcatatgcttttgtaataaattcaaacagtatagacatttgtaaagtgagacaggaaagtccacttcagcctccataggcaaccacagatatcatattggtgtgtttttctggaccctttcctatgcttatacaaatatttttctacaactttctaaactgaaactcataggtaaactgctctttataggcaaccacagatatcatattggtgtgtttttctggaccctttcctatgcttatacaaatatatttctacatctttctaaactgaaactcatgggcctctttctgtggtgtatacacacacatacacatacatacacacacatacacatccattaaaatggaatacataccataatttatccattttccatttatgggcatttagggtgaaagtcttggtcttttaacaatggaatttaattcattcatatttattttgatcactgataaatgtggtcttatttttgccatcttgttttgccatgtatttatcatgtgtgttttttttttccttgtgactctatggattcatcaaagtgtatttgtcccctgtttcttctttccttctttttattcagtgagttggaagttctatatcttacaataggccatcatttagttcttaagcttagataaacttgtatttttgtctctggcaaaaattaatcagaacctataacctccttccaaacataataaatctttttttttattttttgtttttgtttttgtttttgagatggagtctcgctctgtcacccaggctggagtgcagtggtacaatctcagctctctgcaacctccacctcccgggctcaagcacttcacctgtctcagcctcccgagtagctgggactacaggtcccaccatgcccagctaatttttgtatttttagcagagacggggtttcaccatgttggccaggatggtctcaatctcttgacctagtgatccacccgcctcagcctcccaaagtgctggaattacataagtatgttttctcacgtctctttttccttaccttttccccacaggcacatatacacataggtatctgcctgggaattattaaaataacctgaacaattccaattgttattaattcttcttgcttcaaaatacaatttcctttttctatgttagaaatattaacaattgcattaatctacaatctaacctatttgtgcaattgcatattataccaggataggaaagtttaaacatgtatttcttttagacttttcattgaattgctgaaaattcatagtgaattgtatcttgagtaatgcttctctgagtctcttatttcccaaaagtatactttggaatccatgcaattctgatcgttgtttgacctttgctggcacaaaggcattctgaaatatttgcaaatgctaaagtcacttcctcatcttttacagagtttacttcagcttggtgaaaccaagtgcagtatcagtttgttgtaagcttaccactaattaaaggttcataaaatagccctgccctagggtcagggactagctagaagagcatgaaaatagcctttgaagattcagctgctggatattttacatcaaaaagctgaaacgttttaactattttaatattttgtttatagtacttaatatttgtgaacgtgaagtaaaatggacacagtcatagtaaaactgtggtaaaactaacttggatggtgtttgggctgtggttatcagaagctgcttaaagtgtccatgccttttatcccagttctacttccaggaatatgtcctaaggcatgttttcatatgaggttatttcaggtggcgcagggtaattctagttgggacacatttgccacattgtctaacactgactcacagtgagaaagttattcccatgctcaattccttttcagtcttctgatcaacggaaggtgaaaaactttagcttggtgctagcatacctttaacacctctctaagcctctctaatctcccattttatataaaagaatgggcaaaggggtagcagtattttgactatattttaaccacagtgtttttttattccaataaaacctattatgattgccttcatttatggcatatgatgttggttttccacttaaataaggtttgtttgtttgtttgtttgttttttgagacagagtcttgtcctgttgtccaggctagagtgcagtggcatgatcttggctcactgcaacttctgcttcataggttcaagcgattcttgtgcctcagcctcttgagtagctgggactacaggcacgcaccaccacacccggctgattttttgtatttttagtacagacggggtttcgccatgttgcccaggctggtcttgaactcttgagctcaggcaatccgcctgccttgttttcccaaagtgctaggattacaggtgtgagccactacaccgagtcaggtttgcttttaaaatacatttgtttaaggacagaaatgagttgatgtaaagagaaatgttaagtacattacagatggtaattaattatagcaaaatagtaatggcaatgcatggatgtaggaaataggaccctaaggaaataatcagagctatagacatagatttatatctagggatattcccgtagatgaggaggttcctcccaatgacttatgttaccataaagttagaaactactcagttgttcagcaattagggattggttaagtgattttcctactttcatatgatggaatactagcattatgaaaaactgtatttaatacatggaggattatatactgttatataaaactggttataaaagtatatacagtattgtaattttgttaaaaatgaagtatgagtgtgtgtgtgtgtgtgtgtgtgtgtgtgcgcgcgcctgtgccgaaatcaatggggaaaaaagactggaagaaaatatttccaaatgggttatctctggatcattggactacaggagttgtttgtgttttccagtaatagacatgtcacttttgtcaccagaaaaatatatctatttttaaattaacatgctcctacactgacaggactacctggtattttgtcatctgcaggcattcctgggtcctttcatgttcttacaattcagttaggtccctgtggcctgctgcaacatcatggggaaatagtacggttaagacgtcattgtcatctctcagtacagtccaaggtacttggttttggagtgtgcatatttatatttttggagtagaatgggagaatgtttctaaaattctctcgaataatttttattgctttttcttcttgacagctccattaaacaggaccaaattaggatcccattttttaagtaggtctggattattaagcaagaatagagtagacgctgagtctcctagtttcttgtttagtctttctttaatttctgcattttctgctgaccatgaagtttttagatgttagatttaatcatggttctgtatcacctgtgttggagatgtgtatatttaaatctggacacctctcttccagaattacaaaatctctgttcacggaaaaaaaaaaaaaaagttcgctgcaaggcttaatgcttggcagaaataattgctaccttttgcctagtaaaaattccccacgtgttctttcttagggcttgttcctggagactcttgaacttttttgtgggaatggggttggcaggttaagtgagtaaatggtgcatctgcctgggagtggtctacagccctggtgtgagcttcctccttctgtaaagctgctgggctgtagccagggtgagccagccagggcctgagcctgaaagaggcctgttgtggcattccagtaacatctgccagattgcagcgagacctttgactggtcagctcttcccctgctggggtccttcaactgcaccactcctctccatccccacggccaccactgtggtgcaagctctcacacctcttgcctggaccacagcagtgacctctagctggtccctgcctcgcctcgcccttacgtccagtctggttttttacaggagctagtatgtcctattctcctattgctgctgtaacaaattaccacaaaatcagtgccttaaaacaacacaaatttactcttttagaagtcctgaaattaaggctttggcagggctgcgttccttctggaggctctagaggagaatcgttttgttgctttttccagcttctagaggccactgcattccctggctcagggccccttcctcctcttcgaagccaagtctttctcgtgccacatcattctgaggctcctcatctgaagtcagatctccccctgcctccctcttataaggacacttgtgattatgttgggcccacctggataatctccggttctcaggacccttaactcgatcacatttgcaatgtcccttatgccatataggggaacatacacacaacctccagggattcacacatagacatctttggcagggccattactcagcctacatagataatcttttaaaagtacacatctaaatgcattaatcctctgcctaagacccttgtgtggtgctccagttctccagggttaaggctcgaactcctcttgtggctgggagtgtcatgcaagggtcacctacactgcttctccagcttcaccctgcctcctgtccctgccaactacccatgatccagcctgtgcacagggtgtgcttttgacagggacactgcttgatatggtttggatgcatgtctcttccaaatctcatgttgaaatgtgatcgccagcattggaggtggggcctggtgggaggtgtttgggtcatggggctggatccctcatgaatggtttggtgccctccccgaggtaatgagtgagttcttactctgttcaggcgagagctggttgtttaaaggaggcttggcacctcctcccctttcttgctccttcttgtgccatgtgacatgccagctccccctttacctttcaccatgattgtgagcatcctgaggcctgaccagaagccaagcagatgctggtgccacacttgtacagtctacagaactgtgagccaaacctcttttcttttctttttctttttttgagacggattctcgctctgtcacccaggctggagtgcggtggcacgatcttggctcactgcaacctcagcctctccagttcaagcaattcttctgcctcagcctcccaagtagctgggattacaggcgtgcaccaccacacccagctaatttttgtgtttttagtagcgacagggtttcaccatgttggccaggttggtcccgaactcctgacctcagatgatccacctgcctcagcctcccaaagtactgggattacaggtgtgagccactgcaccccgccttaaacctcttttctttataaattacccagcctcagatattcctttatagcaatgcaaaatggactaacacattgctcctccccacactccatttcaggcctccccttagacaaggtcaggcctccttgagatgctctcacaaggactacatgcaattctgctatcacacctatcacagattaacatctttgcatttatttaggtgattatttgactaataatagatgttcctcttatgtaagtactccatacaggcagagaccatgtctatttcttacccacaattttatctggcatagtgcctggcatgcagctgtgggcaagaaatgacatggttagtaagtccttggaaataagtgaataaatgaatgggtattaacagcattgtcattgtgctctatctctttttccctgctttttcttctgcatggcatttgtctccttttctactgttgcctccccgcactggaacagaagcttcgtgagaacagggactttgtcttgtgtgttcgctcctctcttcccaggtcctagaacagtgtctcgtccataacaaacactcaatgaatatttagggaatgaatgtctgcaagatgctgagaatctctcatagagttttcatatgtgacccctctttgaaattgggtattatcaagttattcattttaatgattcaacctaattcagtaatcaggcaaattggcagagacctaaaatatttacccgttgttgtgaggatgaaataagtaaacaagtgtaagttatttagagcagtgtctggtaaccacagccctgtgtaagagtttgctgctgttgttaagaaatgcttgacttcttgatatcttagagtttttgctgactctgctgcctgtgttgggatcccaagcagaaactgtttgtggcccagcaggtgttggcactgggtgagtgcttctggctcttgtcccacgacgggcatccaggtcttccagcggcctgaggatataggaggggcttcaggcggatgattggggccgttgcttatgttttttccttgtttggcctgcaggtggcagcacaccctgggccccccactccccgccgcaagtcctgaggatggccagcagagaaacaagaaaatggactccctggctgctggagagttgaatgccagccaccagccatgggtgagtggagagcctgaccggagtttttctctaatttgttctgcattatttgtgttttgatatatgaattggtgtaaatcacatgtgttcaattttgaggccatttgttgatttttgcggtttatttacaaaaacaacaaacaatagcagtgaaaccagaattattcctgcaatgtttcagagagtatgagggacaagggcgcatcctctgcattgtaagtgtgacttcccttcccttctgcatcttgggcctgtctcctttgccatccaggtaggaggtatccacccagaatagttcaacaagtgtgtggcaagctgggagtgtgaggtgttcttcacggggaccctgcagtccttcttccagtcactcccagggtggactattctgcactgtcatgcctggcccctaagaacccagggtttccatctgcctgcacaggcctttcagccccttggtggacttctcccgctgaccctcccctcttctcacccctattaatttcacagctctatcttatttatcccaagatcctatttgtgctgcattctgagcacttgaatgaggattgtttattttctgttttgatcacatttgttagctttgtgcttagaataaaataatttcagtttcataaatgggaataagcccttatgtcaagggccactacatcacttcttggcattccagtgaggggtctagtgaagagcttccctgaatttcagtacctttcaaggcctctcttgaaagaatgtggaattaatttgggtggaggcttgtgcatggacttttttctgagtgtatttggccagtgggccaatggggaagcagaggcatggacagagagaggaatgcggcagaaggagaagctggggctgcaggatgccatttgctgtttgtatggcttcccatggcccactgtagtggctagagggcactgccaggaatccttcatgtggctgttgcttgctgttggggaacatgattcagagctgtgtagctccatgtccagttccactctgcatctcactcacaaagctctagcgttgggctgctgggttttggtgaaagcaggtgctatgaatatattgaaggacaaatcagtccctaagggacttcgatagacgcagtcctaaaaacatttccgggctggtttcttttttttaaacaccagttaaccgttttcagtttaactgtgttttccttcctgaaacctttaagtgagactaattggtatgatttttttttgtatgctttgtttttagggagtttctcaacttgtcaagtctgcgttgcagacagagatgaaatgatttttttttcccacacagaccaagcatgcagaaatgggaatgatttaagtttgtctttaatttaatttctatatctttcttttcctttccttgggaaatagaggaaatacttgggggcattttcaccaaattgtaacttgtaacttcacaagagcccatcagcaggaatttctatgcgtgttttaatgcctggttgggggagacatgaaatgacaacagacagttgccctcaaggatcctttgttctgtttggggaatcaaaactgtgttcctccctgtaacaccaaatactagagccccaggggcaggtcccatcatgaatgcccagtagtcagtgccaaaaaaacccaagtcagggaagactatgagacctgcctctggggctctagtaaattcagatgagagaaaagaaggtgggtggtgtttccaggcacacaggtgtgagaaggactagggagcacttaggtccaacttgaacattatttggaggagtgcagagagattgtattggacaggttggttaaccagatttcagtggtggtgagagtttgactatcaagccaaggagtttgaatttgataccataaggaataggaagtggccgggcgcggtggctcacgcctgtaatcccagcactttgggaggccgaggcgggtggatcacgaggtcaggagatggagaccatcgtggctaacatggtgaaaccccttctctactaaaaatacaaaaaattagccaggcatggtggcgtgtgcctgtagtcccagctactcaggaggctgaggcaggagaatggcgtgaacctgggaggtggagcttgcagtgagccaagattgtgccactgcactccagcctgggtgacagagtgagactctgtctcaaagaaaaaaaaaaagaataggaagcacggttggccctccataccagcaggttctgtgtgtggacctgtggatacggagggctgactgtgctacacattttttgtttgtttgttttttgtttttgagatgaagtctcactctgtcacccaggctggagtgcagtggtgcgatcttggcttattgcaacctccgcctcccggatccatgcaattctcatgcctcagcctcccgagtggctgggactacaagtgcatgccaccaagcccgcctattttttgtatttttagaggagacggggtttcaccatgttggcgaggctggtcttgaactcctgacctcaagtgagctgcccacctcggtctcccaaagtgctgggattacaggcacgagccattgtacccagccctacgtcactttttataaggaatttgagcatcgtggcttttggtatctgaggagctgtcctggaaccaattcctcgaagatgctaagggacaactgtaataggcttctgaatgggggacaactgactgttttaaataggaacttttatttccattttacatctgcttttcaaataatgtcttttcaaataattctccaaggtcacaggttggtgggtggggcttagatctgccagactccagagtccatgtacacgctaacccctgcactggcttgcattatctccagacacaggttggcctgcatgtgaccaaggctccacccagccctgaccttggatgactctgagtctatacatagctgcatttgcgtgtcagcctcactccctgggctgaactgtttatagggtgaaaggggactttgggtaagtcacttccctgtctttctgagactctaggaaatcaggggcaggaactcagctatgcatccatggtctgcacagcagcagcccagataagttccaagagctgcagaggctgtcagagaagcttcagagctgtaggtccctgggcaagtctcctccaaagtgggagctgcagggctgatgcggatccaggcaaggtgacagcacagcacaagttgactcctgttactgccctaatcgtccagcataggcaggaggagttggggatttgaagtttgaagttcgaggagttgaactttgaagttctttatgcattcctttgtcattccttcatagaatattcagcaaataacttagcacctaattgttccaggtctggccctgggccctgggcttacagcaaggaacaaaacaacccaagtccctgccctggtgccacttacattccagttggggagacagacaatgtataacacaatgttaaggagcagtgaagtagaagaggaaagcagggagaggggatagagtactagggccagagacctagaggtccaggaaggcctctctaaggaggagcatttgtgcagaaacctggcatttgagctagccagggagctagcaatgtgaatgtctaggttgcaggcagagggaatggcaagttcatagacctgaggtgggattgcctgggaagcagcgagtagggcaacgcattagggagagaggagagtgggaagagcccaggctgcatggggccagaccttgccaccttgccagctattgaagaaaggtagggttttgttctttctccagctctaaggtatgtttcaggcatcgttcctggctgactggctctaaatctgcagccctcccagagagcctttgatcaacccagtatcctcctatatcatcccttttctggctgaactaaccactgttcattctgttgtctacaactatgaaccctgcctaatacagagctttggaggaggaggagagtgccaaccagctttataaggaaattaaatatgtttttaaggttggaaaagatgcacttggatattatactaaaacgtttaaactttggtagaaagggctccaccttggccatgcaaaggggcctttgtcatcactgtttcctcccctaggagccaggaggctggggtcagtctcctccttacctgccagccaggggcctaagctggtcacccttgcttgaccttcgtggtctcacctgtataattcagttagttatattattcctgcctgaagggaaagaggaatgacttattgagggtcatttctatgttggaggtctctgatgttgcgaataagttccacagaaggttcttgggggttaggactcttccctgaattatgtctgggcggggcagggggtgatttatgtttattttatgcatcctccccacttttttttttttgctttcaaaacacttttacctctgtccttgatctctgtaaaagggctctgtatgttacagtggttaagagcatggaaaaacagatgtggtactgagtgccaggtccacctttgctaagtttgtcactttgggcatgtcccctaaccagcctgttccacagtttcctcatctgagaatgggtatgaaaatagtagctactgcaaagggtgctgtgagaataaatatgataatgcacccaacacaattcctgacccagagtacagcctccctgaaggtcagctgtaatgattgtgatatgtaatgattcccacccaacaggcaggagagcctagaccatggaggctaggtgacttgcctatggtcacctgataaagccagagatagaagccagggctcatggagtcccaggccagtggtctttccccaggattcctgttgttttttaggaggaaatgttaatatagacagttctgtctgtgtctaaccccttagtagctggttctggcttttgtaggggattgggggacaggacttcctcagcacacaagaccctcaatcctaggcattagcccctctgggtggggcatttgtgggagcaggggacatggcatgactccctctttgttctgtgagaggcagagggggttaggagtgctgtgctcccaggactctcctcctcccaccgccacctgctgcctgccagatcctgtagtccttcctggggaatcatcacagaggcctccaggaacctggagtggggagggagcaggacaggcaggtcctccctcctgtggcaggactctgtggctcaggcctgggaactgagtgtgggaggaggtatggtctccctaaatagttgctcccagcgggccatttggaaagagaaacagacttttgcgctagggggcaggggcatagataccctctgcagctgccctggtcaccttgttgcctgaagactgttcccagtggtcttagatacagagtggtggcccttgctcctgtcagagtaggtttaaagaccacacaggtagatttctcccagaaacaacaccacttagaattttccttcagggagcatagcacaggggagatgtccacacacagtcatacctgtgtttgaatcccagctctgcctttttgcttgtgggtggtcgagttgggagtgtgcttgagaaattattcagcctcttcaactctcagtttctacctctataaaacgggaacaagaatacttacctcaaagatttgtggtatgaattaaacaaaataacctgtttgaactgcttaacatgtgtgtgcacgtggtagcccgtggtagctatttttatcatcatcatcatcgttaagcatgtcagtggcctctaccagtctgtgggtggaagcagctttcatgtgtggctcagcctcatggaggctgtgcatttgctgtgactcaggattctagaatgactgagccaaagatctcaaacttctctttgctatattgttatttgcagtcacactcacacactcagttatccagggtgaataattaagtttctgttgatgtaggttgccatgctgtttatttccctgtttctcttctgtttagttcagcgtccttcaaagaagacaatagttaagtagctaaactatattgagggcttagtatactaaaagtgttacataaattagcccctttcattcacataaccagatttagaaacagagtttcaataatgcctaagactacactgctaccgtgcagcagacccagcagacccgggcttcacatgtctcattccagagcccacactggcctctgtactacccgcttttaaacaggacagtggttgaatttggtgaccttgagagatcaggtagtctggtctttcttacctcctttccaggctgagctgaacatcacagaggggaatatctgtgattttcttgagaaactttacagcgaaagctgctggctctgcccttggtagccatttttatggtctggagggacagtggcttcttcctagagccactttgcagtgttcccttgaggccagctgtccatcctcgagagcagttaggaggtccatgttgagagtgtgctcagtccttagttggaaacctggaaacgcagaccatgagggtggtgtcccactggcacatggcaggtggggccttctgccaccctggctgtgtgtgtggcgtccagtgcgagtggtagccagacatcatgcccacctgccctcgagctgcttgcctgcagctggctccttactcacagatctgcatccatccggcgctggggagcagaggaagtggtctgtgggccagctgaattgcccaaggagctgagtcactggctgatttcggcctgccctgcagtccctggggtgactatggtgataggggagagaaatctgcttatctaggggccttgaagcctgagaactcagacactccaggagggtccttcatgccacagcatttactgagcacctactgtgtgcctagagaggtcatgcgagagacctcagcatgggagtgtgtgttgggctgcctggagcccgggtggctggtggccaccagggagctccactgccttagaaggatctgaggctggcagaggggccaggttggtgtgctgctgtttatctgagcagattccatgacaaccaggagataaatgcctgaggtcaagcaaaccctgaaacaagattaggtgtctgggtagggtgggacctatactgtgatttggagacccttaagtgaccagtatcttctgggtgactatttagcatgcttaattaatttgttaattaactaatgccccatcctactccagaaaggattgaaagtgactcaattcagcaggtcttttagagggaggaaggcatcctgagtttgctgtgagtgaaaagctagggtttattcaggccccgagagggtcatttaccagctgccagcccagctccacactcctagggctggctcccatgaaagcacagcctttgctgccaaagctggtttgcagcgttgctgggatcgcctcctggtctctttgcaacaagtggccccgacaccttcctgctttgatgcaaatcatgtgacttaagagaagcaacctgacctcaattaccaggtgcaaacatcagtcactgagagtaagcaggaggcctccagtgtccctggttgttttagcctccagcattaaatattaagagtgaactgttcagggtgtgataaaggctgtgtctcacagtttatgatttccagtaaaccagagggcttaaaggaagggccagggacaggtgagagattccagacctggccctctgctgagctggtagagcaatttctgcaggaatgggaggggcagggagtgagtccacagctagtaaagatttgccctgttctgtggcacagctagagagctgcattgtctgcccagcaggccccagaaagtgaggccagtttctgctcccagccaggcagctgcatgcactctcagcatagggatatgggaaaaagaagaagtgtgatgtgtcctcaccgtgctggccactgtgcctgcctcctgctgggtgccaggccagccaggagccctgggcacattcctctatcagtgtaggcaatgggcagctccaactgctctcacagaaagctagaggaacatttcggtattcagagccttcagacacatgggctggggttgctcagcatctggcctccatggggaagtccaggccacaaggaagctgcaagcaggcagcatatcccacttaggcctaggaagggaactgaggtccccctcccaccctgcaatgtcataaggagactcagccctttctgagtttctctagagcacctaatctgatagcagtgatagaagccatacatcaaattaactcagcatgcagtaacagtggcatgcattcatttaacaagtatttaatgaacacttgactctctgccacacactgtactagatgctgggcatacagtagtgaacagacaaggtccctactcaaatggagctacagcataatggtggagatagaaagaaaacacagaaataaaacattggtgctagcagtaagtgctctctaacaaattaaaatagactgaagtgtaatcaagtgactgagtgactgctttggattgggtagtcaaggatagcctctgaggaagtggcatttcaggggatacctgaaagaaaagactagaaaagagcaggtgaaagagcagactctgtcctgtctgctgtaggcgcaggagagccagagtgacaggaggagaggaagaatgttctagaacatatagcttggttaacttgctttggtgtttgtgacactttcttgcttattttctgaattacgcgctaaaccttcattcagtaaagttttattgcatgccctctgagtgccaggaattttgccggatggcattaaaatcaagatgaatatgtcaagtctcttctcaaggggtgtccagtgtgttgggagagatgagccaggaaaccaagacagtgtggaagtgctgtgagtgagagaatcaaagagggctaacaggagcatacagaagggcttcccaactccccgtgggcagtccagcagggctcccagaggagaggacacctgagaggtcctggaggctgcggaaggttagccagaaggagaatgtatgtcccaggcacagagagtggcctgtgcaaaggcctggagggtagggtaagcaaatgagagaaggatgctggagggtcttggagatggaacaggtggccaggaatcacagaaagcctggaatgctctgctctagagcctgaaccagacactggagaatagcttgcggaatgaagacagattcctaaggggccaagtcagcagctggtaaaggctggaggaaaggacactgagtttatgagtcactgttcagaccactctctggggctcccttcctacctgggagctatcccaggcgacgaccaacacactctagccatttcccaaatcagaatagaacattcacctgacccaggcacccaggcaggaacatgcaggtatttaaacatccaggttaacacatttgactacttggttttgggggagcaggcatgatgggttaagacttattaatctggaagtaagcactaggttttcctttagggcaggaagaccttccttgcaaaatccctttctggcaagtctcactgggctgtaaaattgcaaacgcactgttatcacatcccaataagtgcatgatttgattttaaagtaagataatcttgcgttcattccagcctcatagggaacatacagttttctccatccttttctcttacttactccccttcctctgtttccctctgtcatctctaatccccagagtatctggttatcttttttatacactcattactccttcaaaacactccaatatagataacaatacttgattatttggaagttatctcaactatacatgagctgatgaaaaccaggaagtaagcaataagcaaaacaggcagacagagagtccaaagtccaaaataaattaacatttgttgaggacttgtggacttactatgttccaggcattatgctaacctcatcacagtctctattttgattaatcttctgtttgcccctgcagatccactctccgtcctctctacctgctctgggttgggaggctgacctgaatgggccacatcactcatctatcttgcctctggattctagttagatttggtccatggggagcattagcaagagatggaaggactcaggaagatgaggtcaggagttccccgaggagggcaagtggttaagttattcccccgggtccctatcaggtcgctttaggccaactgcatcctccactggagcccacagctcctgccagacacccttccaatagctgcctcctttgggtccccttacccatttattcccttccttcataccttcaggttacaagtggtaacagctccccattgttgctagcccccatatgcttcactgtctcatcttgatttccctgagccctccccacacctttgtaaacagtcccagtccaagttcaccatctgtttcctacccaacttgatgatacaacgaggtaagcactgtattagcccatcttaagacaagtaacctgagccccagagaagtttaataacttgtcccagaacacacagctggtaaaccacagagctaggtctcaaatccaggtgtttctgattccaaagcatgggcacgtttcgtcattatatcatattgcttcccatgccctaaagatcgtctcccccagacttcatgaaacatcagtttactctggtatttttcccaatcagcaaccatttaaaaagagcaaacactagaagtaaatgctttcaaataaatcgtgagaggtaactgatgctggtctggattgagaaaggcacaataactattcaaaataggcctatgaacttcagaagcctgtggaatccacacttgccgtgtcctctgcactttccttctctgtgccttctgaagggtggtggcattgacatcaccatctgtgggagctcacataaagtcctgaatctgccaaaagacataacttgaggttgcctaacatcacccccatgtagtatccaaacactggtccttattttagtggctggttttcatgtttaatttgtgataccccaagaatacgacagaggttctttttttttttttaagttctgaaactgctgattcagtttgcatgaggatattacttttttaaaggaactttcaaaaacacctaaaatttaattttagccatagtttagttagagaatccctgggtacagaatttttctctacttcccagcatttacagaatctgatgtcacttgggagttggagggagactttgggggaacagccaggaagtggcccttgggtccttgagccatctagttggggagaaagggccatttttaccctgaaactctgttctgttcatgtgcattgtcccaaggttcttatgaagacagtcggtccttatgaagacagtcagttcttgactgtcttcatgacttgtctggccagctcttcaataccttagccagacaagaccataaaaggccacctgctttacttatatttgactgttggtaaggttgaccctgaaatcttttacatttgtatttcttttgataattttgttcacatgtatgttagaaactgctcattgctctacagtatccattccctctttcttagtaacaaaaccaattttttgctgatcccttttccacccagctgaaaactacgttcccctggcaattttgcagcaaagtgtgatcatgtggctgggttccggacaatggatgcaagtgggtgtcatatgggacttcgaagccagctccttaacaggagggggtgtgccctttattcaccctcctttctccatcctactttcttaaatgaggatgtggtgactatcactctagcaactaccacaagacatgagaatgagagctgcactttaggaataggggcaggatgagccagaagaagcgtaggtccctggtgacacctgaagtcaccaaaccagccctgaactgatcatttctagaccttttttttcagtgagagaaagaaagaaaatcccatcttgcttaagccactattgttttctgttttatgtaactgaacaaaattctaaccaatacaaaataatgtttataatacacaataccataatcaatgctgtttttctttttctttctttttttaagagacagggccttgctttgtcaaccagactggagcgcagtggcacaatcatagctcactgcagcctcgaactcctgggctcaagcaatccttttacctcagcctccagagtagctagaactacaagtgtgcaccaccatacctggctaacttattttttatagagatgggatcttgctgtgttacccaagctggccttgaactcctgggctcaagcaatcctcccaccttggccccctgagtagatgggattacaggcacataccaccatgcccagctccagtgctgtttttctttggagagtgtatttttattactgattacaaactcatctgtgttttttgggttttgttgttgttgttgttttgttttttgctttttttttttatatgaagtctcactctgtctccttggctggagtgcagtggtgcaatctcagctcattgcaaactctgcctcctcaattccagcgattctccttccttaacctcctgagtagctggcattacaggcgcaagcctccatgcccagctaaatttttgtattttagtagagacacggtttcaccatgttgcccaagctggtctcaaactcctgacctcaagtgatccacccatgctggcctctcaaagtgctgggattacaggcatgagccacacccaaccatatgttttttatatatgaaggacatgtcctttctgtcagtgttgctgtaaatataattccttgtttttgcttgtcttttgattttgtttatgagttctgtttttaaagtcttggtgtttgtttttaatatggctaaaatttctttaaaatgctgtttgctcttttatccaaaattcttccccccttagataagtattcaccaatatttttctggtttttcaatgacttcactgtttacaattagcgttttagtccattggtgagtactgttggtaagtttttaatcttttgtaggtcataagtgtttaggcctaaatactctcctgagttctaaagcaggagccagcgtcacctcttgtttatacaccctgtcctggcctgagcctcctgaaggctggcacattcagcacagacccctctcactcctacttcccacccaccgcccttctgtgggtcacctgcccactactcaagatagcactcttggcttcttctggaacttctgtcttcaccaccctgtgttcggctctattccaactcatctctaatttctctttaccgagaccaggccgctgacagccctctcaacgattctaggagatttttgttatttcttctctggaaatacaatataaagaatttttatatggttttccaagtagatatgaagctttttaaattaaaattttgtgttctgataagagaaatgaaccatcttcatcattttaagaagtagaaaatatattatagaaaagcaccaaagaaaataaaaacaacatagaaagtaaaaagtgaaagccctaccaccttcaagaggtgacctctgtcaacagttgatatatctctttccagacttatttatacaaacaaatgtggatctttataaatatacgtatgcacagctttgttcatgaaaatgggagcatgctatatactttgtacagcaactggctttttttttttttttttttttgagacagagtctcactctgttgcccaggctggagtgcagtgacacaatcttggctcactgcaacctccacctcccaggttcaagcgattctccagcctcagcctcccaagtagctgggattacaggcacccgccactacgcccaactaatttttgtatttttagtagagacaaggttgcaccatgttggccaggctggtctcaaactcctgacctcaggtgatccacccgcctcagtctcccaaagtgctgggattacaggcgtgagccaccactcccggctagcaaccggctttttacaaatagcagtctattgtgtatatttctctatgacagtacatagagacctgctgtcttctttttaaaggctgcttggtatgtattccaccacgtagatgtactgctagttcatctcctcccctacagatgaccacaaagtttttcaatgtcctgataatatttataggccactacatcctcatttttatacttttatgcatttgtgctagtgtttctataaaatagatttctacaattgagactgttgagttaaagggtatatacatagtaagttgtatatacttccagttgccccttgttgaaaccttgtaccaatcagtgcagtgtccttttaaatggtcttttcattgcctgttgcttccctgtctccccaccccccggctcttcaccctagtgctagaattgcttttatgaaactcagatctgaccatggcttgccctgtttaaaatacctcagtggctcctcactgtcagcaaaacccaaacattcatctaagctccttctcagttggagtcctctgggaagcagacaccaaaacagaatgaaaagtgcagaagatttattgggggtaagaagagctaatgcctatgaaagataaaggagaaaggagcagaagtacggagagaaaagacagctttcagactgcagtccagatctaactctgggacgcaagagagggaaggataattctgttgaaagagcatcagactgtgatgcggctgtaagagtgtctcaacgagcccagtggggagttccagccaaagattgcccaggagaagagtcgcactttgggcagaaatggacaggcccgagcaaccctgccatgttctgtcattggctgggggccacccaggaggcaacatggtctgacttgaatggtgtggatccgaggctgcagcctgtcagctgtctgcactccatgcaacaggtcctttgaatggcatgtgttcgtggctgccataaactgcagcctgccttttagccttacctcctttgctcttgctctctgaccccgtgttctggcaacactggcctgactacacgccgtatcacatacaaccaactgcccataccaaccccaaccctgacctttgctcactcagttctttctgcctggaatgccactccttcccagttatacccagcaaaatcctaatgtgctttcaaggcccaacttaaaaatcatcttctctggttgacctcaccatgtagaattaattgttccttgctcctatggtgctatgtgtatattagtacttcccagattggagtattcttagctgtttttttctcagatttttgcctcctctaaacctagcaaaacgtcagcacacagtaaatgttgactgagctgtttccctgctcctcgcaaagcaccttgaggttgcagaattccaactcccggaatggttggaagcacacagtacatggtcaataagtgtttgttgacttgtctgggacctagtattggtggggtgaggtgggcagaaggctgctgagggtgggtatttactgttgttggggctcaccagtctggggccacattggagttttaagactagagcatgtcttcccctgtttttatttttctccatgatttggaaagaccccagaggtgggtttttttttttttaagtaatcactttattgtctctggtcaacaaatgagaacttttatgggtcttccctttttcaaccacattttcatgagttgggattttgcatttcttcattacccattctccttatgggtaaaagaagagccattatgatacctaggatgagagctccaggtcagatgggtaatcattttcagactggaggctcatgggatacagggaattgggaaggtagaaatgatatttttcctcttcctctttcccacatccaccaattaaagaacttccctgggagtggacctgtgggaagtggctaagggtttccggggtgggtacagcagggagtgacatcagggcgtggtggggatgaggtgggtggagaggacaaagagggactctccaccttcctttggatctatgaggatgttccttggccactgtccctcagcagaaggaggctagagctgaggtggccacaccctccactcattttcaatcccttcaaactgtcaggccctcagaggaaaccctagggtttccccaccaagatgtaagggctgtgtgcctctgccttctctcttagggtggtcagcacaggtggaagcagggaggtactgggctgaggcttcggttgtcagtgctagcttgacagcagttaagaattttttttgttttgttttttaaaatttatttttctgtaatttttaatgtagttaaaatttatacataattcacaccacttcaatttatacatattgaaacatcactatgtatcccataaacgtataattattatgtattatcattgtctgggacctcatattgtgtgttataatgattatacatatttacaaggtacataatgatgtttcaatacatattatgtatagtgatcacatcagggtaattagcatatccaccatctcaaatgtttgtcatctctttgtgttgggaacagtcactatcctcctcctagctattagcagtggttagggattttggaagttgtgtagtgtgaagaagcctgtgggccagaggttcttatcacagactctttcttcttcaggagctatgaaccatccttccccaaagtgttatcaaactgtgcctttggtggaggcatagctctcgtcggattcttttttgccagaaagatctgtgaacgaaactgctactatgttaactcagagaacagcctccctaataaagaagaggatgtgttcctacaagagccaggttttagttggattgttagtgtgagtgatgaagacctcagaatggctctagaaagaagcccagatctcagctttgcactgtgattgtcccccagcaactttgcattccccctgtatgggaatagggacctgtggattctgttgccatagatccagagattggacctaggaaagtgagaccaggtggtctgacacctacctccagagcggacaacccagagacagagcaggcccctgcaggtgtaggggctggcggcgagaagacagctatgtttacccttgtagactaggaatatcagtatgaatagactagtcctaggctttgaaatgaattttagtgttcattattatttggtcattctaaaaacccctattttgaacctccacttcagagaaatagttctgatgttctcagaaaatgtcaggagtgtatggtgcacagcagtggacaacaaaggaagagaaaaccagaaaaggagaaaagtgaataaaaagaaacttctcaaattagagcaaaatactgaattcagttatgcaagcatacaactgtaacgtgacaacctctctgattttgacagtccccctccacttgtatttttaaagtcctggccacagttataaatagggaaccatatctgttgagacttcccaagggttacataaacagtttggatggttacatctttttaaacaacagtttctacaaacactgaaaaaatcccacttatttaacagtctgatgccttgagccagtcctgggagtccctgggaggccttgcagaatcacttccttctgactgtgagtgggggcaggggcctggcttcttgagagagagcaggggaggaagaacccagtgtgtatgggggcgggcagggaggagtggggtggggcagagggagggaggaggaggccccagactgctactcatacaggcagctgtatcttgtctccaggagagagcagggacccaggatggagcagacataggtcttctggggactcagccctttcaggagggagtgtgtgctctaggcacacccttcccatttgacaatctgatatgaggtggaaacagggtccttgggcccctaagtcatgttgggaatgtttccttctctcaagccggaagagctgaggtttatctgagaaatgcctatgtctcttttgacacatcgtagtcactaaccccttgttcctgctccaggagcctctaaaaagccatctagaccagaaaaattggtcttttttagtgatgggagtggctttaatgtcattctcccctatttagttatgagctgtacctcagttttgtcattagaaatataattttaggtcaggtgcagtggctcatgcctataatcccaacactttgggaggctgaggtgggcagattacttgaggtcaggagttaaagaccagcctgggcaacatggtgaaaccctgtctccactaaaaatacaaaaattagctgggcatggtggtgggcacctctaattccagctactcaggaggctgaggcacaagaattgcatgaacctgggaggcagaggttgcagtgagctgagatcgtgccattgcactccagcctgggggcgacaagagcaatactccatctcaaaaaataataattataataataattttagttaagcgttctcccttcccagatgtctttttagaagtgcagttagctaaagatacatagctcattactataaattaattttatcaaactgatccatgcacttccatttaaagaggactcggtccagtgggtcttaacctttttttgaggtcacacaccccttccagaatctaatggcacacatagaccctttccccaggaaaattcacaaacatccagaatttcatatgccactaggggatttaaaagacccctttgactccaccctgggcttctgagttcttatgagagggtggcacatggaaaaagtggtggtgaggggcaaggaacagggacaaaaaaggaacctgggtccttaagagatcacttagttgttttacccaagacttggcatacaaaaatatcagaaatgagtgtctgctgccaagtggggtcactgcacgtcctagaaaaaaagtatgccttcatctgcagtgacacacagccatggtgttgggactggcacactgcatctctaagccgccaagagcttgaccctggatgggaagaaaactgccccagagatgctggagctggctttatgaactggctttatgctggggaggtggatggcagatcgcatccatctggtaggttgaggtcctcttggcaagcctactaccatcacctcccagcagaagaggactgcaaactatccttaaaggggactcggtccagtgagtcttacctttttttgaggtcatacaccccttccggaatctgatggcacacatagaccctttccccaggaaaattcacaaacatccagagtttcatatgccactaggggatttaaaagaccctgcaaaggacactgcaaactcataaccttgagtccaagatctcttttttttttttttttttagggaagtcaattgtatgatgtagcttgtgactcccagggtattgttctactcaaactggggaaaacatggggaaagtttctggatctagacttcatacacaagcatcacaggggattttgaaagtgatgcagcatcgtgaaatgagcatagggatcgtttggagtcgagcgcttgttatttgaagctcctcctgtctatgtggtgactcaaggaggggagaatttcccctttgtgagccagctggacaagtgtcagcactgctgtctttgcaggctctggcacagaggcgcagggcctggactaaagggagtctccagggtttgggggtcagacccagcttaacacacatgaaaaggagtgatctttctcttaagccattgagccagggtccccctacagcccacagagccctttccaccacctggtgcagcatctgaaccaaacagagggcatgtttgttgcactgcctgggggttcagctcccatccataccacaacacaggacaaggcccgggctttgcacagcacagtcaagtgagcacactctcacgatctgatgcagtccttctcccacacccaccatccaattttttccttcacttctttgtcttttttaatattagtaatttttgttatttctgttaactggacttcttggaactaagattacttaagcaggatacactagccatagatgaaaagatgggtaaattgaacatttatgaacttttgttcatcaaaaataccattaaagagtggaaaggcgtctgggtgcggtggctcacacctgtaatcccggcactttgggaggctgagatgggcggatcacaagtcaggagttcgagaccagcctggccaatatggtgaaatcccgtctctactgaaaatacaaagattagccgggcatggtggtgggcacctgtagtctcagctacccgggacgctgaggcaggagaatcacttgaactcgggaggtggaggttgtagtgagccgagatcatgccatgcactccagcctgggtgagagagcgagactctgtctcagaaaaaaaaaaacaaaaaacctagtggaaaggcgagccagagactggaagaggagaggatattctctgtaacatatccgacagacgactggggcttatatccagaaggtccaaagaattcctgtaagtaaataagaaaaaagcaaataggcaaaagtcttaaacaggaacatcttaaaagtggatatataaatagccaataagcaaattaaaacgtaaaagatacaactctatacccacaggaaggactaaaattgaagactgataataccaaatgttggcaaacacttttatatgctggtaggagtgtacattggtacaatcactttggaaaactatttgatagtatctactaaagctaagactatacccattccataaaccatcagttccacctctaggtacatactcaagaggaatgagtgcgaatgtccagaatgtccaccagcggacataaaccaaaatgtttttgtcttatgtctaatagtatctttctccataagagccccaaactagaaacaacacaaatggccatcaacagtagaatggttaaattgtgtcatatctacacaatgggatacaacacagcaatcttaaaaaagaacaaactgtgtctatacataacagcatacatggatcgcacagataatgtgtagtgggaagaagccagacacccgaaaggtacattgtatgattctatttatatgaagtttaaaaacaaataaaattggccgggtgcggtggcttatacctgtaatcccagcactctgggaggtcaagacaggaggaatgcttgagaccaggagtttgagaccagcctgggcaacatagcaagactctgtctctttaaaaaaaaaaaaatagctgggcatggtggcacatgcctgtagtcctagctacacaagaggctgaggtgggaggattgcttgagtctaggcgtttgaggctgcactgggctatgatcgcaccactgcactccatcctggacgacagagcaagaccctgtctcaaacaaaaggcaaaaacagataaaattaatctctggtgatggaagttagaacagaggttactttttgggtgggtcccaacagggaggggcatgaggggccccctgtggttggaagcattctgtctcagtgctactcaaagtattgcaattgccagccaccttgccattcaccccactggctcctggatgataagtataagggtgcacctttgtctgaaccccagtgcctagcacagcccccgccatgtagagcagatcctcagtggacatttattcaaagaatgagcaaattgcaccaggcgcagtggctcactcctgtaatcccagtactttgggaggttaaggtgggcggatcacttgagtctagaccgagaccagcctggccaacatggggaaaccctgtctctactaaaaatacaaaaattagccgggcgcagtagcacaggcctgtaatcccagctacttgggaggctgaggtgggaggatgacatgagcccaggagtcagaggttgcagtgagccaacatcatgccactgcactccagcctggacaacagagccagaccttgtttcaaaaataaaaaataaaaaagaatgagtgaagtaagacatggcctttacagagtaacatttgtgtgttagaggggaatcagtgtgggaaggcagttaacaactgctcaaagtttactataaaacaaagcagaaaatacatgctgcaaagagaagcagaaatgaaggtctttcactagaatgggggatggggtgacaaagaagctgtcggttcaaggaagaggccttcacaagtacttgggggactacgggggcttcccaaaagagatggtattgagctgaactttgaaaggtggttgagattataataggcagaaaatggctgagaaaggcaacctgggctcagggaatggctcacccagtggttctcaaactttagtgcaaccaaaatcacctagaagactcattaaaacagtttgctgagtctcatcccacaggttccaattcaggaggtctaacaagtcccaggtgatgctgatgctgctggtctggggactattctttaagaacccctagcttaagccaaagccagcctgtccaggcaactgcatctccctttgggcactgtgttaagtgagtgaagggcaagatgagagggaggtgtggatggacaggtggagtgggccagagcctgagacctttggctactgtctgcggagtttaggcctaattctgtagacttaatttagggcctcaatagatggacatagtgtaatgacctgttctctagggaagtcctactccagggtttataacaccctctacctgaagcttaaagctgtacacacaggcaggtgataagttcatactgagtttggtcctacagagacaagccctgcactgtcccccacagcatacctgccaggggagacacagtttacactgatagactgaagcaattgaagcaaggcactattttaaatgtgcaacatcaggattatttgtagccatgcatgcagtggggatggcaagtggaagaggaatcagtcaatctgaccattcaggcaaaagcagcagttttggtctcaataaagagataattggtctgtttgtttgtttgtttgttttttctcatatcataggtcccttccagattcccaggggcaaggatttataccacatccccagtccatttttgtcactagggaagcacctagatccaggtagtttcctccaagtggtgtctctttggctaagaaagggagagtgtgctgggagcggtggctcatgcctgtaatcccagcactttgggaggcccaggcaggcagatcaactgaggtcacgagtttgagaccagcctggccaacgtggcaaaagcctatctctactaaaaatacaaaaattagccaggtatggtggtacatgcctgtaatcccagttactcgggaggctgaggccagagaatcaattgaacccaggaggcgaaggttgcaatgagccgagattgtgccactgcactccagcctgggcaataagtgagactccatctcaaaaaaaagggaaggaagaaagaaaggagggagggagagtttgttgcctggggagggagcaccctctgtggatgctatggatgtccttgtcagaaccatcctggtcaggacacactggacattggccctttccctgatgacccagacatgcaaggcggatgccatctgtcatcctgcctactggcttttggttacaccttcaataagctgtacttactgagtatcaactctctgtaaagtaatctgctggttgtagtagagacacaaggatggatcagccatggacccatcctccagaaacatacaacataataagaggtaggtgacattaaaacacctactacctgatgcctgttccctccctctgcatccctggcttgagtctagctgcttcttctccctaatgccctgatgctggaggctgggagctctcactcattcagccttcacctcagcaggtatcacaggggtcctgggctcacagggtgagtacatcaagatgtgtgtggtctggtagggagccttcccgccccatagctggagataggctaactcctgagcaggtgctctacagccatcatcctgctgctggggccacaacaatcaactctgggccgccgatccccagtccccttgccggctgggcttcacaccagtagagggaacctgggggccccctttgcctcagcttatgctgaactagaggcctctgggggtcacagctgctgcatgcacgatgatccacggggagtcaggatggggctgaggcaagtgcagtgtcctgctgcctccccaagcacctccttcctctcgaagctctgcctgcctttttctcagggacatgagaattggctcacttccttctcacctccaactcccttttgcaagagaatcatctagaatagagttgtcggtcaaactgtaaaatatttgaagacatctattctgagccaaatataagtaaccaatggcctgtgagacagccctcaggagatcctgagaacatgtacccaaagtggtcaggccacaatttggttttatacattttagggagacatagccatcaatcaatgcatataagatgtacattggttctgtccaaaaaggcaggacaactaggttggggagtgggggtggtttcaagtcatagatggattcaaaaatttttctgattgacaattggttgaaagagttattatcaatagaaagcaacagaaaggaatgtctgggttacgataaggggctatggggaccaaggttttattatgcagatgaggcctccaggtagcaggcttcagagagaatggactgtaaatatctcttatcagtcttaaagagtcagtaattccaaaagggaagagggtataacgaggcatgtctggctcccccttcccatcatggcctaaactagtttttcaggttaactttggaatgcccttggccgagaggaggggtctattcagacagctggggagtaccttggaattttctttttggtttacagaacacaggcccagaaatgagaaccaggtttaggtcttgctctcctactctccactgtgtgacttgggcaaggcatctaatctttctaagcctcagttttctcatttgtagaatggaaataatgcccttgcttacttcatagtgtcattcagaggcacagacgatagagaggcaaaattcttgtctttaactgccctgaagcttcatggaggagttggacaagtacacacacaatgtgctgcatactacaccagaggtatgtctagggtgtggtagtagcagtgtggaggtaaactagttctgccaaaaagaggagactacaaagcatggggcgtggtggaagtagccctccagggctttggactctaatgtttctcaaacagtagagtgttaactgtattaagttgtatttagtccctacaacaaacctgtgagataggtgtcatccatttcacatatgagcagctgaggctcagaaaggatcatgcattggcctggcctggtatttatagagcccctgttgaatgctaaggggcgcaaatctaagttccttcctcgtagctcacattccacaggtgaagtcacttgcccaagacgaggctggaatgtcagagcctggattcaaaccctcatctggtggcctcccaccttaccctagaactcactagccctcaggacatcctcttacggggagcatagactgtccctgccagcccctgtggggaatttgaggatttagggaaaaggctgggtcagggataggacaggccctgctactcctatggaaccttctgtttcctgagcattccctggcagcccctccccaaagagagattgaaggcctgaccgtgccaatgttttccccagggacggagggcaggagaagcttccccaggggatttcaagggaggatggaggtggtctctattctggggtcagagagtgacaccctcttcctgctgaggtggggaatccccttggatttctctgggtttatgggagaggcctattgttttcgtactgatcaggccctcaggggaggaaaactcaagacctggcatgtcataggactaaatcagcctctggcatctgagtggctccttaggcttggggctcattcctgccctcccatgccctcagcctcaggctgccatgagacccatggcactgccactgggcagtgacattttgttttaacccaaggaaataagagattggcaaacccccttctccaaggaaaaatatacaggattgtttattagagcatttgctggtagtaacaatcataggaaacaatgtaaatggccaatgtttaggaattaaataaaatatggtaaaaatctacatataatgaaatacttttaatgcagccatttaaactcattatgtagaagaaaattaatttcatgagaagagtgctttataacagatttagtcaaaattcagatcataaaacacaatgtacatgatctcatttttaacccaaggaaataagaaaaaaaatacctatatatatgcatagaagaatgtctagaaggatgcatccaaagttaattgtagttatttctgggtagtagaatgacacgttttctcctgttttcaatatttccaagtttccttcagtgaaaatgcatgtattttgtaatcatggagaaaaagttcccatggtgtgtattggcgagagaagaggattgtttccttttggctttgcacttagatggcccaaggccttggccttgttcccagagtgcagatattgtagaagccacggggaaggctgggagcagcagaggagaggccagcttgaggagaataagctgggcatcgctgtctaggtgtcatcctaaatgtcacctcccagagaggcacctgaccacacagcctggcgaaaggaggtcgctcccacacttactctgtgtgtttcaccccagcttactgtcttcatagcacccatctgcatctgaagttacctgcctgcatatccatttccttggtgattatttatctcctgcacagaaggcaagctctccaagagcagagtcccttgctcactctgacttcccattaggagaaaggacccaagccagatcttggtcaacaagcaactgaggacttgctcagcagccccaagctatgggcatttatcctaaggctacacacagcagtgagaaaaaggaaataacttcataggaatctagaaacaggtggagagctagcttataggaccagacctgggtggtgctcagcaagctggaggacctggcccagtgttagtaacaacagcggccacgtacaggtgttgaggaagtaccagctttgtgttttctcttaaggtggaaccaatgtaggttagatccctctccctctgcttccagccctcctgctgtcaccagccaactccacccctcagctcccaaattcagctcctctctttagaacctgctgtagtcagattctcactccaactgttccactgaatcatccctgaccaggatcacctgtgactccaagatgctaaatctctgtcttcatattattaaatagttgatctatcacagtggactatgccatcctcctcagaagtctttctccaggtttccctcctactgtacttgctagtccttttcagtctcttttgctgagctactgaatggggctcagccccttgcacagcttccctggttttttttttttcttttcttttcttttcttttcttttttttttttttttttgagacagagtcttgctctgtcacccaggctggagtacaatggcacaatctccgctcactgcaacctctgcttcctgggttcaagtgattctcctgcttcatcctcctgagtatctggggttacaggcacctgccaccacacccagctaatttttgtatttttagtagagacggggtttcaccaggttggccaggctggtctcgaactcctgacctcaggtgatccacccgccttggcctcccaaagtgctgggattacaggcgtgagccaccgcacccggccgacagcttccctattgacatccaccctcttgatgatctcatcctgtgtcacagctttaaagaactatgtgctgagaactcacaaatactcatttccagcctggacctctccccagattcacagttccacctgcctacagtcttctccacttaagtgcttaaaaggcatctcacacttacatccaaaaccgtattccttatctccccacaaaacatgctccatctgtacgcttccattcagaaaatggcaattccatcctcccagttgctcaggccaaaactgggaatcttcctgctgctcccagccaactctgtctcctagttcacagcttcagctcctttctttttaacctgccccagtcaggttctaaacccattctttttaatctctcacttccaatccatcagcaaatcctccatgctactgctctggtccaagccaccattgtctcttgccaagatttctgccatagcctcctaactggttctactctttctctcagtttattctcaacacagcatccagagtgatcctgttaaaatgtgagttacatcatgtcacttctctgtaaaaaaccctctagtggctcctgtctcagaatcagagcccaagttcacacaaggacctcccttgaatgccgtgaacactgtggagcctctcactacctctctgatccctctcctgcttctcccttattctctctactctggctacaccaccctcctcacttatctgttaacatgtcagacaggccctcactgccaggctgttgcacttgccattccctccacctgggaagcttcttccccgttaattctcagggctcatgtcctcacttttttcaggtaactttgttcataatttaccttctcaggtgtctagccttctctggacacacattttagaatttttacacgccttctcaccttctgccccaatattccttacctctctctcctgccttattttttcctccctaggatttaccacttctgattcctatatttttaatttatgtatcttgttagtttttggactcttcactaccaccaccgccccacccccctacccagtagacttcaagctccatgagggcagggtgttagcctttttagtccaatgctctattcccagagccctaggacagtgcctggcatatagtaggtgctcagtaaatagctgatgaatggatatatccatggaaatgaatgaagggacaacttattttttatacaaggccttgagacaaagtgggaagggcactgaggtttctgccagtataggagcattaacaggccaaatgagaaagaaaccctctgagtggagaatgccgctgggtggaagcttgtgcccgtgtctgccctgggccagcatcctaccaactcacacctcagcagctttcaaagaactcaccacagatgggctctcatctttcaacttccatccaggcttgcgttgttcaaaggcccaccttcagtgccctgcttcaatcatttactttccttgttttttgcaggtgccagagtttgtagcctattggaggaaaacacaccaaggtaagacaacaataagaccacatcttgtttgggactgcccaacgtagccttggaaactgtccaaggaagaccagggtgctaagtgttggcagctggataaagggaaggcccaagagactttgcgttgacttcctggatagagtgagagtcctggggacagtgaggcagctcagtatagtcagtgatggctgtgaggtctttagactcaggaagacagtgttgcacttgggaaaatgtagcagcctcccccaagccagttggttgtgggcccacagcatggccctcttgccctcacttccctacctccctccgggtctccctttcctcacttgcccagaagtgctgcctggcccactgaaggcacagcaggctgctgcagagggtctagtgcttttttttttttctgagatggagtctcgctctgtcgccagactgaagcgcagtggcacaatctcggctcagtgcaacctctgcctcccgggttcaagcgattcttctgcctcagcctcccaagtagctgggactacaggcacacgccaccacgcccagccaatttttgtatttgtaatagagatggggtttcaccatgttggccaggatggtctcaatctcttgacctcatgatccgcccacctcggcctcccaaagtgctgggattacaggcatgagccaccgcgcctggcctttttttttttttttctaaagtaagactggtttagttcaagaggtatatactaagatctttccagcatagggcttctctgattctgtgtttaatctcagtccaaattttgtgaagatcctcagcaaataaatggatgtgggaaatgtgtgattgggaaagaggcagcttttaaaaatgtgtctggcctttgaccacgcaatttcactttccagtatttattctaggaaaatactcatactattgcaaagtttatatataaagatagttataactgcattgtttatcatttacaaaaagaaaacatctgaaagcccaacaagacggaactggttattccacattggcacattcctacaagggaatgtcattaggaagaatgatgaagataaatatttattgatgagaaagatatttgaacataccatttttttaaaaaagaaatggaaaaatcttacaaaccattcaaggaaagtagctttggattcagcctgaagggttgagatctagcttagtctcttaaccaacttgggaactcaggcaagtaatgtgatctccctgaacttgtttcctgcctgtaaacggggcacaataacacctatcttgtgaagttggaaggattaagagagattaacacatctaaaggcctcagcacagcccagtaggtgatgattgctcagtagctgggtgcttagatgagacatggactgtgatagtatttttacccgtttataagcctggaaacattctggaaattcatacaccagcagtggagttttctgactgatagaatcatgggtgattattaatattttcttatttttctacaaggaatatctcctgcttatctaaggatggtatagtttaaaaaaaagtgacaatttaaaaggttaaaaaaaaaacagtgcatttcagcaggtaagtttgctaagtagtccctgcacagagctctggagaactgagagagaggtgggaaagaaagggaatagagagaacaatgggtgaaggaaaagagaaggggaggtcagaccccagggctagtggccaaggagatgcacctcggcggtaacgctagagccccaccaagcatgtgtttgtcctcccatcccctatgattggcacctcccgggagagctccaggtaggagatcttgtaacccaaggctcatctgtcccagcttctgatgacaataaatgtgtgtagcctcttttagcggccgagacagcctgactatggcacgtccagggagaggccccgtggctctagtcctgggcctgactcatccacctttggtaaacccagcatttttttccatgtccagagtaggagaggcagggcatcctggtgaattcccagaagtcatcctaaaaggattagcacctctcttctttagcagcccaataggatctatacccaagagataggtctcccaagcaaatacaggctgccaggagagggaaatggtgaccacctaagggctgccatgcctggctctcatccccaccctcaccccaccaactgccttagtggccagtgacatcaggaggaacccttccatgctgatggtgcttgtgcccacctatgccagttcattgagcattcttagagaggcatgactcttctacataagcgaattttccaaattattaaatttgatcccatcacattgcagttttaaaattgtacccttttaaattaatttctattctatcaaatttatcaaaataatgcacaaattcaaaatagctggaagagatgattttgaatgttgtcaccacaaagaaatgacaagtgtttaaggtgatagatatgctaattaccctgatttgatcatgtcatgctatatgtatgtctggaaacatcacactgcactgcataaatatctacaattattatgtatccattaaaaacaaaataaaaaataatgcatgcatatggtttaaatatcagttgtactgagaagcccataataaaaatcccttccccgcctttctcactccccctctctataggctgcctctttcaaccatttactagtttccatttctgtttatactattttttgatctaccgattttaggcatttgttgacttcttgtgatagatgaggattgaactttcctacagaaccatccccacttttcctctctccatccttccaataggaacataacacaatctgtggttaactcaatagtgaatgtggacatattcgtcactgctgagttatgtagcatctttgagtcctggaagattttcttgtattatttatttaataattttcttccctgtattttatctgttggatcatctggattaatgttttagtttccttatattttctctcctacttttcatctctttgcctttttggtctactttcttgggaaaccttcattgacttcatactccaacccttctgttgattttttttttaattttggctttctttttctaatatcctagtactcattcttgttcttcctgttctttttcaaaaataccacattcttttttatgcatatactatctccatcctattcttcttgaggcactatttatttttcatttgtccatttgtcttaatagtcttctagtctctattttgtttttgtttctacctggaggtggcagcggcggtggtggctgcttcttgttgttgttgttgttgtcgttgtcgtcatcctccttcttcttcttcttcttcctcctcctcttcctcttgttcttcttcttcttccctcttctttcttccttcttcctttttccttctgctttctttttcttctccctctctctgtctctccatctctccttgttggaggctttccttaaatgccaaatatctcagctatctgttggtatttattaatggagcaataaaaggctgaactaaactctgcttggggagaatttatcaactggggtttcactacaggaagcaagacagtcttttagttaacaagcctccaatgagcaccttttctctagagctaggtttcttaaccttggtactagtgacatgttgggccaaagaattccttgttgtcagaggctgtctcatgcattgtagaatgtttagcagcaccagtgacttctgcctactaaatgccagtagtaacccccctcccagagttgtgataaccaaaatgtctgtaaacattgccaaatgtcccctgggggacaaaatcaccctgttgagaaccaccaccctgaagccattcagctcctcaagagaagcattctaactcctagttctagttattgaacgctacataacaaaccacctcaaaacttagtagcataaaacaacaaccattttttgggccactgtcaaggagtcagaagggcaattctctgctctacgacggctaggatgactggaatgactcgaggtgactggaataactgggagttggaacagctggggctgaagggtccacttgtaagatcgttgttcacttggcaaagagagctggaaggctgggctcagctgggactgttgaccagagagactacacatgatgtctccagcaccatggcctggtcattggacctcttacgaggcacctcaagtctctggtgtgagtgttctggccagcaagacagaagctgcatggctgtgtatgtcccagccttggaagtcacatagctcatttccactgtagtcagaaatccacacaggttcaaggaaggagacacagacccacctctccattggagaaatgtcaaagaatttgcaaccatcttttaaattcaccataccctcatccagagtgatatatacctggggtggggcagggcaaggtaagtgggtgggacattgagtcccacgcttcattcttcagacttttccctcacctccctgttttcatccctgtattcatctgccctccctcctgcctgtctctctcctgttcagtgtctttgtctccagctgtgtggggcagggtgtggaggtgagacctggggaggatttcaaccagtttcctccattcattacccccacaggctgctgtacctcagccccaccagccacaacacctggactccccaagtctgagctcctcctgcagggttccaggggtaaagtggcttgcctcctgtcagtgtgcccctctgcaagcccttcagagcctagcttcctccatgtcagtcattattcctccacctgcctcccagcttcctgtagtttggggaactctttcagccactcatgtctcctttaccattctctttgcctttgagagttaataccatttggttggttggttgtttgagacagagtctcgccttgtcacccaagctggagtgcagtggcacaatcttggctcattgcaacctctgcctcctgggttcaagcaattctcatatctcagcctcccgagtacctgggactacaggcatgtgccaccatgcctgactacttttcgtatttttagtagagtcggggtttcaccatgttggccaagctggtctcgaacttctgatctcaagtaatccaccctcctcatcctcctaaagtgctgggattacaggcatgagccaccgcgcctggccccatttgatttttttaagagacagggtatcacttcatcgcccagactggagtacagtggtgtgaccatagctcactgcagcctcaaactcctgggctcaagtgatcctcccacctcagcctcctgagtagctgagactccaggtacacaccaccacacccagccaattttttttttaagacagggtcttgctatgttgcccaggctggtcttgaacttctggactctaatgatcctcctgccttggcctaccaaagtgctggaattataggcgtgagccactgcacctggccccatttgatttctagactagcattttagtggtgcttcaggagagaaaggaaactaggagtgtaaataactgatgtgttgaactggaaaccctgttgtacctctcttgtatggatctatctctacattgtgttatagtcttccctgccctgtaacagctctgtgaagcagtacagtgacatttaaccttctgttgatcattcagagtcctccttatgaaaatacttgtttaccttggaattattaagctattaagctattaccttggaattattaagtaaagctatttgttcttccataatgaggaccccagtcattttgctgggattctttaaacctttcttcgtggccgcctctgtccctggctgcctttcatcctatgtatttgtggtgagagtgccacattacagcacgttagcttctgatgtactcttttcaaatggccagccccggtgactctgccgggcattgtttgtttgccacccccccacacatccctgctccagttgattttctgctctttcccactcctcccaggatttgacctttgtggattccatcagccaggctccaggtccccaagcttccagttgggtttggccaattgaagacccctcccctgaccagaggttggaggctgggaggggaaatgggaggtgctttatccccccagctccctcccttgccaggtctcaggtcaatagtgcctgtgtttttcaccctaaaaccacagctcctgccggcagtcccctcctactggtctctctgggttccaggagccctcccacctcctccctggggattggtggtcacagctcccactgttgctggctgcaggatgcttcacctttccttgagggtttctcttcatcttgctcacccttggaaacggtcctttcctcagtctctcctgttaccagtggagtgtgcatctgtttcctgctgggactgtgatcaatacagcaaccttttctgatttgcatctaaaacaaggatactcaagcagagagggtatcaacatttaaaaaaataaaacaagaataaatagtccctgagtgagccctgagagactctcttaggcgagagtctgggtgtgagctttgtgacttctctaggctacgcaagggcttttgtttgttcatgtcgatgtttttaactataatgcagataatagagggcaatagattagtgacttctgtacttactggagtgatttgagaaggaaaataagcatgtaaatcaagggaagccaggatcactcactctcctggtcccagtcagccctcgtttttgtttaatttgtgtatttcgaagcacacatatctctagggaagaaaatgaaatcaagaactcctcctggccaccggtttcctgaagcatgaaaaggaagcatttcataaatgctttgtaaagaagacaacaggaaggggtagtgtcactggctggcaagagctgctgttgtggtatttcacagacaagggaggtgacgtggcacatgggggctgaggtcccagccagaggccacacaggcacaggcctcagagcccaggcctccctctggcctgtagaccctcagccctactggacaggaggaaaaggcctaggggacattgcccccatttcacagagaggaggctgaagccagtgaagcagagagttgcagcttcagtggggagacactgttatgccccgcctgtcttattcatgcttcttttacctgtagggatttttttttacatggctacccttgagtgatagagccttcatcagcttagcttgtcctcttgcagcctacgccactctgtgccctttagccaaggaagcccagctgaggccccgcagcgtccctgcccagcagagctacaggaggcccgaggccccttcctgttcactcttgctctatagacgccacgctgcaaagcagatgtgcagggacaccacctgaagacccagcctgcagctcagccctacacactgtggatggtggagatcccagagggccaagagaagcttattgagacttctctgcactgcccctcccacagcaggaggttcatggcccatgcatttctgggagggttgacagggcccaggttgtggaatacctgtctgtgagccccatgtcctgtcttgtcccagctgcctgtagtttgacagagtatgctagaggtcagccattgctagggaggctgccactaaccacacagagaggaaggaaaattctcagccacagcacttagagctgagcctgacatggtcctcagcaagatgttgcaagttcctaatctgaacacagaggccagggagtaagcatcatctggagcccagagctgactgtcattacccacaaacataaacaccctgagtctggccttctccccaccctgccgaggttgtcagagcctcagcactggctctgccctgggtggcagcccctgggaagcccagctgccacctctctacaaatggccctgtagaagctgtgctcagtgatccacttcctggggggggctgggcccaccttgttgccattacaccccattacaaactgatgcaaccagctttcaacagacactgccaaggaagatacacattacaacagcatgctgcaatacctctgcctgtgcaagagactgacccacatccaaaaaatggacatcttcccaccccagtgtctcactccactgagctggaagtggcctttgtcaggaccctgtgaggtcttgagtggatctgcttttcccaagatattaaaccagtgactttaaatcctggctgcatattaccatcatctgggatattaaaaaatactgatgcctggatcttgctcccacccaaagagtctgactgaattgatggggttttcaaacattttttaagtgtttgttgaaggatgacatacatgcaaaaaaaaaaaaaaaagcacaaaccataagtgtaaagctcagtgaattttcacaaaatgaatttaccccgagtaaccagcatccaaatcatgaaacagaacatcaccagcaacccctggtaccccttccacttactacctggctccaaaggctaatgtccattctggcttctaatggtgtacagtcatttctcctgttttcaaactttatatgatgtaaatggaatcaggcagtatatatcctcttgttgtgtttgtgagatgattcatccaagttgttacttagagctgcagtttattcactcttcttgctatagagtattccactctatggatattcctcgatttatccattctactgtgatgcatttttggatattcgagttgttatttataattcggaactattctgactattgcaatgacatgctagtgtgtatttttggagtacatgtatatccattgctggggaagcatgggtatgagtatgttcagctttagtaccttatgccaaataatgttcccaggtggctgtacccatttacactccctccagcaatgtatgagagttctggttgcttcacatttttgccaaccatagatattttctatctttttcatgttagccattctggcaggtatgtagtggtatcacagtgtggtttgaatttgcatttccctgatgactaatacagctgagcaacctttcatatgtttgttagccatttagatcttctctttgcaaagtgcctgttggaatatttggacatgagtatttttaaaaagctccttaggtaactctactgtgtagccaaggtggaaaaccactgaactaaaaccacaaattagtatctgcgtctccctttcttcatgatttgcctttgaacttagagcattttggatctgagaggacctcgtggaactgggaaaagattatattcactccctactaagatgagcctgtcaggaagaagcaattggagctggcagttaagaatctttaggaatgtgacctctacttcagaagggtccagggagggcctgtggtgtccacagctgccacagacatttcctaaccacaaaaatggccccttggtggtctccccagagctccaggcagtcatggggaggaagcggagggccccatgccaggtacttcccagtttctaggccaacatgaatgggacacagctcatatggggttgtggttagactggggacagtggagcatatgttctggggacctgggtgtggccaagggaggcctcctgtctgtggcctttgtcccagattggaaatcagccagtggggctctcctacatgggtccaggcctggctagctcttgaattctgtgcgtttgcatgtgggtccttatgcatgcgtcctagagcagggtcccagggggccactcccccccccgaccccttactcctctaagctgggaaacacgtggcatgagagaacacactgtggcttctaatgacatcgtgtcttgattgcatccccattgcatcatctgggctcatctcatccccacctctggactgtaacatcatcccagggactgccggacactcatctgtgctcccccacagagagtataatgccatttggtaattcagtacagcctcttccaacttgagaaagaagatgcatttccttccctcagtcttgagctgtgcaggtgtcacgctgagctgccctgtgtgggctccatgttggcacacatcggttgcaaggggctctgtgtagtgagtctggagttggaccactggccaggcgctgggatgctagtgcctggactgagtgtgcacagaggcccctcaggcagagccacagtgggcgctgaacctcctggtgaagttcaccgcagtaactagagctcagtgggaggggctggcctatcagcacctgtcctgtgtgctttttgaaaagagcagggtctaccttctgtcaactgaagtcctgccagctgcatggcatgagatgagggacaaagtggcacgtgaacaaagttgacattttggaggctgttaggctcagagccaaccctgggctccatgtagtgccatgactcatggattcaggcccatcttggaaattgctctgggcgtagagctctcatttctgatagtccaagtgcagatattggggttcctctaattggcccaaatggtggcctgcaccaaccagcgaccagagtgctgtctgaatctagaataacaggaagaacacgcctccagcagtgtaggagagttccccatgcagtgtgcttcccattcttaccagcagttggtatcttctgtctttttcacactggccatctgagtctcataaggagactcctctccttccactgagcctgcatcccagcctctcccctttcttcagggacctctccccagcaattacgcccttccattctctcaaccagggaatcttcaaactcttcttctccactggctcctgctgtgctcctgtctccatcacctgtataatgcttcctgccatcctgccttccccgtggagtacagccatgctgtctgctgcttacagccaagattctggaaagaaatgtctcctttttcctcgtcatcaaccactcatttattcagcaagtgtttcttttacacttgcctgtgctgggcatggcagcaatgcagcagtgaacaaaaccatcagccctgctctcatgcagcttataatcaagtagagagacagacataaatgattaatagatgctcctgtaatggtggttgtgaggtgtgctgccacagcccagccacacacgccagttcccttctctgcacatgtacatgtctgctcatccttcccacctgaactcatgtgccacctcacttatgccccttcccaatgccgcacccacacaacagggtgtccctctgtgcccacagcagcccttgggtataactgttccccacagaggctgaaccccaagggcagagtccaggccacactcaccacggagacccctgcctggcacagagcccagcccagcagagatgctcagaagatgaatgaaagtccctgctgagattgatccaatctgtttgtgaacatctctggggtccaagaattcacggctttctttttctttagagagccttttgtttctttttgccattatatactatatttgggttagggcacaacaatgtgaatatacttaatactgaactctacacttgaaaatggttaagatggtaaagttttaagttatatgtattttgccacaattttttaaaatgcagagcataggtacaaagaaggaaaaaaagggggcaaggtccattttattgagaaataaagaacaaagggttcaattcagagaggattggattttaaaacgtaatttagattagggaaatgcaaatgaaaaccataataagtaagataccacttcacatctgttaggatggctattttaaaacaacaaaaacaacctgaaaataagtgttggcaaggatgtgaagaaatagatacccttgtgcattgctattgggaacgtaaaatcatgcagcctttgttgaaaacaatgtggtggttcctcaaaaacttagttatcatatgatcccgcagttccacttctaggaatatacccaaaagaattgaaagcagggactcaaagtgatatttgtacaccagtgtttgtagcagtattattcacaatagccaaaaggtggaaacaacccagatgtccatgacaagaggagtggataaacaaaatatggtgaatatgtacaatggaacataattcagctttaaaaaggaatgaaattctggtacatgttataacatagatgaaccttaaaaacattatgctaagtgaaataagccagacacagaaggaaaaataccagatgatcccacttatatgaggtacctagaatagtgaaattcatagagacagaaagtagaaggatggttgccaggggctggaaggaggaagaacagggagatactgcttagtggatgcagagtttatgttgagggtgatgaaaaagttctggagatggatggtggtgatggctgcacaacagtgagaatgtacttcatactatggaactctgcacttaaaaatggttaaaatggatgtagacattttatgtctattttgccataacaagaaagtaatttgggtgtattttagagattttagaaaatactgtaagcacaagaggaaaaaaattaaaatcattcgcaatcaccaggtagagacaacgactgttgaaagatcagtgtgtatcttttcattctcgttctctctctcaaaaaagtgtgtgtgtgtgtgtgtgtgtgtcttcagatgtcacactggactttcaggaaaggttcccctctctgctgcttccctgctggagccatggagagcaagtctatccctgttccataggtcaatcctttgaatgatttctcatggctgagttcactcccctgcacctccagggttgcacttctctgaaaatactcatttattttatgtgtctactaaaaacatggcacccacgacccaataatatgttggaaggggttggagagagaaacgcgagtacctctcacaccttctcacacactacacatcttagcgatggccgagtgagcatgttggctctctggactcctcagtctgttggtctgggctgcgccaggctcaggctccctgcctcccccccaaccttgatccccttgcttcttgaacctgatgctgggcctcacattctccgttgattctagctcttaaatcctgcttctccagcttgtcaggaggctgtgccctcacaccccaaagagcagatctgccctctccactgagagggaaggagtgaaggtcccacagcctctgacccctgctgggcccaagagaggaacagctgcttgctttatttctcgtgggagaagtgtgtctcctctttgtctcaggcacccctctgccctgtacagcagcaagtcagcaggaatgagctgagccgcccaagtagtggctccctccactatgggggctctgtggtcctgggggctgtcctgcctccactgccataggcctggccccagagcatgctgcagtggtcacaacctgtggaggtgcccccagacccccatatttgggcccaactacagcctccttccccagctttgccacctggcttgggagccagggcaccaccagcttcactggcagggagagatgaagaaagaggccatagccacgcaagtgactgaagttcatgttcgtgcacaccaattagagagggacagcacgttcatttacctccaaatccagccacagacacatcgcccttttctcttggctctgaggcctccacagaagggttttttaaggttgcagccaggacctttatagcctagtcctgagaagattatctttttattgcaactttgattaatgattgatcaaaaactgatactagaaacactgaagaacaaatttgctgtagacattaggaaaggtctacatctggcaggcctggagacctgcccaccctctccccccacggtcaaaccagggcaaaggtacattggaagacccaacccctacacactcttacacgtgcactcgcacacacacactgaggggaaagaaatatttaattgtccttaaatcctcttggattaggctataaattgcaaataaatggagcaacagacagagcaaaagcacataaggtcctttaatagaatttctctatcttattctgtttctatgaatgcctgttacaaattagcagcttaaagggaaacctggagtgtgggaaagagcgacccttgtgtgaagtccacagccggggtttcctacagacctcaggtcccagagaacatctaagatgcctccaacaccagatggaggagggcaggagatgctgcacagagaagcagcacttcccgagcatctgtggcaggaagtgacttggagaggatgaggccgtgcctcaggtgtgctctagctgttctgatggtctctgaggccacgactgccatggtgaggtccacagcctgcatcagaatcaccaaagggcccaaacgtacggcctcagagcctggagagccaggaatcggcattgcaacaactccctgctcagtgggttctaccagtccagtacctgccctctgagggtgcccagggagcagggtgcttgctggctggaacactttttcctgcccctcagctcctctgtgatgccctgaggcacgggcactggaaagctggcagagctgcttctaaattgaaactggaaaatgaaactggaaatcacagtttcattttccagtttcactcgctccccctactgttggggtttcttttccacaaggagagtcccccagggagaaagaagcaggagtgggagtgggggagcatgttgggggaaggcagtgagggtgtcctgtctgcagcagggcatggaggggccccagcgctgcacttgcttcctttaagcctggcctgcttgctgtcagccccgggggtggtttcctctctaggaaaagctaatgtcatgcttatgctgaaaaactcttttcagaggtactttaggaggggcctggctctcgattaatctgggccatttcataccggctgtgctcacccaggcacaaacactgaaagcaacagctggcaaagccatcgcttggtagcagcttggaagacaccaccaaagaagctctcatggaagcggcagatttcctgaagcgactggaatgcggggaaggagggcagtcggggagagccgagaaccagcccccctgccaactccaccccattcctctcctcacctgaaatgtctcatccttagaacagctgccctaaccccctaatcccacacactcctttgtaggttaagacccctgaagttgcaccctctcgtaggagctatgtttttcagagatccatgtgattatttgcctaatgtctgcctccctcagggaagtaaagtctgtgacgcgtggacctggtctgtgttgttcactgtgcatccacagtgcctgggtagtgcctggcatgcaggaagtacacacaaaaaatatgtgttcatgagtgagggcaggcttgaagagcccaagagaaggacagtgctccagggaggcgtctgcatcaggctccccagtgtctggactgcatcccagcccctccgagcaacttcaggggaggattctgtgaacagatgccccagctcttccgcccacagctcctacccccagcctgaggaatgctttgactgtccccagtgtgtgcaggcagtggggaggtgatagggggaggtgtcccacatggcacactctccctagcccttgctttgcctccgttacctacatagatgggcttcacagcctcttccagataggcagggcactgagctctgtgggccacacctaaaaagaaagggagacaagctggcggtgggggcatgacagtgtttttgtttgtttgtttgttttttgagatggagtttcactcttgttgcccaggctggagtgcaatggcgtgatctcggctcatcgcaacctctgcctcctgggttcaagtaattctcctgcctcagcctcccgagtagctgggattgcaggcatgcaccatcacacccagccaatttttgtgtttttagtagagacggggtttctccatgttgctcaggctagtctcgaactcccaacctcaggtgatccacccacctcagcctcccaaagtgctgggattacaggcatgagccaccgtgccgggctgacagtggtttttaaagggggagggcagatgaaggacgttggtggaccatcctctgggaggagatgtggactgaggaagcaacgctgacctcaggccccacaccaccctttcacctcagcctcactttctcatcagtaaatggaactcgttcttgtgtatgtgccatggaggcaatgtagcagaagagaatagggcagactttggaactcagccatctgggagaaaatcctagttatgtgatgaccttgagccaatgactgaatttctctgtctcattttctcttctgtaaaatggggacaattacagtgaattctgtgaattcattcatgtccctgacacatggtgtgagctcagtcattacctttgcgagggttgcaaggatgtaatgagatggcagatgtgagcacagctcccagacccgaaggtgctgtatgaatgggagggagcagtgagtgttatttgggaaatattgaagacacaacttccctcccacatttgtctggggtggagcaacagttttacttatttaatgataagctggaagatgcaccaaagggaggtgaaaaactgaaaccgccaaccgtttgagctccaggctgcaccgaagcggtgtggctggtgcagatggtgagagccccagtgccggcccacttcctccatgagtgccacacgcctttctcaagctagccggcttcccaaggctgcaggaagtggggccaggaacaggccctccggctgtgttgggggaggcctgggcaggggttggcagctgctgggtgtgaacggaagtcttggaggtccttgaaggtcctggggccgcctgcacagcagcccctgccctctccctgtccaggcctgcccaggactagcttgtagcagactcttcttgtagcctaggctcttgcctcttgcagtagtgagccattgtacaaaagacatccagcggagggaggcaggctggagaggaggacagccgaatcttttctcaaaggaaatgcagttgtggttttgagacgttcatatttcacatctgtggttggcgtttcccagggttctcagaggtgaatgcagggtcagccctgtgtcaccaaataaggctcacagtgaccttagcaacaagctttgctgcccattggctgtcactgctgccgcctgccaatgcggcctcctgaaggccagcactgatgctgagctgaaacttctgcatgtgccaaggtccagctgcctctgtcagaaatcaccgtccttggaagcagccacagataggtagagagctccggacaaaggtggacaaggtcagtgggaggactgtccaggtgtccatgtttcagagtccacctggccagcattccattctcacatagcaccaaaccagcaccttggtggcctggtcccagcttgccaggacaaccccccattccaccctgtcaaccttgaactctataatggtcatcatttcatagctctgctcattttagttccactgggttctcccttgtgcttggcacttgactaagctccttctacacattacatcttttacctctctcaacaaccctgtgagccaattagccccattttacaggtgcagaaactgacaccaaaggaagtcagtaatggcccaggtgactgcaccactagtaagtggggaagtcagaatttaaacccaatttaaacagacctagatcccatgctattaaccattgcactgtattgacagacactcaatgtccgtgcagctcagtgtcttcattctgtgacatggggatgacagtaccgtacctcacagggttggggtgagcattgtgtggagtgacttatgtccagaagcacacctttgcaccagtggccttggcacccccaaggcatgctccacaaacagcttgcacattcctttctcacagcgtgtgctgctgaaacattgaggtttgtggaccggacttctctgtagcccttgtatttagttttcacttcctctttcttgacctcctcccaccccccacccaactgcaaggtagggaggctactgaggggccagcctgtggattccagagggcacagggctatctgggatggaggggacagggttctgaagacagaaggtgggaaggtcacactgtaagggcagacataccccatttcttctacctaaacaactgggtgtaataccactgtttccctgagaaacactttcaggattaaaaagtatataagtaaagaaaataaagcatataagtgatctggtaaagatgaaaacatggctgatctgaaggtagtgaattatctcaattgacttcacagtcagttacagatcgaactccttgttctactcttttcccccttctcactactgcccttgactagtctttttttgttgttgttttttgttttttttttgagatggagtctcgctttgtcacccaggctggagtgcagtggcgcgatctcagctcactgcaagctctgcctcccgggttcacgccattctcttgcctcagcctcctgagtagctgggactacaggcgcctgccaccacgcctggctaattttttgtatttttaatagagatgggatttcaccgtgttagccaggatggtttcaatctcccaacctcatgatccaccggcctcggcctcccaaagtgctgggattacaggtgtgagccaccgcgcccagcgactagtctttaaaaaaatgaataatataaatttttttaaaagatgaaaacatatatataccctgtaacccaagagtcccactcctcagactcttctcaaaccacactcttacccatgtgcaccagaatacccacacagcaccagaaaatgtccaaatgaccatcaaaagtggagagtacaaataaattgtgcagtgttcctggagtgaaatgaactacagcgacttgcaataactgtaatattgtcatattggataataatactgtaataacaaatgactcatcaatgaataaaacctacaaaagaatgcatacagtataattccttttagcaaaaatttaacagctggcaaaactgtattgttaaggatacatgcagaggaggtcaaactacaaaaagcacagaattattacaaatgtctacttatgcagaagggagggttggggttgtgattagtaggggaacacgtaggtgctttgggggtgctagtattgttttctctctttaagtttgggagattaccctggattattgggtagaaactggggtgggtgagcccaatgtaatcacaagcattcttaaatggagaagagagaggcagaagggtcagaagcagaagcagaagcagagagattgcaatatatgaaagacctggccagccagtgctggctttgaaggtggaggaaggggccgcaggccaaggaatgcaggcagcctctaaaagctggaaaggggaagaaaggaaagagattctctactagagcccccaggaaggaatgcagccctgctgacaccttcagtttagcccagtgagacctgttttggacttctgacctacggaactataagaaaagaaatttgtgttgttttaagcccctaagtttatgttagtttattagagcagcaacaggaagctgatccactgggaaaccatctgggatatgcagctgcccaaaatccctgctcgtggttagattcagccttacgaggctccacagcccctctgcgaaagactccattccctcttggagaagctcagactctagagccctgggcaaggaatgggccttcatggcatgggggcgatcaagaaggatgccccccaggacagtgactctgctggacttctctacagaaaacagtatatccctcagtggcatgagaagatccaatagggtcaccacactccacaactgcaggggacactgttcacattttagtctatgcagcctctggtggccaaagattaaatgagaacacctttgctgtgtgacctgaagttcatggtcagtaaattgtagctattgttatgcacgacttagggggaagcaggggtcactgcagagcagcagtggttttatagagatttgctttatgattatttgttaaactgaacatatattctatgtatttttctgcataattattgtttcacaatttttaaaaagcatatacacacatgaatcttctctagccccgaacagcacagtgaatggatagggcagcagatgagctctgccccacgccggccctgtttcagaacagcactccagagtgccgcactgcttgctgaaccacagctgttactgcagattgaggagcctcagagggaacagaagataaagatcattatggaatttaggattgcaggacattctttgacatttcataacagccaggggagatcaactgtggtcaggggacaggggcaggaagaaaccatggccaaggcctgtctggcaggacttgaaggggcagagggacccttgcaaatgaccctgcctggaacccacccccagttggcccctgtatagcactgatccagctggggcttttatcccaggataccctcttcagggatgcctgtatttgttgattatctgccatatgcctggtcactgcagaatacaaggaagaaaatagccttcagcagaagctgagacaggagcctagaggatggacagtaaggagtcgaaggctcaggatgaggctttcctgactttctcccctagaggactgatgttctctactggtacagaccttgttttattcatccttatgtccctaacctggaatgggcccagggtgacagttataataagtgtttgtcaagtgagcaagtgtgtggagtgtgcattgtagagagtaaggtctctacaggatcctgctggagaggcagcccactgggctcaccacttctccagaggagggactggtcccttgccagacagccctgccagctggagcaggcttcctcaggggtgcctggagctgttgaccatggctgttgccctctggcccctcttgggaagagcaacctgtcaggtgttaaagacggtcttcatttctcttctccaagtaaacatgactagtttccatctcaccatcttctggccctcagcagactggttatccagtctggagaggcaacagtagtatccagatgtgatccgaacagacagaacgatggatgcagacggaaaattcaggtttgtgtgcttcggcagtcagtatatgcaagtcgtaatggggacagtggctggcatggcctttagcactgtgggaaggatcagggtgtctgcccatcatttttctctctttgatagacactgtttacgtagacactgttttggtgtaaaaccctacgttgtagctcttgtcaacagtgttatgtttctcctcaactgtcctggaaactccctgaggtggctggcttgtaggcactccatacctgttagctagtattatttatttattgttttattatttgaatggacaatcaattcatgtcatttaatgaacatgggctatgtgccagaaaccaccaggtgccagaatacaacactgaactacagtaggcctgtccctgggccccagagctcccagacacactaggaagacttgttgatttaatgataaaccttgattgagctcatgattaacatcttcaccaccagacatcattgagtgctctctgtgtgttcaactcagaacatacccttcctgccctcagaggctggaatgtgagagtcattaagggagacaccattgtgggagtgagaaaatcctggacttggagggaactgactagggatcacctcccagctctgccatggacccactgtgtgaccatgggcaagttacttgacctctctgagcctcagttatcttatcagtgaaactgggttaataatatatctctcagtggcacaggaggatcacatagggtcaccacactccacaactccaggagatgctgttaacattttagtctatggatcctctggtggcctaagatttaaatgagagcacttttgctatgtgacctgaagttaatgtcaataagttatagctattgttatgtacgatgtaagcaggggtcactgcaggccagaaggctgacacaatttggccaggctttgttcttcaaggaagggcagggctctgagaagtgcagaccgtgatgcaggtgaaggccaggaggcagggactcccagggcaggtctggaaggagcgaggctggtgacggaagtggtcagcaacctcaaggcatgagtaaggcgcttgcccttctctccaggcacagaggagtcactggaagctgggcaaagagctgggatggatgagaccaaggcgaatactttacttattaagctgcaaaggaccctagggagcatcttgtcttaccaggcaaacaaaggccagggagggaaagtagtgagtctccagggtcacacagcaaggaccagggcccgcgccaagactcccacccctgcagaacccagctcaaatgattccttga

SEQ ID NO: 360 - DNA, 89703 bp, Homo sapiens
ttctttgcaccacagtttcatcactttttatgaggaactaataaaggtatccacctcaaagtcttgagaattaaataagaaaatgcatataaagtacttaacatagtattgggcacatggtaagcattaagaaagtaataactctcatcgtgcttgtgtattgatgatcgcagttagagttgttatcattattatgtttattttaataattatgatgatgttgaatttctatctgctggcttttaacacactttaggatataagtctagtgaaactgtgtccaaaaaattctagactttgtggaaaccctagttggcagagcagaaggctactgatcagagatgggtgattgttgagagttccccatctgcctccccatgctgtttggtgagtatcattctctttaggtttttgctgtgctggctgctgggagctccctaagctcattttctgttcctcaagtggaacagagaattcctacgcttccttctctaaggaagtgtagtttcatactgtgatttcagcagaaaccactaattttggccagcattgccccctgaaggagaggagcaggcttcactcctgcgacagctgactttctgttcctttctgctgttgtctctgtgcccagtgctgaagtccctggagatgatcatgaaattcagggtgaccaggttgggcagtgaggaagcggagaagtctcccagcctcctctcacacctactcctcgccaaatctccaagaattaaaaccagttggcaatttcttggaaaaagggaatcggcctcttaaatcttgagaaaagaaaaagggtgttttttttttttaatggctattttgttcctgatgatcctggcatttgtaccccatgcagactctgaacacgtgcaggagctcgttccacaaggcagcctgctaatttcatttgccatcacagttttcccatctgctaagggatgcacccagacaattttccacatataattcacagtcctttgtaatttaggctcaaatagaatcaacagcttgatcaagacgccatggcaaggacttcaagggcagggcttccattgtctcccatcttttgtgagtgcatcctctctctggccgttctctgcgtctctgtttatgtctcctcctaccttgtttcacagtccctcacaatttgtatttgtccttctctttcatcaagcacgatatttctgtcttgcaaatgtgcaggtctaacaagattcctcccatagattatgcagcacaatgatcatttttgggccccaacttgctaattgcagcccccacccccacttcatctggccaaggctaagatggatgctcaatttgcattatttatgtctttttctctgtgtttctggtgatggcttttgcataacataggtaaaattttgctgacatcaagaattcatttggctcgagatgctcaaaagattgtaggagtgggggggacccggtttgtgtaaactcaaaaaccatcagacatccttgctctcatctgtttcttagagaaaagtgggcatttgctcctagcattggaaggcggcttttcatgagagttctctggattaccttggacagtcaggtgagctcttttgtttaaagaactttggttccttttgagctgtcagtaccctttctttgaaagggcagggcaaggcaccaaggctcattttaaagttcaaacacaagtccgttgccacattgcaactacagctaaagatcatcagagcaaggagatctcagacagtgtctaatttgacctccatattttgtcgaggaagagactgaggctcagaaacaagcaatggctcaccaaggtcacagaactgccaccagctagttctgtggtctatcattttatttggtccttaaatcccctccaatagaacagcaaccttaaagggatcagtcactattctaagcacttcgcatatattatctcattgaatcctcataaaatacctattcactgggacttgttgctatcaccttcgtttcatagatgagaagactgaggcacagagaaggaaaataacttgcctaaagtcacatggcactaagtagcagagtttggattccaccccaggtagcctggttcaagactgcttgatgtaaccactctgttctccaacctcgctgagctgccccattccccatataataatgcccaaattccttattttgcaacataaagccttctactcctggaaaagcagcctggtattgggaaaggcagtctagtgtgggcagttttgtgattctgcttggccacataaaaatgggccttgggcctagagctcttccttaccaagaggtaggggccctcatagcctgtgctgggctcatcaccttgtgcaggaatcttcctctatttcaaactcaatgagtactgcttaggcgcaggcatggatggccctcaggcatgtcccctcacctgccccccgccaccccttttctgcaattcagacccccatgggggaaggggaggggtccttctattctccacaaagtggggtgcatgtagccacatcacccacttttgctgcagggtggatcgatggccctaggggcaatgcactgccagctggatctcatgcacactgtctctactctcttgctgtaagagaactgaatgcaggagaaccaaggaggctggtgtgtgtttgctcagctagcagcctctaatcatgcactggtctcttccttgggtggcactcatctgccttttaaccttggctgtacttattatattctattctgacacgcagcctaacacccagggaactgtttatgaagctgctatgctggggatgactttttggctactttcatgcattcactcttctttgggtacgcacggattttctcctggagagatactcttggctccagcagaaggcatgtgactcaggactggcccattagagcatcccattccacgtaagagctgggcgtgtgatccctcagagccatgtgctggaaaagacttgcttataccatcaagagagaagtaagattctctcttctccaccagagctcccagagctaaggacatgaggtgggagttatccatagttgtctagagaatgaggccactatgggccagatcagagctgagatgaagaggtggagagacacagggtctctttgataccatcttaactcttaccgcaagctgagcccaaagccagctactctctagaatactaaattccatgagccagacgtttcccttttacttaagccagtttgatttaggttctgtacttggaacgaaactctcaaatgattactgggcttcaccaagttcttagtctctccacctggccctgccgcctcaagctctgtcctctttgaacttcctcttttctcaagctgaagtgccagtaagaagatgcaagtcaagcatcttgttgcattttgcctgtctccctcctctacaatgtaagcttcgtgagaggaacaaacaaagaaacaaaaaaacctaacctgtcttattctcactgctgtagccccagtgccttgaataagtcctaggacagcaataggcacccaaaaaatactgttgaataaatgaataaagctttccctgatcatcttccctctcctccctttatgctaagttgctcatcccctatcagacagtgttacattattcatcttatacattccctttcctaaattatgaattctttaaggggcctgatacttctccatattccctgtgcctagcagagttcctggcataaagtaagggcccaaaataatggttaatagaaggaatcaattgattaggtcaacagaacactcttcattataccatctcaagctttcttagctccctggttgaggtttgccttatcccattctctggcatcattcataatcaccacctggggctcagctgatggacaatggagcaattaactttctaatggccaagatatgaaccttcctccttcatggtcaaggcaggaggaaaggacacaaagaaagggctagctaccactctctgggttaggtgatattcaagctaggagtactggctcagaaaaggaacccctgaaaaataacagaaggaggtggaatgcatgcattcaatccacataacaatctccttgtgcaggaactgcacttggtttcatagtgagctcaagtgcaatatagtttgcagttacttttgctcccttacttagctttaaagctttaacctcactttgctacaataatgactgccacatcaatcaggtctggctgcataggattatcatatcagtctatatgttccaccaaagagtaaggagataatataactgctattacattataagctcttgttgaacaataaaccatgcttttatgatttataacaacacatactatagtatttccatattaaaagactagagtgattttacaaaggaaactcttggtagacagtacttaattactacatatgatatgtatttcatatgcataattctgacatatttataaatcatgttacatgatatattcagaaactctttataagtgataactgtattttcttttcttttttttctttttttttttttttgagatggagtcttgctctgttgccaggctggagtgcagtggtgtgatctcagctcactgcaacctcggcctcccaggctcaagcgattctcctgcctcagcctccccagtaactgggattacaggcacacgccaccatgcccagctaatttttgtatttttagtagagacagggtttcaccatgttggccaggctggtctccatctcttgacctgataactgtattttctaagccacttgcttccaaatgcaggtttataacaaagcttttatggacccagaaaaataagggcaatgatattagatatatcttatatgtgtatgtatatagtatgtgtgtatgattataaatttatgaatgttctttcttgggaaaaaaggccatttattcaaagaccacagactcacactttttttttttttttttttgagatggagtctcactctgttgcccaggctggagtgcagtggtgcaatctcagctcactgtaacatccgcctcccaggtttaagcaattgagactcacttttttactttttaatatcaccaacggcaagaaaaaagggcaagaaatgtcctctcttttatgaaataacagtgtttgttatactggaaaaatattggggtattatacttcaatctcctcaattttttgacattttaccacattctcggtttattgattttacttcattagctcataaaattactccagcaagggctctcatgctctgacaaaacccacaatgggcccaatcctgacactgcctctctggaagtggcccataccccaaattgtccctctctaaaccctccacctctccgcccctctggtacctgtactcaccttctaataggaggaaaggcatggagagctatgagactttaactcaatgcttttttcagagtgcttgcattattaaacaggatgcatattactccaaagggtgatttcttatcatgaaataagcatgaaatattactcttattactccaaagagtaatttcctatcaggcagtgaggtcaagtagggtgaataattgcaatcagcattggaaagctaatgttgagcactttaaattagaaccctcagctggctctcctgaatgtctgtcctcaatgtaaacaggttgctggaaaagccagagcagcagtctagtgatgccccagaaaatagtctttcccatgaggtcggaaataagaagtcatttcaatatcagtatggaagtggagctaagaatagtaatcatctgctggttatgccacaaacttcttctgtttcatttctcactccctttatgacctttctttcttcccactttttattttttacctccctcttgtcacaaaacactttctccaaatacttgaaacatatatttagttggtacagctagctacacattgatatgatctcttgtgcaatttggataatggatttccaagctttataaggaagaacaagcccttttccttctctcccagaaaagaaaatgagatcaaggacccttggctaagaacataatcaagccttattcaaatagtaatcttcagctttttctcttgaaaactaagggaatgtccatccaaatcccaaagaggagaaagaatatgtggagagaagaatgtagaggaaagaaccaagcaacatgacatggaattcatggagatagctgtatctattcaattacagcataggaaatgtttctgctcttcctaaagagtttgggtagtcctgtctgagagacttaatgctcgtttcgggagatgtgtgcatttaggacaacagtcatgcctgtaactccagctgcagaggagactgaagtagacaagcccatggccaccctaggtatgttttatatgccttcctccacacccccaaacagtattgcccttctctgagacctaggatggcaatggccactacttctgatcctactgaaggtcctctctgcatctgtacttttctcagacttggggaaatacacaaagagaagtagagttgaggaccctacttcagttcccacttctgtaactggtcaggaagcccaacttggtcatcacagctgccttctccccacccttcctatgttgtctctacccactgccagcaactcagccaggtaggctcttacctgatgggatgaccaaactttcaatctggaataatctgagtgcttgatagccttggccttaactgtgttgcctcacttttccagtgccagagatttttgggcaagggagtgtggagactggattgaaaggcagatacagacttaaatttgaaaggttaagaaaggtatgcaaaggtagcattattgcctaaaatatttcaccagaaaggtgaacctgagtctgatcatgcttctagctttaactaataatttactgggaaatacagggaaaaaggccctgatatttttaataaattgagaaggaagctgtaggggagatatttaaagactaagaaaggctaagagatttaagagacataccaacaaattgccatgtgtgaaccttgtttgaattccgattttaacaaacagcctcttccacctcattaagagataaatatccagtacttttacttttcatgcttaataattttattaaagtttatattgttgtttgttaaatatcagtggtagaatttttaatacaaaagattaagggcacaatgaataaaactattaatttcaaatttgatacatattttcgttgcagagaagtaaaatgttcaagaaaagtcttttaagtatgacaatacatttcattaagataaaaccatatggagaaagtagaatataaagaatgcatttatagagataaagaaatgtaaaatttcaagagcttgtttctatattttttttaaaatagtgagataggcatcaaattgttatgatacttaggttctgtggatacatttaaaagagtaatatagaccaggcgtgatggctcaagcctgtaatcccagcactttgggcgggcagctcacttaaggccaggagttcgagaacagcctggacaatatggcgaaaccccagctctactaaaaatacaaaaaaattagctgggtgtggtggtgcatgcctgtaatcccagctactcaggaggctgaggtgggagaattgcttgaatccaggaggcggaagttgcagtgagtcgagattgcaccactgcactccagcccgggtgacagaacaagacttcatctcaaaaaataaaaaaaataaataaaagagtgatataacagtagaaatgtgccagaaattgcgtccttcataactgtcaaacatgccagaaattgcgtcctttgtaactgttacaacttgtgatttaaaaaatttagatgctaacttaaaagtgtgacagggtccatagtttcaaaattctttcaggggaatctaagaaaaagagattaaaaatccttgctgaatccactaatgctcaacaatttttttggactcgtgttcgttttcttgcattaatacctatctactctcctcagaatgcattttaggaagaaaaatttatatactctaaaagtctttaattgctacagtggtaccaagaggcttgtgcttcttagcatcatttattcattattcatttacttaatacatttcagttgagcagatactaggttcaaaaacctgtgccaggtcccacagaaatacccacagggatccggtacagatcctcctgttaaagagcctagcagtgatcaaactcttaagctctgcccttgtttaacacagtcagataagcccagtgagactcttgcagtaacctcctgaaaattgaaatggtcttaagagggtcttgcacaaccactattgaaaatgagtaaaaactaaaaaataatatttcaaaaggtatgttccctaattgtactcttaattgaaattgcttcttggttctctggtggcacctctggaaagatgaactagaagccaatttataaggaggtcagtgtcagagaatccatccttattactggtaggaaaaaaaaactcaaggaggacaggctacagagtgatatcaataatccagatctgtcactgcatgcccctagactttgcaaatgccccaaagattatgtgtacatggagttctgatctgaatatgatttatctgccgcagtctgaccagctctgttgaacagagtcagctatatttttgggggcttagaagatgacattaatattgcccatatttatcactgtgcggagacatggagttgcaagctgcagttctgagttctgtgggtacagagtcgcaagtgtatattggtttctgatgtgtgaatgatgcatgtgttaaacccagtgagcttttttaagaaattttttactcttttatgtatttctatctacctgccttccttaccgtacacaaactcacacactcatttgtccattcttacacaaaataatcccttctttgattattcagagaaaagcccgtgtatgactgggacgtcgaggatgcaaaagtcactatttcttagtgaacagtactccaggcctgactcctctggcagtacatcaacaggatgcagttctgcaactctgctttttatcagttttgtgttttgttttgttcttagcaatcagaagagcaatcgcccacccattctctcagcgattacttaaaacatcaagaagggatctagcccactgttctcagtgatgggctctaggcattataaaccaggcatttctgcttgtcaacattattcactcagtcaacaaatgcttattgaccacctatggtatgcaaagccctgggccaagcattagggagaattgtctgtatttcatagattctgaaacagttatttttcaacatttgaatgtctctgaatttggggagtttacttggcaaggcttttttctttcttagtgatacctaaaacaatgccgtcctataatcaatggcctctcagatttgatgaaatcctacattgtccatgacatctctgctttcaccaaaaaagggattatacagaagaagaggaggtaaaactcagctatcagtgggcttttcactgatcgtcaactttcagagcaagagaagtctgagcttctgtggtttgaagatgatctgtgtgtttcatctcctcgtgccctccctggccttacaagctgtcataacttcacatggattacctattattatcctatagttcttaaaatcacaaatgaattttttattgatgttgggggtgtgtgtgtggtgctttctgtaaaataattcattaggaaatttatttttcatccattattgaagccatcatttgaagagactgtttcttagaatatatctaccatgtggatatatatgccagtggaaactagttaaaatatttttattaaagcaaaataaaggtttttttgtggttgtttttgttttccctttatttatccaaacatttacaaactccctatgatgcatcagacactgctaagtactgttaggagacagtgacaaattggatacagtttttggcttcaaaagacttacaattaaaggaaggataaaacctgtaactaccaatgctcatatagggaagaatgagtgagtcctggggccaagatccaagaatatctgaatgaaatctgcatcattccatggcactacatctaccattacatatcacaaaacaaaagctgttcttcctttcctcagaaacacggctgcatcaggtctacccaggtagaccacagaatgatgaaccaaaacagcccttccacggttgatatacaaagacaactcccaacccctggtggatagaaaggactgcatattttgaaaactttacaataagccaagtgttccatgcctcatatacctgctgtcattgttttctacccactgatcagtgttaccactgtgtggtttctacccactgattggtgtttccacccagtagtcagggtgctcccctgttctccttccataatgtttcgtaccctttcacccctgctcagcttctcccagacccctccctcacgactttttaaactggctttcagaatcttttacctttaattcccttgtaaaatgctccctctcctttatttgaactataagctctttgaggacaggaaccaagcatggatgacacagagtagacaatgaaaatatgctttgctttgtcaaggaaggatgagaaagaagagaaaatagcttatcttcttgaatatgggagtttaggaaactgaaaaaagctttggcgcaccgacagagcaggaaattttaccatagaaggctgaaaaagttcaatcctgggtttcccctcctggaactatctgataccagtgaatccttatcttctttttttgccccagcacacatgacagttgatagtcacatgaataacagattgttgtgagcaaagtcaatttatctggaattctcacatgattgactttcaagccacctttctgtcctacttgttatacaagtgattaaaagtgacgctaataaagagataatattgaatccattctaatctatgggggaaaagtaaacccacttgcagattttgctatttcatatttagtaacatgcttcttgagacaaaccagtctgtggatgctccaacactgtcttcagcccctggccctgcacaccctcaggacagcttagcttgctggccacaccttgtgccaagacccagaagtcagaattcacagccacaggagctcttcccacagctgggacccagaaatggttctactttcttctttcaatatataaaggatctgtaaacaaaaggaacaaaaggaaaagcagaaacattatcaacatgaaaagaaaaccatccattctaaatatgtccatttattttaaaacaaagcataccaacacaaagctttatttctagtatatccacgtttatggtgcctaatttttagagcctcccatcttggggggcgagcctttataacatttgttgagtaaaattaactgactcatcattcttcttctagtgatgcagtcaatgtttgtagtttatttgaaactcaaattgaactgggtgttttgtgttttagctggaatcttatccctagagactgttgcttgggattcaccaaacactatatccactacttctgatcatgaggatttgaagaaataagtacttaataatggtggcacttccagtactggggatcctatcaagaagaaggattggagacctcctcacatctcagaaatcacaatacaggcaggggctctacttcctgtatggaaggggacccacgtcttcatagctgagaagggaaggcagcagccagcaacaaaataaaagataaaagggaagccaagcacttgcaagaactacagtagataccatcttctgggccctgtactgcgtcccctgtgctatcccaagagagctaattctgttcagcctccttccctcctgagcctctgagaaagtagagaataagactatagttcagtggtttgaaagccataatattctgacaagggttcaatttatgttcagcatttttttttcttttgcatcccagtcaggacttccactcaagttctcttaaaggaaggtaaatatttacaggtagaaaatggcactaggtgccttgataagttcaaagaaacagttaaatttgtgtgtggatctttgttttcttttttcttttcttttttttttttttgagaccgagttttgctcttgttgcccaggctggagtgcaatggcacaatcttgactcaccgcaacctccacctcctgggttcaagcaattctcctgcctcagcctcctgagtagctgggattacaggcatgcaccaccatgcccggctaattttgtatttttagtagagatgggatttctccatgttggtcaggctggtctcgaacttctgacctcaggtgatccacctgcttcagcctccctaagtgctgggattacaggcgtgagccacggtgcccagcccgtggtatggatcatttaatcaccatatctggaatatataaacatggcacatattctctttgccaccccctgcttttttgtagcctcaaaatttgatccaagactgggagttaaaaagtcccattttgtgtaatcaggttctggttgaacatgattgctgaattattttaaattaaagacacatgtctggggattgagctgtatgtattatttcaggatggtgtccattaggccttatccacaggggctatcttcaacttttgccacattcaatgcattctttatacatcagtattttcaaaatggtgaatcacatgtaagggaaaattggagggaatatggtactcgttaaatggtgattttttgaaaattatcttgaacgcattattcaaacctgtttccagtctcccctgctaagggccccactgctggttggaaaagttctctggggggagaaaaaacaatattttaaagtcaataacaatgcataaataaataaaatcctacagttgtgcaaggcccttttgcaagcctaaatctttgaagactttacaactgaatcaacatttactttaactccttgtcagccctaaacactttaaatgtcttaattgcagatctaaatcattgcggctgccatcggtttttcactttgaatgcagatgtccctgaactgaggctttgtcagacttcacctcgtaagggcagcctgcctatttaataaatcgttgcatcatgtcaagggctcctgcccggacttacaggtcgcctttcgtgaggagcagtcagggtgagggaaactgtgtggctgaattcgtctgttggcccagccacatcaggcatccctccactccaaagatctccttcctgctaggagctggtgcgtctgctgcatggttgttcatttgcacagctttatggaggtattatttacgtatcataaaactcactcttttgaagtcaaaactcaatgatttttttcataaatattcagagttgtgaaaccatcactgcaatctaattttagagcaattccatcacccccaaaataaacctcatgcccatttgtagtcattccctcttcccacctctggcccatggcagtcactaatttttctgtctctatagatttgccttttctggacattttatatacatggaatcatacaatatgtgatctgatcttttttactttgcataactttgagatgtgttcatgtagcaaggagcaatacttttttcattgtaagtaatattccactgtgtagatataccatattttgttcacccaggcatccactgatagacattcatctgggtcacttccactttgcagctattatgaaacaaccttctgtgaacatatgggtattttttaatgaattggaggtcagattgctattgtcattcacagtcaactttaagttgggcttactcttttttcaagaagtcacccatatttttgttaaagctgcctattggaacattccagaataaagtagactcctgagggcttcaaaaaataatatttatcagagtgagaccctcggtaattccagggcatcaagtggttaaacataagggagggaaccattggaaggaagtttcaagaccaagagcgatttgaagagcagcaggagccccttctatgccagtcgtgacccagagtttaaagagctcagacccacatgcgcctaccacgcaagtgttccttctggcagcctcggcactgccggacttctgcaagccctgctttcttaaataacatgggggctactcagggagaagtcaagttggaagtggcaggggaggtgaacaggtcgtaacacagggaacggagttgtcaggctttgtttattttcatgtcttctaagacttcagcgactgataggagaggccagccattctgccatcgaggaaggagtgttgtacttgatgcggaagcagctagatcaaaaggcgcccttctgtgttgccccaaatcacccatctagagccatgaaaaatccgtgtcatgagaaatcctttccccagaaatcatcatggaaagcaggcatataaaaggcaaactggtttaggaaatgtaatgttgatcaaaaggaaagccccgcgtcctgggcctggcacagctctaactctgactgtggccttgggcaggtcactcaccactctgggcctcggcttcctcgttgcgaaatgagagagattgacatctggatttctgcctgaggttttttttcccacattcaatattctgtttctctgaagactatgaaaactgaaacttttgaaacccatatttaaaagtgaaaccagtagcatcatcccattggcaatcaagctactgatgtcaagaggcatgatctggaatgccaaagggtgaataattagcataaggaacacaaggtttttaaaatgttgcccagtggcacccctcctttattttgcagataggaaaattgtggttggtttttttacatattctcttgcaggttgtttagcttctttgtgtcggagttaggaattgacctaacattttaggacttccagaccttttactgtatcaattaatccagattgcctaggagaaaagaaaataatcattcaagagcctgtataaaataggccagcatttaaaaaaaaaaaaaggaagaaactctgaccttctagccaaaaacaaaagccatattattcttgtttttgctttatgatttcggttcttattggaatgatgaaatcctgctgaagaaagaggatgaagggtggttacagtctgataataaatgatgaggctgatggacacccaagaagaaagaatgttcctgttgagaagaacgtcagcatgtctcttcctcccttttcctcagttgcttatgtcctctcttgcccatggagccatctgacatctcttggccaggctctcagacacatagccagctttggagggcttaacacgctttcattaggactttcaagtacatatcttgctggaagccagcgatctcggtccacttccccatggcaacaaccagccttagagttcacagggatgcctgctcctttgaactccgtacagagtattccagagccctggattttgactgtcctccaaagccagtggccagcctggtagtgaaagaaatctggggacagatggtatgaaattgaaatcacataatcactaccctctcccaaatgctggcctgttatattagcgagtctccacaaagttctgtggcactcatgctggtcttgctggaggcctgcatcttaaacaagggcgcctgaacatcagggctgatgaagagctggcccattaaagaggaatttcatcaacgtcgtgtggtccctccgtgaccatcagaaccacatgtgcatttgaagaagtcctcatgccactggaccaatgacaaggtctctttcaacttagacccatctgttgttgaaaaactactgtatttgtgagaagccattctgaggtggaaagggagtctgatctttgggggaaaacatggctacaggggttctttcctctgaaaatctgtaaatttagctaaaagttacttcaggagaaaaagccattggtagcaagaacttggcatcatggaaagatcccaacatcctcttttgatttactgtagatgtctggcaacttctctttgcttcccctctctcaattgtaagatagaaatggtcagtgttcatgttataaaccaacatttgcctgcccgagctgaattcttgtcaacctctgaagctactgagtggggaatgaaagaaagtgaggggaggaggaaggcccctggtgcaccctggaggaacagcacagattccagctgaaatctacatgaggctggctgattccacttcttccaatcctcaactttcatcaatgccagcaacagcatatgggacaataggatgctttggttggcatcgactcctggcctgatggtgttagtttattttcatggcaaataattatattctctcctttcctaaatatttcaaaatggtgcaaataatatataaatccataggcataaaagtcattagattcttcaagcaagggatttttaagaatacacaaaatgacatattagatttctccaagctcttactcaaaaaaagcaaataaacatttatttattaaaacatgcttgtctcattttaccctattgtcatccaaaaggaggaacaaaggcagagaatttggagtttaataatttgtattttaaagtgcctcttccactgcttactacttggatgattaaaaagagtctgaatttcagttgtcttatttgaaaaagtcagtatgataatagtaaataaaaacaagagcaattttaagggattcttgtaaacattaaaaaagttattattataaatattaaaagtacatgctttttaaattgtaaagccttaaacaaaaactggttattattgtccatggagagtaaaagtgaattcaccaaaacatctggaaaaggtttgtcttttgcacagggttgtttttagtgcgagatgaagagaaaaattctgagaatagcatgatgagaagtgagctagtttctacaacttctttgtctgcatttctctctttctgattatgtctccaaaacttcctcgcttcttgagcagaattctctatatttcataaacagggagacattgttgtcaaaagaactcaaacttgtgtttgagacaatcctcctgccgtctcctatctcttccaacacctttcctcagagatcagatacattttcctggcaagatgttcattattcagaggttgctttgcaatttcctacaatttctgttcacttgcaaataaaaccatgcctttattttaggatatagggaaagcttttaagaacagaagttaaagtcaagcatgaataaattttatgcatggcaaatatagactttgataacattgtctccatcagggttgattgtaagtgattcatcactttcttactcatgttactgatagaaatactggagttctgagtttgtaaattaataaaaccccttatcgatagcacaatattcatttaataatatattcctaacacagacccattgtatgaacatacattgattgcattcttaaatggatcacattactgcatttttatctatggagttggaattatccatccctctagaagccagaagtgtcatgaattttctttagctaattcagagggaaaagggtgaaaagactgggggccaggaggcaagacagcatggtgttcaaaagaaaggtggccttagattttgagaagagatggcatgctaaagcactgtgccttcttcagtttatctacactgccaaaagtctttatggaaagtatagtctttggattgcactggccatcctatggacaaaacagtaagatgttctttaaaatgttcattttcatctatatgttaaggagacaagcagcaagctttagcaatcctgctagctaagtagttctgaactttttctaagggagatgggcaaggatacttttccaactctgatgaagattcctcttccaagcaaaaaacaaatataaaacattgcctaccaattcaggcattttatgaattgcctgaaccccatttacttcagctattaaaaatagctgaagtactccatgcctcctgaatgtacccctttcttagctctttttcacataagtaatggtcatgttaacaacagagactctcctttatatgaagccatatgtcataaatagtatgtgatatgatttatatggtcaatagtatcaataagtagtatagtcatacgtcataaacagtgatatgatttatatggtcaatagtatcaataagtagtatagtcatacgtcataaacagtgatatgatttatatggtcaatagtatcaataagtagtatagtcatacgtcataaacagtgatatgatttatatggtcaatagtatcaataagtagtatagtcatacgtcataaacagtgatatgatttatatggtcaatagtatcaataagtagtatagtcatacgtcataaacagtgatatgatttatatggtcaatagtatcaataagtagtatagtcatacgtcataaacagtgatatgatttatatggtcaatagtatcaataagtagtatagtcatacgtcataaacagtgatatgatttatatggtcaatagtatcaataagtagtatagtcatacgtcataaacagtgatatgatttatatggtcaatagtatcaataagtagtatagtcatatgtcataaacagtgatatgatttatatggtcaatagtatcaataagtagtatagtcatacgtcataaacagtgatatgatttatatggtcaatagtatcaataagtagtatagtcatacgtcataaacagtgatatgatttatatggtcaatagtatcaataagtagtatagtcatacgtcataaacactaaccttttttctaaacctttttagcccttaatggtcagccgaggacaaagacatcatccttttattaattttttaaatgccataaagttaataaaaagtaaaactatttcctggaaaagattccccaattctttgctttccagaaggaatctacatctctgtatctatttatttaactattagtcatcactgcaatgaacactttcttaataatgaaacaagtaaaatcgatgtgagaggaaaatcttaattaaagaaatcctagctaaagaaagagctaaagaacgtagtaattcctttttgtggaaaatgggtgaggagtaaagaccttttataagaaataaatttcctatgcaaataaaaacttggttttattttttaaatacaatattattttttaataatgacagaagacttaatgtgtcagtttttttcctcatttcattgagaattaagggccaccaatactttttttataagatacatcaaaagcacataaagatctttcaaattttaccaaaggttttcatttaattaaatcgacttatttaaaagatattattttattctgaaataaatagttgcataaattcatattcttctttgttaacaattttaaaaacatttcttgtataaaaaatcaaaagcagtagatggccgaataggaacagctccggtctacagctcccagagtgagcgacgcagaagacgggtgatttctccatttccatctgaggtaccgggttcatctcactagggagtgccagacagtgggcgcaggccagtgggtgcgcgcaccatgcgcgagccgaagcagggcgaggcattgcctcacctgggaagcgcaaggggtcagggagttccctttccgagtcaaagaaaggggtgaccgacgcacctggaaaatcgggtcactcccacccgaatactgcgcttttcagaccggcttaaaaaacggcgcaccacgcgactatatcccacacctggctcggagggtcctacgcccacggaatctcgctgattgctagcacagcagtctgagatcaaactgcaaggcggcagcgaggctgggggaggggagcccgccattgcccaggcttgcttaggtaaacaaagcagccgggaagctcgaactgggcggagcccaccacagctcaaggaggcctgcctgcctctgtaggctccacctctgggggcaggacacagacaaataaaaagacagcagtaacctctgcagacttaaatgtccctgtctgacagctttgaagagagcagtggttctcccagcacgcagctggagatctgagaacgggcagactacctcctcaagtgggtccctgactcctgacctccgagcagcctaactgggaggcaccccccagcaggggcacactgacacctcacaccgcagggtattccaacagacctgcagctgagggtcctgtctgttagaaggaaaactgacaaacagaaaggacatccacaccaaaaacccatctgtacatcaccatcatcaaagactaaaagtagataaaaccacaaagatggggaaaaaacagaacagaaaaactggaaactctaaaacgcagagcgcctctcctcctccaaaggaacgcagttcctcaccagcaacggaacaaagctggatggagaatgactttgacgagctgagagaagaaggtttcagaggatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcaagaactacgtgaagaatgcagaagcctcaggagctgatgggatcaactggaagaaagggtatcagcgatggaagatgaaatgaatgaaatgaagcgagaagggaagtttagagaaaaaagaataaaaagaaatgagcaaagcctccaagaaatatgggactatgtgaaaagaccaattctacgtctgattggtgtacctgaaagtgatgtggagaatggaaccaagttggaaaacactctgcaggatattatccaggagaacttccccaatctagcaaggcaggccaatgttcagattcaggaaatacagagaacgccacaaacatactcctcgagaagagcaactccaagacacgtaattgtcagattcaccaaagttgaaatgaaggaaaaaatgttaagggcagccagagagaaaggtcgggttaccctcaaaggggagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgggagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatgtaaatggactaaattctccaattaaaagacacagactggcaagttggataaagagtcaagacccatcagtgtgctgtattcaggaaacccatctcacgtgtagagacacacataggctgaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacaggagcaccaacattcataaagcaagtcctgagtgacctacaaagagacttagactcccacacattgataatgggagactttaacaccccactgtcaacattagacagatcaacgagacagaaagtcaacaaggatacccaggaattgaactcagctctgcaccaagcggacctgatagacatctacagaactctccaccccaaatcaacagaatatacgtttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagtactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagggacacaaaaaacccttcaaaaaatcaatgaatccaggagctggttttttgaaaggatcaacaaaattgatagaccgctagcaagactaataaagaaaaaaagagaggagaatcaaatagacacaataaaaaatgataaaggggatatcaccaccgatcccacagaaatacaaactaccatcagagaatactacaaacacctctacgcaaataaactagaaaatctagaagaaatggatacattccttgacacatacactctcccaagactaaaccaggaagaagttgaatctctgaatagaccaataacaggatctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcatttcatgaggccagcatcattctgataccaaagccgggcagagacacaaccaaaacagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaatagatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagctaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgttttcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaactcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacaatccatgctcatgggtaggaagaatcaatatcgtgaacatggccatactgtccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccacatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaatacatgaaaaaatgctcatcatcactggccatcagagaaatgcaaatcaaaaccactatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaacactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggtcacaggaaggggaatatcacactctggggactgtggtggggtggggggaggggggaggggtagcattgggagatatacctaatgctagatgacgagttagtgggtgcagcgcaccagcatggcacatgtatacatatgtaactaacctgcacaatgtgcacatgtaccctaaaacttaaagtataataaaaaaaaaaatcaaaagcagctatagccaagttaaacttcaaaaattaacttcaaacaactgaaaattataaaaggcatatgtttttgttttctttattgtatccccaggtaaattatggtattaaaaatacctcagtcaagggctttactcatgccataaagcctcatgttacttctcaaagaaacgagaaagaaaataattatatatgggtagattatatggtgataatattgtataagaatactttaaatggagttgccaagatggttgctttatattaaaaaaagtctataaaacatataattcataagtggactcttctgcattagtagagtgaatgtttcattttcagaattacagacatataaaaatcatacttccctgctatgaaagaccagtaaacatccttgttttctgtaaaaacttaaatgctggaggccaatactcacaaaacataataatatttctgctaaaaaagccaacttttttttaatgaggaaaagaaatcaaacatatacatcctaagtgcaatatttccaaacttttaaaaaaggacagtatgtgaaattgccaattctatatttttaatttgctcatgtttgctgaaatcaattctatttacaggaatgaatggaatcgttaaatacatactgatgtgactggctcatctcattttaccttgctttgaaggaagccagctcttattggaaaaagacaacaaggtaaaataagaatgggactttttttttaatgtttgtgaagcaaaacaaacaaacaaacaaccccacaagaacaaaaagcaggaacaactctctttcttttaaacacctgttaccattaaactctggggattttatgcaactggatacctgagcaatatccacggtacatgccttacaaaggagtagtatgctaagtttctctttcataatctggaatgaagaacattttttcttagaatcaaatattccactggataggaggattctctggttgactcacaaaattcaaaacaacccacagtttagcttgccttatatatgaataatgtttaagcagcaaacaaccatcagaaaaaatactttctatagaaaaatgtactctatattccatctcacagtgccagaagtagctcaataacaacccagaggcatggctagcagttggagggaggaaggaagaacaggtcagctaatcttgaccaccataaattcctacattctgtaatgttgtttggaaaaggtaatattgtctacagccatactactctgaacacatccaatcttgtctgaaaaaggtaaaattgtgactctcataaaaagataaaatgaccttgtttccaagatttttttcagctcattaattaataagggataaataagatgttataatcagatcaaagaagaattcaacaatccacacatatatgggtaataaggaatgtcagaaataatttacaacaagatgcaaaaggatctatctgcaggcaatgatcaattacattccaccaggtataataaatttgacttctatagataagaattattttccttattaccagttttctgcaacttgcaaaactataaaatagctcaagaacaataaaatgtggaagtaaccccaattatacccatctaattagacagaacacttttcttttatttatttcaaagtacttcataattttccctggcaatatatacaacagtagagtctattaaggccaatcacatccttgatgttgtgaattggggaggaaatactgaattccggatagcaatactcccactgtctattaataaaggctataataccagtgctgtccggtagaaatataatgcaagctaccaatgcagccaacatagataaattttacattttctagcagccacacttttaaaaacatagaaattgttaattcgttaagtttaataaaatacataaataactaaatgcaaagtattatctcaacatataatcaataagaaaaaatatcaatgagatattttacattcttttttgcattctgtgtcttcaaaagccagtggatgttttacacttacagcacatctgaattcagactagccacatttcatatgccttactggccatatgtggccagttgctactgaacagcacaggtctacagaaatcaaactttggcaagctagctaagctttgcagggtttggaatattaattaaaacattttaggtttgtccctatcttattttcaagatagccaagttctcagatatcctccttttaaaaagaagcatgatcaatgcccgaggaaattatacaggcatacctcggagatatttcagattcaattccagtcactgcaatgaagtgagtcacacaaaaatgttttggtttcccacagcatacagaagttatgtttacactatagtgtagtttattaaatggatatgtctaaaaaagaatgtgcataccttcattaaaaacaccttattgataaaaaatgctaacgatcatttgagcctgcagtgagtcgtcatcttttgctggtggagggtcttgcctcagtgttgatggctgtgacagatcagggtggtggttgctgaaggctgggtggctgtgacaatttcttaaaataacacaacattgaagtttgccacatcagtgaactcttcctttcacaagagatttctctgtagcatgtgatgctgtttgatagcagtttacccacagtagaacttctttcacaattggagtcaatcctctcaaaccctgtcactgctttatcaactaagcttatgtaatattctaaattatttgttgtcatttcaacaatgttcacagcatcttcaccaggagtagaagccactttctttgctcgtccataagaagcaactcctcatcaattcaagtttgatcatgagattgcaacaagtcactcgcatcttcagggtacacttccaattccagttctcttgctatttccaccacatcagcagtgactacctccactgaagtcttgaaccactcaaagtcatctataagagttggaatcaacttctttcaaacccccattaaagtggatattttgacctcttcccatgactcatgaatgctcttaatggcatctgaatggtgaatcctttccatacgttttttaatttactttgccccagtccctcagaggaatcactttctattgcagttatagccttatgaaatgtttttcgtagataaggcttgaaagatgaaattgcttcttgatccatgggttgcagaatggatgtggtactagcaggcatgaaaacagcattaatcttgtgcatctctagcagagctcttggctgaccagatgcattatcaatgagcagtaatattttgaaaggcatcttcctgagcagtaggtctcaacagtgggcttaaaatattcagtaaacccatgctatagacagatgtgctgtcatccaggctttgttgttttatttacagagcccaggcagactagatttagtgtaattcttaagggccttgggattttcagaatggtaaatgagcattggcttcaatttcaagtcaccagttgcattagcccctaacaagagagtcagcctgccttttgaagctttgaagccagacattggcttcatctctctagctttcaaagtgctaggtggcatcttcttccaagagaaagctgtttcatctacattgaaaatttgtttagtgtaggctccttcatcaaggatcttagctagatctggataacttactacagctcctccatcagcacttgctagctcaccttgcacttttatgttatgaagacaccttctcatcttaaacctcatgaaccagtctctgttaacttcagacttttcttctgtagctccctcacctctcttggccttcatagaattgaaaagagtgacagccttgctctggatcaggttctggttcaagggaatgtgatggctggtttgatcttctatccagaccactcaaacattctccctatcagcaataaggctgtttcaatttattttcattcatgtgttcactggagtagcacttttaatttccttcaagagctgtttcttcacattcacaacttggctgagtagtgcaggaggccgagctttcagcctatctcagctttaagcatgccttcctcactaagcctaatcatttctagcttttgataaagagacatgtgacccttcctttcacttgaacacttagaggctaatgtagggttgttcatcagcctaatttcaatatttttgtgtcttagggaacagggacgcctgagaagagggacagagtcggggaagggtcaatcagaatggctggcagtggggtagtcagaacagaatttatcaatgaagttcaccatcttatatgggcacaattcgtgatgctccaaagcaatgataataatgacatcaaagatcacggatcaccaaaacagatacaataatcatgaaaaagtttgaaatattgtgagagttaccaaaatgtgacacacagacaccagtgagcatatgctgttagaaaaatggcaccaaccgagttgctgggcacagggttgccacaaatcttcaatttgtgaaaaaatgcagtatctgcaaagtgcaatgaagtgaaatgcaatagaacgaggatggcctgtggctgaaatggctgtcagtgcggccccatggatgtcctcattagcagtctgtaccagtgtcttttccaaaggaaaccatacttaccctgtgatgtcagagggaaaaatgaacacacagggacatggcaataaccataacaataaaggtaatattgctgtacctgtcacctgagtgtgacagcgtgcatcaaaaacattaactttttcattttcaaatcactcttgtggggtaaagaaaggtagaatgcttctcataagccctcttccactgcagcatgagaagagacattttgcttcttagcaaagaagtagctaaggcatatccaactcagtgtctcagaaaccacaaagacctcaactagtcaccagaagatccagctcaaagctccacctctgaagggagagagcctccttccccagggcacagccctacagcatcccgcaatgccgcagcaccacgtcgtcagtgccaggcaggtgctgaggaggaaggtggtaggaggaagcccagcttgcctgtgtgagccagggcagggatggctcctggagggttccctcatctctgtatttatttactcctctttattgtgccttctccccacaggggtttctgagaaagggattcaagtcccaggggtagatggcctgcagggatccctaataaaaaattatttcacaaagtaatacagtaacacttggaattcttcctttcttgtcatgtttctggtgttttatataatctgaactaggagaatatagggccatgtgtgtgtgagagaaaaagagacagagagagcaaaacagagaaagacagacagcagagaagagaaagaactagccaaacgctggctctcagactccaatcatatcctcccttcccatttcctcaggatatcagctaaactcagtgctccagggaccagtggcctccagatcgcctttgagtcctctcctcccccaccctcacatcctctagtgaactttcaaaaaagcatggaagtcatcctgctccccacccatccagccaactacctagactctggtggccaccatgtgcaatcactatctcctctgcatgaatggtactttcaccacctgagcgacacaggcttcccattcaatgggcagcatccgcctgtatttaacattagctgctcaataataacccattgaaggagtaggccctatgatgtttgtataaggagaggggcagtgaagaaagggctccatgtgctgaattcaagaagggggttatttctttcctactataaacagaaatgattataaaaccagatcccagaaagagcccctcagccttcactttggcacgagggggtttcgtttctctgcaagactacctctgcgtgctgacttctccaagtttttactgcattccagggagggagatagaaaccaaagcaaataaagtgcccccaagggccctctcctccctctgaaaagcttctatttttaattctctgcagcttttaaaacagtcaaatggggaagtttcaacagtctgtggtggaagagaatgcctgccctctctaaggacacccactttagataatcccagttggccacgggacaccagggccagggctgggcaaaggggttttcttggcagtttcttttcagcacatttctgtcatcacaaagtaacttttaacaactgtgttttcctctctacaaatgagaagaaggcagattttgagctggtggctcactgcatgcaaaatgtacctgcttcccccatagcgtctggttcatgctacaagtgcgttttcctggcacttagtgctttatagagatgctaaactggaaaccagggattcctaagctccctgcagaatttcccacattcaccccgcgtccacctcaccaggtgggtggcaatcatgagcccatcattttcaggtgggaaaatgggcaaagccagaaaaatggcaagtcgttttcccaagcatgtcttggaggatgttagcaggaagagtaaacatttcttctctgactcagtccggtttgtggcctcatggttactctctcccaaccacacaatcctgactgtcaccctgtgagcatctcttaagccacacaccatgcactctgacccttaaaaacctgaagtgcccccacacaggtctcctgaggttgaagtagctttgggcaccagtcgcgtggtgagcacagaagagcagggttgtggaggaggatttcctccgcttcctcctaggccacctttgcagagctgtctctaatacccacagggcctactttcaaaaagacatatttaaggcaattggccgtagaaagctctagatccaaataacctttcagggttcttaaggacaggacttgaagcttggggaggaagcagcaaatgagctccaggtgtgaaggggatgagacaggctccaatgcagtggagaggtaggaagcccagatttcaaagttatttctacctcctaaggttacatccattacatcaagaatttaagtctttagccaaaatgccctatttcctaatacagagtttttagttggcaaaacccaacttataaatgtctcctgagccctcctcttctctccagcttttagaactcaaccaaagcccattttacatgaatgaaggaacaaaacagtagaaagaaaaaaagaagaagaatgaatgtggctgtgcctgtccatcctttgtcctatcattttttatcaactttgaatccagtgaaacctaacaataattcagccatgaacttgctacataaactggagaaatttggagcatatatttccaattcatttacacttggctcatcaaaatacgttgcacttaaaaaaaaaacgctatttgatgtttaaggaattgtttccaccttttaaaataagcctttctcaattcaaacaggaagctgcagaatgctaagagaatagaaactcaaatacaggaaggtccagggactgttcaaaactcagagccatgaatttagagagggttcaaaagttggcagcgtgaaccctctcatccccatccacaaataataaatatcacaagaaggaaaaggagaaaggagaaagccactggaaagccataacttatcctggctccagacttacagttctctccaataaaccaggagttcttggagaacttaggttgtgctgcctacagggagctgagctactcttgtgtcataaattaccttgctggggataaactttcctccaggttcaacagacaggcagctctgcaagacccatcacccagctctgtgcttcctaaattatacttcatctggttgtgacatctgaaaagctacagggagaatgatcaccccaaatttgaccttcctatgccactgggtctttttttttttttttaaagaataataactacatcaggggaaaaaagatacaagagcatcctatttgaaaacacaaacaggtaaaaaatagagcttcctatacacctccccaaataatagtatgatgttttcaaacttgtctacactaagggtctttttaaattgcaatgtgaccctaagttcttccccaactgaaatagcaacagtgaagcttaaagtcattgaagtgagagcggcagggattaacttttcccctcctttcttactttgcaatcagcaacagcctcattccagttctccagtcgtattcagatgtgtacacacagagagacacatgcactcaaacatctgagaacccagaatatttaaggaagtggctacagtgccttgaaatgtgatcaagcctctgagagcaggtatcaggccaagagaaataactcttatccgtaaagagttctctaataaatcagaaagccttttcttccacatgtcacctgacatgtttaatttatctcgtttgacagaattgtggcaagcagactgaccactggcacaattagaatgggcctttgtgaccaagggcagaatatcaggcatggaagggcacagaaaaggaatacacacagtaggtatcctataaatgcttgtgggccagctcagtgtgatggaggatgcaaaagaagagaacgaagatttcagatttcacaggtttacagcacatcaagccaatgcatagacacagtaaccaatcttatctaatccaagaaatttaacttaactggtttgcttcttcctggaatttggcctctgtcataaactctagggaattgcataggcttattcatttttgcttctgcattttacttatggaacacaagatttacaaggaagagtaggaagaaatgtactctttctaatgtctgcaccttctgaacttgtgaacgcagtggatttattagtgtcagctggctaaccttgcatctggtcatacaatttgtcttgaaagaaaaagcctttacctggagaaaaaaacacaccttgaccttgctatcaaaatagcttttaaatacctatactttatttatttaggaaaaatgatcacagttactagcccaatgttcccttccctgcaccaactgctacactctaattaccaaggctctcctggcattgaacaggaggagactgtcttcacttcacttctaaatctttatgtaaagtaggactaaactatccccagttatacaggtgagtaaactgagacatggacagagatcagcttattttcttcaaaattaactagtggcagggcctagacttacacccattctggaccccaggtgtatgttttcaacttcctggcaaggccacctctgtgtgcacccggttcatcgatcttctttcagcaagaagattattattgaatacccaacgggcattcaacttatcattgatcatatacatatactttaattatttttgttcatttactttttcctattttaagataattgaaatataatacacataaataaaagtgcataagtattcagtcccacgaattttccacaaggtgcatgtaaatcagcacccagatcaagaaacagatcatttgaacccaaaagccccctcctttttaccctcttcattatactcctgtcttcattcccagccaatatatgcctttcctttggttgggggcagtaataaatttggttataagcacatgctttggaagcagattatctgggttgaaatcccagtaccccttttataaactttgtgtccttaggcaagttgcttaatttctctgtgcctcagttttctcaactctaaattggaatattaatagaaactcatgagatcatggggaagatgaagggctataatatgtataagagcttaggaaaaggtaaatagaaaagctcggggtaaacccgcaggaagaaccagctattattactggaacatttctcctcattctcagagactgtccagggaagaccaataagatgcaaagatagtagagcaaggtagatggcaagggagagggagatagagaaattcaatcaagcatgtgccttatgtcaatatgagaaataaatccacctctagactagggagaggatgagagctggacaggttgaagaacagctcactagacagtttgccagtcacacagaatcaagtttctaaagcaaaactcttatttgaaacataatgtattttctcatcagtcctactaatgccccatatgtgtgcaaatatgccccatatgccaaagatgataagcatgagtgctcttttagatcacccatgggccttccactcccaccatgactcctaatagtctagaattagatgtatatttgttagcttcctacactagaaagaaaaaacgtgtaatttttttcatccaattcacagcttaattccttctccctactatacttcattaactaggccattttgactgacagtgcaaaaatctctatttggcatagctttttaagtagaacagattcaggcattttttccatgctacatctcttcacatttttgagtcacttaaaatatttttgatccatttcatttagcacttttcaaaattctctgtagtgtaaatcaaaagcaatacgtagcttaaagcatagtttccaagaagccagttacctcagagatgtaaaaatacaggacagataatctgccatgcaaatttctttttatgttttctagctgaaacaatgcatttgctggaacttctttcttaggtctacatgttttatgtagacatcaaaatatttaaccaagttataaaagtcaaaaaagaacagagaaagaataaaaacatctttcatgtaatattaaaaatggcaagcatttaatattcatttgaataacgagttgactactgtaaagaattaacatagtttagattctcaacagtaacagacagattgaggtctgacatattgacattattaagttgcaataggatttaggaaaactcaaaatagataggaaaagaggcccatgcttggtttcttccctccctcccttctcttgctctctctccctctccttaccctccctctcccttgcctctgcagtttttcttttcatgtttgttgtgaggtaaacagaccagagatgaatattaaactctaacatgctgtgcactctcaagctctaacagatctttttttttagtgggatagagataatgttacttacagagcctttcgacaacatggccatatggctggccagaccccctgtctaaaaggaacaaaatgcttccttcctgggtggctggctgtgggctggaacagtacatgatgttcaagataagaaaacggaagttcctcgtgctgagcttaaccaaatgaggtaaaataagaaatggaaagacaatgagaagctgccttatttgcagcctgtgtcagagccagcgcagggatttggagttgaacagcatctctctcgatcataagcgggaaggccttgtcccagctacttaactccgtgtagatataaatatgagatgaagctgctttgttaccttttagggatattgcaaataccacagagatcattataaactgattcttcgtgcccttgagcttgctgtgtaaaataaattgagcctgtaatttccagtccagtggctaaggattctgtctacccatttctaaggccagtgattcccatttgaagggtctctccaaccctttagaaactagatctaccctccacaggacgctggtgaccatctcagccatggcacttgccctccagactttgcaatgcaccacgtgcccagcctctgccccaagaagctccagccaccaccaccttattctgaggcttcatttcctcatctgtagaacagggaaaacattagtttctgcctgatggagacacttctgctcagattctctttatgtgcccagcctgctgcaatctataggtgatcagggcaataggcgtatctggccataatcagctctgtgaccctcagcaacttatgtaactctccgggtctcccttctctcatctgtaaaatgggaataataagactgcttcatagtactgtaagaagagttcaatggcatataactctcaggaagccattgctaagtaaaacaaaaggatcctccttctggcctcattccttcagtttcctccttgacccattcctcatgctgtcttttagggtgggaccctccaattagtctttcaggtactcctttcagttaaacatttttgagcacagtcaccaatatatatttatatatttataaattttatacctatagtgctttgttaatatgttttgtgcattctgaaaacacacacatactacacagaagttttcaaagaatgaggtaagaaagtcaatagaaataggaatttaatcatgttcttcatgcactccaactaatcatctagggctccctcttctgctctctagcctccctggccctgcaggaggagtgttcccctgtgggatcctgtatatcccatcttcttgggagagttgcacacaccataacccaagcatggcttcactggtcaggataagcctccattctcaacacagtagcatgatcccaggtgacagtcagcttcacggacatgtgatccatgcagtgccatagggtctcatgctcaagtgggtgccatgcttggttaattctcagatgttgccatcttgaaattcttaataattctacctttgaacttgtgctttgtaggcaaagtctgatgggacaacggaatgtatatgtgagcagagaagacatgcacagtacatgtgtccactgtttcttgctgtcccatttatatgtattgttggtgatgcctcatgagcacagcaattctagtgggcccaccttgtgtgagagttcagtgacactccaagtgaatacaaggtgagcatattatggaagctacctgcttccagagtgccgtagtatacacgtgtttcaagaagtgaaataaaagcagtggagttttgtgcagtgttttcactgttctggcaagaatcaaatacctatgcaagtacaagctatggaaaccaaattgtatattttcagtgattctacacacatgcttttacattttcatttaaagctgactttgcacaatataaagataaatgggaaaatttgtgctaataatttaaaactttaatttttctttactaaaaaatgacatcagatagcaaataaataacatgatgacaagaggagagaaagaaatatggaagaaagaaaaaagttttctatcttggtacctttaatacacttctttaatgctttttatacaagctgccccatgtttttattttacaccataatcagctctgcccccagtcctctgactcaggtccaacatgactaatgtgtctctatgaggagtgagtcctccccaccatcttctctcactggaaaaaggggagaaggctctccattccgccctaagaaataatttatccttccgagaccacaggtaatcacattcagttgatgacatgcttcatatttcacttattcattcaacgagtatttgtgtgtttattgactctaaatgtaaataatatcatgttaaacatttgctcaagggaaccggtacctattttaccctgtttctgacaacagcagaaagttcctgctgaaatgtcaagatctcagttcaaaagaatcctgctgttgaaactcgagaactgagctctggagcatctactcttcagaatcctttacccacgcccagaagctaatgatttccagaggtggccacagcaaagaattcataggaacattggttattgtgtcaagagtcatgtcaagaagggaaggtcactggttccaaaaattccagaggtgaaaagtcactcttacaaataccgtgtcctccacattcagcacatcatggtatgtgctttatcataatttggtgggccaccagctgtcaccaaggcagacatcatccaaatgaaattcttcaacctcactagccaggtgtcacttttacagctggttgacactttctgccaggcatggacatgggtcaggtttttgcctcttgaatggactaagtcagtggttcccgaagtgtagtctaggaacaactgggggttcctgagacacttcttgtgggtttatgcagttaaaatattttcataataatccaaaatgttatttgtccttttcactcttctctcacgaatttacagtgtagttttctagaggctacataacaaatatttcgttgttctgatggctaatggaatgggtattcttgtattttgaaaatttttcaattttaatatctaatatagttaatatttatagatatagcccagataaacataagctctctgaagtcatcaacaactttaagaatgtaaagagatccgaaaaacagaacatttgagaagtgctggactaagtgaagcaggtatccattaccatttccatttcttcaacgactggtctaccctcttctttcccagataattccttctcacagtcccagcaatgactagtgtgatccttacaactcaccaaggagactgccatgccaatgactagcaggcagacaactataattgagccttggtcactttggcaaacagaatactaaagatgtacagctataggactctgcaaagtcactcatcatatgacataagccacaaactacccttagtataatcaagagaattttaaactgttttaaattttaaacttcttttgcataaagaaggatgtggtatatattaatttttaaagtgcatttaaaaaaattacctggttttcccaaaccaaaaaaaaaaaacaaacaaagaaaaaatcagttgaataaattgcatctgacagagcatatccttggaaaaggaaatccctgctacctcctaaagaatgtcttcaacacacacatgaaacccttcatagacacatatggtatttaatacatacctgctacggaacagctgatgcttttaccttttcatgaactatgagtcatccccctgccctggagaagattttctgagcttcataaatattgatcatactccctaaattctaacaggtggtttcttcaaatatgagtaatacttcccaacgtcaccctttattttctacatttagtcatgatgtatttgttgactaccacagaagaaagaggtattccatataaatgaatattccggatcactgaaacttagccacttcaaatcccaagacatttattcattcaaaaacattcctggaccatgagctgggccttgagactactacgaccaattaagcaaaaagtgcccttagaattgctcatattctaatggatgttgaatagaatctgtcctaaaatttattccagtcatcttaaaagtggtgtatgtgaagaaaagattagaacatctaatttaatctttatcttattttggagtatgttttattatataaacaatatattcatttaatagcacatgcataaattataaataaataaaaacacatctattgagagcgagcacccccaaatttttactgatgggatgtgcaattttccaaggttagagacactgactgaacgccctcttctaggccttctttttaagacaaggggtcagtcatcctcatgaacccttcctcaatcactcaccagctgcatgggcatttgctggaaaattagaatacactctaagcaggtctggctgtcagggaatttagagatgattgaccttttattttacaaaagaatcagggccccaattactaagtgactgcctaagcggtttcccagtttggtgaaggagttagcaatgatttccaaagtgggaatgtgagttagcattgcagtgggtggagccatgtgaaaacgcaggatcctggactgaggatacagatgtttttggtcagaatctcccagtttgttattttcagcaagctccctgggtgattctcaaacattctctgattggagaaccgtgggagttggaagaggccgaggtctctgcacgagctggctccttctcatacgttgtctcagcttttagagcaggaactatggtgttcagtaccacagcgagccctcagggctttccagatgtgtttgacccgatatatatggctgtggagagctgattttgctaattctgggaccactttctaggggcttgtttctgattcttcctttgatgtcaggctgttggccatcatttcttactgccttcggtgttatccctaccaatctgtcttacctcctttgttggccccctccaattttctgcttttaattcgttatgggctgagagactatataaattggcttgttagaagtatgtgttaattacaactcaatcagacatagttaaagtgcattgatttgtgactggtgtttccgctgcttcgagcctgttttgcttccttcctctttctcaagctgaattccagaaggcagaggttgggggacgtctgacctctggttaagtggggcactaggatatttactttcttgtcacctttcactgctgtcaaagctcagagtctggttggcccccagaggagccagtgtgcctaatgattcaggacacctgggtcgacccactcctccatttctctaagctcaaagtgatttacaggaagaacaggaagaggggataggaaccagaagcaagaggaaaggcccactctccagggtggaccaggaagtaggaatcagcttctctgacagacacactaatttccagttcaagaagagtctaggtctgtctccctctaagagctgctggggcatctcagccatgaaatgccacattaggcagcaaggtttcatctggctgtgggtgaggaggcatctctagcctagaaggcataatcaatatatttaacactaaagttcattccattcaaaaatactgctagtttctaaaacattttcaacatataataatatccttatagcctaacctttatttggctgtgatgcgattgttgaatgacatcaggacaattagaaagatcataaaattttcatcttcatcttatattaggaaataaaaattaattatcctcacaatgccccaggatccttcactctcccttcattatacacaaacatacaatcttctgagtgaagaaagctctctgtctttacaaagttataaaatgacaaaaatcaacccaaagtcaaatgttattttatttcatggggttctgggcttcttgtgagctaataatgtcttgttttttccagaaaaaaaaaataatgtctttagctaatatcccaggtcaggacatgcttgactgaagatgaagtgtgtgttaattttgttaaaaatggggttttgagaagaggcaaaaagcaaaaggtacttgtacacagggagggatcacactgatccattttcagtgcttaattacaaatctgctccaactaatttccttattgtgcccacagctgctattcttttgtcaccagtttatttttctttgaaaatctgaaaagcatcaaggctcaccctgaaaggcatcagaagcagaactgaggtcccagatgccccattactggtctcgtttgcaggcctgtttggttgtttatgtcttgcattcaaatcatttattttgttcagaccctcttttgctttgaaaatgactttaggacactgaaccgcttttatcactcaaccgtttgcttgctgggtaacaggaacatcctggtttaattaacatcataacttctcaataatctctaggcaggtcttgttcggtaaatatcaaaaagtttagagttccaaagactttcacaatgacccaggggtctgagtatctttgttggaaagaaaaaaaatgttgctcatatgaagtcatagtgattttggaagattttcatctgtaagttttcatgtcatatagaatggcttggaacttgcaaaggctttgctttctcagccaggaagattggctgctaaaagcagctaaggcacttggtgggttgagggtgctggggtattagtaaaatacactatattgcaagcagcatggtagaaagcttaaatgtttgttcccaagaggcagagagacctaggttcaaatcctggcttaggcaagttatcttaacctcttgaggctcaatgctcccaaatgtaaaagagaaatgagtagcatctgacttctagggttgtaatgagaattacattagctaatgcttggaaagcactccaactcagtaaacaagagctctcattattaccattattaatatttgtttcttgtaagaagagcttagttgtttggctgaatatttctggtttttttctggttaatatcagtattgtgaaaaacaatgtaagctgatctcaagtgaaaattgttatgttaactaatctaggtagggtgactatataatttgtggtcctaaccaagacattttaagaatgaaattgtgcactattaataattatgccaggacaataggcacaaatcaggaccatcccaggcaaaccataacatattcatcccttgccgtaaggaatctcaaaccaaaaaattattagaactgaagataaccttagatattttctagttcaatgctccagttttacagttgaggaaaatgaagtccagagcagtgaaataacttacccaaggtcacacagctagtaattgaaaaccagggtctggaattccagtcttttaattttaactccagtgactgttccacagtatggctctgctttctaatgtctttagcaaggctggggactattttcctcctgtttcttcttcaggaaggatctcaagccatcctactttgttttcttccctccactttacaccagaacagatgacggcctgtacaaaacaatcttcttaaaagaaagcttgtcatttttctaacctaaatccctcatgctgttgttaaaagctattgtccctttttatttattcagtcatgagttgagaaagaaaaagagcaactgttcccccttctataaaggaaattatttttggtcactctcaattattctgtttcattttcccttgggattaaagatttagttctaaaccagaatgcccttttgaatgattttttccaaaacctatcaccagaaaacttttgcatctaagacccctggaaattatacatgtgaacgtacatctttatccctgtaaattataccacacgtataatattgtcatgaatagatctcagaagctctcattttaggtgattttgttgcattatttagacaaagcaaatattccgtagacaggatttgactttaaagagatgagagagccagatgaccagaaatcacacatgtcaggccttcctgaggtatatcaccagcctctctctttaatgaagaccacattttataacaatgctcctatacaaatgcaaatttatggagattgtttatttagactctcgcttttgtacatcaatctccatgttccatcctcctctcctttttgctttgaaagagataacgtggttattcaggtcatatctctccaggttttatggtctggcatgcccataaagatgacaggaggtgcatttcgcaggcagcagccttcctctccccaggctgtcttgtgttgtagaccaggtaccaaagcaactgctacaggatgggtccatactttcctcctggatttgtggttcattgatgaacaaggcatgaagccagacagtcatgaagctcccagaccctactgagcattggctgggtggaacagccaatgaatacccttaaaagttatcttaacacaccgcctctacacagtatgtttgttatgcacatagatttatctctaagagttaaaatatgtgagactctttctacatctctgattaaaagcccatttttgaaagaaggggctaagatatgtagatggcaaactgtgtatttactcagaacctggtcagaaatgaatgagaactcaaaaccatccatgcagaacagataccagcttcatgataccatttaagcaggcaatataagttgtggttaagagtgcagactaatgtcagaggtgagttcaagcccagtctctaccaccatgtgacttcaggcaagttacttattctctctctgcctcagtttcctaatctgtaaattaggaataataaagagtatctgcctcatgggattgctatgaaaagtaaatactatgaggtatgtaagtcacttatcatagtaattggcacattggaaggacaaaagaaacttttgcaacaattttcttttttatataataatgaaagttatctgatatacatacatatatagtttgttgttttatatatatagtatatcatagagcatgttttggaaggaaaagttaacacaagaaatatacatatatatagtttcaagaactatatatatatgtgtgtgtgtatatatatatacatttatatatagtttgtttaatagaaggcagcagagaagttcaggctatggttagagccagcagaaagtgagagacgaggacaatgattttaagaaccgagtggcaggcacaacaagagacagagacaaatgatgatgtagacatgtgatgccacatggctaagcaagagcaataggacagtaaggaaagggcatagtcaaaaatgccagtatgatcaggatcatgtgtggcaggccaggctggtgcggcatttgataaagtggccctatctctatagcaagatcttgtagcacctcttgtgaagggttgcctgagggctcatcagggacctcagcctccagaacctaggaggagaggggaatcttcccaggatcaccaggtgttcctccgtagagaagtcagtaagcaggatgtatctgcctgtgcatcagaccttcatgtgcccccatccccacactataacctcagccacagagaaactgcagccctgtgtgtttatgaaaaccccagggcccaatgcatctggttttcagccatggagctggaaagcagagctaccctgccatgctctgcatcggtctgcactccatccaacagctaagagagtcagggcgggctcgagtttcatggccaggcactgaggccctccaggtaaattccaactggtccatttcatgtgaaatgttccagcttgaccaagagtcgctgacctcgagagcagtcgtttaacctccattacttggtttatattggtaatatttacattgggaacttgattaaagctgacctttggtgaaaacggaatccaatatgtattagaaaactccccgccttctccagccgtgtcaggagtcatctgttccacgtctcccctaattggctgactgcatccacctctctcactgaatgtgtgcaatactttccatttggttttgtgcctttgtccctcactagcacatttgaaagttaaccaggctaggagccgctgcctggttgaggttgaggacagagttagtctgtcataagtagatcctattcatcacaaggtgcagagaaggcactgaatgtctcctggccttcctgctctaaggaaccttgccccagtgtgaagtgatccagatgtctcaactcctacctttacaaggataactgagtcccctggggaaggaaggtagtggccattgactcaggataaaactcctcttcctacatgaaaatgttatctgtattgcttttcagatcaatagatccataaaattgaaaaggaggatacttgatgaaatgtttgtttgctgacatgtccagaaattgctccttaccactgaatcagttcagcaagtatttatcaattacctctttaaaatgctggacagtctgggagtcgatataccttcaaggaactttaaatctgagggctgtgtgtgtgtgtgtgtgtgtgtgtgtgtgtgtgtgtgtgttaggagtggaggcatgaataggaaacatatctacacacagaagttaaataacaatctcaggtgatgaaaacactattggcccgtgcatcaagattcctggctttgccacgaactagctttaatgcccttagtaagtcacacaacctcttgggtttcaaggacatccgcagtaacgtggaagccttggcccagaaggtaaattaggtaaatttcagcttgacaatattctgtgactccatcaacaaagaacaacataaggaatgtcacagactgaatgtgatgaagatacaaacgcccagttgattcaagagaaggagaagccatgggtcactggcaggcatagagcacagaggcactgggaagagggtaacagcacagagcatgagcaatctgggaacactggtcctgtagccttgggtttatggttcctgctacaactacgtagtatgaggcacagacagctcaatattcccaatagaatggatttccttttgcagagattaggggtaaacctttcaaatatggactgtttttcctgtctcaagcatgcaattttatatcattcttatcacaatcctgtgaaactggaatgattattcccactttccagataaagttggagactgagagagttaatttcctctgatcacatagagaatagaaccaggatgtaaacttaactctgttcattctaaagcccatactctggtctggtgcagacccagccctctgtgttccccaaggagtcagtccaagttacaccagtttgctatactaaaggagacaggtgaggaacactagctgtcagtgttactcaccttgagcaccactcactgaaaaaaacaataggtgcatgagcatccaatctaccctcctacaaaatgaaagggcctgagcatctccagaaggcaggaacaaacaaatgtctggaaagaaataaaatgagtatgcatagcaacaatttaaaagactatattgagaggaagaaaggccaccaaatgaaaactagttggggagctagagccttgtctttgaacccaggaggctgttgggtgtaccctacacgatgtaaggaggcaaggagatttctccccattccttctctccagtccacctggcaaaagcagccacttgcagtttgggctgtcaaggtcaaggcctaaagaaaaggtagtacaaagaaatgataaatgtttgaggtgatggagatactaattaccctgacatgatcattacacaatgtatacatatgtcaaacatcacattctacgcccataaacatgtacaattattatgtgtcaaagaaaaaataaaaagaagaggtagtgactcctcttgaagtcaccttgaccatattttccccagcaagctccccactgggggcaggacaccccaagtggtgttgacacagtccctctgcagtccctttggaagctgggagcccaggagcagagcatgagtgctggaaccaagatggcactaacttgggggtaggcttcgggcactggaagccaaccccacaaacaacagaaggaaatatcaaattattgggaatcatgtgataaattaaaatttcttttcaagataatgttcttttttctatttctagccaaagaatctcttttcccttatctaaacaatcagagaatttggttccctcaagtctcaaccttccctgtgaaggttattattggctcggttaaacaaagtacttgtttataatagatataagagatgacgaagtcgttttgaaattacacagttgttgtaataaaaccagttaaaaccttatttaaaaaatgtcacagctggtcaaatgtattaatggcatatggtttagttttctctttttttttcccgcagaacaatatgtgcattgtcatttcacagagtgagtagaggattaatggagcaagataaactttctgcttgctgttcttatagacaatctacactttcattaactgactcaagctttatttatccctttctatgtctcatcttccctggcttgccattttcttccccaaagcacccaattacagaattcctaaaattccgggtaatgtaagagatgaatattatatcatataaagcatgttttagaaggagaaattaatgcagaaagtacacactacataaacaaaatgcccacaactggcagacataattattttttctcctgttgatattaccaactgtaataataaagtcaaaaatgtgccctaaaacataatatttcagctgcatgtagtcatcataccagcaaagaacataattgcattatttgtcccctctgaaatctctcactcatagctatacctttcccaagatctcctattagagaattatttggctgtttccaaaagtaacgcattgactgaagttttgaagtctggacttgccaacttagctgtacctgttcacatgggtcatctcagaattgtgcctggattctgcctggagcttggagatgccatctctaatctacaaccctgccatgtatttgttttttgtcataaatgaagcatggggctgtgctttaattttccttactgccctctgtcaagtaataaccataaatattgtcctgaatcattaagtcacaacctgaaatgtgatcctgcccagctcccaatcagacggccatctggaagatgaaagaagtctatttgggtttcggaatgatccagactctaatttgtagtaacagtcttaacaggctgtttcagagacattaaccagcaacttgtctcaagttctcaaggaaggcacattgtccacagttggaggcatttgcttcaagcagaaccgtgaactgtaactgttggaaaaccaccaggctcactggctttcaatcaaatgccacattcttccatggacactggatttctacccaagggcaagaatatatgcatagagcaaatgcatacataatatatctccaaatattctctatgtcataaggaaagcaaacatttcaatacaggaaaacaaattgcagcttctacaagcaaacaacaatgcaacatgatagatacataatttttcctatcaccccaaggttactcttgcagggaaaataaattgtactctgattttgccatagaaataattttgtaaacataaaaagaaagtcactatctaaagtctaaaaacatatgcttagatatgagtgcagtactgattaaaaggacggttggtcaaacaatttttttaactatctgagcttcctgatcattagagatgcaaacagtatcaataggagatgcctttccatttctacttgactttggattggaaaaccaagtagagaaaacaactgtgaaaaattatgcttcttctccaagttatacctagcactgttctctctacggagtgagttgaatttaatttttgagcattgaaaatacacgtaaaaattaaatgaagatattcactcataaataaatgatattttaggcaagtatgtcaatggtgactctgagagaactaaacaaatgctaatgaacacaagagagtttcttttcagccttcagggaaggaaatttcacgccaactttcagaaaccctcttttttgcctcaaaatttggtttggcacccctcactttcagtaattaaaaatatttattaattattcattaaaattagtggcataaaaaagatagattagaagaaatttaattgtatttaacagccttatttgagcctttgaacaaatcaattattaaaaagtccatgatatgagagaatctgatcatgggctgggtattagataatattaaggaattattactactcttgtcagatgtgatagcatcatagcaattttaaaagtccttatccttcagagatacatacttaagtattcatgagtgaaatgatatggtggctgagatttgctttaaaataataggtgatagatgtaatgtaggcagatgaaataaataatactaggtagatgatacaagactggcaaaatattaatacgtattaaagaggagtggtagatacctaaaattcatcatcttttttttctactttcatctatacttaaaatttttctattaaaaaatattttttagcatattgagaacctaaagcagtggttctcaaccggggtgatttctggctactacaattgaggaggcagggtggtaccagcatctagtgagtagaggccagggatgccgctacacatcctgctatgcacaggacagacccacagcaaggaattactcagccccaaatgtcaatggtgcagaggttgagaaaacctggcctggacaatgtcttgttaggatggagttgatacatgggtaaaatatagtcactgccttcatggagtttaccatcttccaaaaagaagaaaacaaataactatcctacaaggcaccctgcacctgtcttctatcacatctctttgtcagtgacttccaggagggatggaaggaagatgaactccttatagtcaggggttcaaaggcagtgcttttcgttattacttacttacaacactagcctctggaaataagatttttaaaaggtctttgataggaaggtaatttaatgggttacattttagataaagattggtatatacacagtggaatactactaagccataaaaaagaagaatgaaataatgtcttttgcagcaacttggataaagctagaggcaattattctaagtgaagtaactcaggaatggaaaaccaaatcccatatgttctcacttataaatgggagctaagctatgggtatccaaaggcagacagagtggtataatggactttggagactccaaaaagggaagacaggaaatgccatgagggattttaaaaaaactacacattgggtacaatgtacaccactcgggtgatgggtgcactaaaatctcagactttatagtaattgtatttactatacaattaatctatgtaagcaaaaaccacttgtactctaaaacttttttaaaaaattaagattggaagggaagttgttctaaacaaagagaatagagagtacagaatgcaagggtgtggaggtagtggaaactacaattgggagaaatctctgatgagcctgaaaaggaagcgtctccaaggcacacaggcagaggcattggtctttgtactttctgtgtagagaagttgttctggtgtcctctctcccccaagctactaggaagcatagttataaacattccctttcacctctccaaatgaggacattgcatgctcgggacggaggaatgggcctgcacaccacggaggcgtccgtgcagaggagggatcagaagtaactggatcatttccaccagccgcccaacactaaacccactgaaaccaagccaccagcactcccttatctcttccagggaaagtgtgcagaagtgtccgcttatttttagaagccactcagccacagaacaggtgtccataagaagaggagtgattgttcgtgtggctaagtggcgaggagagagtcacatccatggagggcctgatgtgccaggccttgtcctagacacctcttatgaaacatcacctttaatccacacaccagccctgagaggtaggtggcatgagccccactgcacagataaagacactgcaacatgctgagaaattgtggcttttctcaaggtcctgcagctcctaagcggcatgtttgggattcagagccagaactctctgattctaaagccacacaatgagcctcccattctccatccaatctgagcacatcaataataccaacagtaacaatgagtggaggcacttcaggctgggagctcttcctggccttgctgtggaggtgggcagtttaggtgaaaaccggtacaggctgaggctgaagccaggtggaccaggaaggaagaaacaggcaccactgttttgagtcaggacttccagaacaggggtggacagctgtctcctgtctgaatggaggaaactggacatcctcagccaagggctgtgcattaagcaccagcagtgcactggttgggggctttgagaggcttatggtacttgagcctcaggcccaggggagttatcaggaggaccaggaaagctgccaactccatgtcagagttcccaagcgagctctggctaaggagcagtttgggtggtccagaattggtgccttcccaaaacaaacaggagacgcctatgttcctggctaactcccactgtgaccctaacatctggcaccccagggcactgcctgggcttagagagctcattagtgcacacagaaaggaagctgtccacgtctgggcagagggggtggaagagaaggtgggtgggacgagaacagttggaaaccacccactccaagagactcagctgagctaagtatgggcagggggaaggatcccaaagcacgaggcgggaactcagagtcctgtatcacccgctgtgtacctgtcagcaagttaccaatgccttgtggactgagttcagtgtctgtgagcaaggacttttggtcagccagacctgggttcaaatctagctctggcactaactagatgtgtcaccttgagtaagtcactctctgagcctcattttccttatcaacaaaatggccaaaaagaggtaccttccttacagggcagcagtgaggaataaacaggcaactgtgcatagaatacagggccagggccccatacattgtaagtattcaataaatggccaaatttcttaatatcatcaccatccttatagataatgccacaggctctgctctttctcagcacaaggttgttgtaatgatccaatgagactgtctacacaagtaaaagcatgatgaggcagcaaggcactgtgtagacaatggccagacttctaagtagggacatgctgcctctgctcccttattttctctcctgggctaaagaagatgtccacaggaatattcccttgttgagggtaaccaactctctcatggggatgattaatggagtaaataattctattttcagagaagttacatgtcattggttattggctttcagcacataactaacagcaagaaaccatgtactcacataaggcttggggttcagatcattgcaccccttcaagtagggtcatagctttgcattcttgaattccttatctactagcttcccctccaccttcagctgactgtcttaaacagagcctttctcagtacacatttgttggggaagtgatttttgtaaacattttaacaaattgcttgggcatcatggagagccagttcagtgttatgtgtaacccttcccaggaggctgcagggaacacagtgagcatttgctatttcctcagaccactcagaccttccagtctggaaaccacagtgagaatctccagagagaagaggccttatggcttgttgactccttcctgctttctataggactagctccagcaggatcacagatgcttcctctgagttttatctaagacagttgaacactcacaggcctgggcagggcataaaaatctggaaggaacttccatgatgatctgaaaaatgtcttcttttcagccggctggaagtttggcttaggtttgggtcatagatcaggtcgatattgaagtgcccctcccaggtcaccccaagctgggaaggggaacttttgggtctgctttgatttagccattgccagtctccttgtcatcactctgtcctgtttctttggaggctgtgctgtgaatgttttgcttctcctgatgctagatgagccctgtggtcactggcccgccctggcctactgcccaccacatcagtctttctgtccagtctgcagagccagtacctgcctggtcacatttccacttcctggcttatctctgtgctcacagcaggtttggctgctctgcagattctgagaatggtgcccagcaggactttctgggcttttcttttctccccgtatagaggtgactatggataaagtattgcctccctagtcacagagagctgcctggcaaagctgcaatgaggggcagccttgcctttgggctaaagatctgagggatggaatgagaactatggcctgctctgactatgcaagctctcaaaaccacgattcaactctctggggcctttctgagccgtaggggactggggagggcgtgggcagctggggagggattcaaatgcccttgtgatgaattctaatgcacctatacacgttctacatcattattgtgttccgaagactcatccaccacctcccttccttgcttgctcatggctgctggtgttctcccaagcccaacaacccagtgggcctcagctgctaccaggtatgagggatagcgtactgggtgagacctggactctggagccagatggtgggtttgaaccctggctctgctgcttattggtcgtgtgacctcaggcaagttactcaacctctctatgcttccatttcctcatccatagaatggaggtgataataggacctactccactgggtcatgataagaatcaaatgagttaacatatggagagtgcctgtatcagcacctggtatgcagtgagtgtttgcaacatataacaaatattcacagacccagtgttaatttttccatgggatataggggtcattactgagctttgagctctcttgatgctggggttgaagttaacctagaataatatagtggcaagaaaaccacttgacatcctcagcactggagcagtgtagctgtgtaccttggtttcctctgctgtacaatggtaaacaaatacaattctccaaatagaattatattttggaatgaaataattccagtaatattcttaacagaatacctggaaaatattcaatatgtgtttagctatattcattaatattattattatggtaactgagacaggccaaggaagggtaagagttgttcttggacatctgctccccaaaggacatcagcaatgtctggggtcattttgggatgtcatagctggggtttgctactagtatctagtgagtagaggctaagaatgctgctaaacatcctataatgcaagggaaagttcccagagcaaataattatacagcccaaaatgtttatagtgtcaaggttgtgtgttttgagtatagctaccgccacagggcaccatatccctgactgctgtgtgatcacccttagaagggaaatacccttgagcaggctttccactgttgcacagaaaaaaggagatagtaactccagattcactggagcaactgaagggagatgtctctctagggctaacttcaggttttcaagtaccagaatcagggaaccccatgaaagcaacaacaatcccacactgtgcacctagaatagctgctttgctgaattctccctgataatatttgtaatcctaccaaatgtgggtactggctcaatgggcttctgcaagccaaactttctccccaatacagtctccactgctgtgaatggccacatacccttccatgcagtcactcaagccagaaacctggaaatcattgtcaaggcctcactctcccttgtcccctgcagccagtcatgctgttgattcactgttctagataccacttacatcattcacctctccccattcccactgccattgccttggtctgggttttcatgatctttcactcaagttactccaagagctcctaatagtctctatttccagtcccttccaacccctatccatccaccaccttgctccaagaaacatcttcccaaaacataagtcatgtcacttatttacttaaaattctatcagcaaactattgccccaagcacaggacataagatccaaagcactttgtgatctggccttggcctgcttctccaaactcaccttgccttcctcattcttcagctgcttgcatgtcgccagacacgtgtcatatacagttgagcctctgagccttctcatatgctgttactgtgcctacaacactatttccagcctcttctgtgggctgactcctactttccttgaagactcagtttaagcatcactccctctggaaaaatttcctaaaactctccccgggaggctgcatttaggactttcctttctgcttccatagttcctcatgcacactcttctaatcctgtattataatcatggatttccttacctgattcttccactagaccatcacctcctttaggtgaggtgctgtaatcatttctatttaccagcattctagtacatggctttgcacatgataagatggtcaataaatgttaatggaatgagtaactattggggttatgaacaatatatggttgttgaattaattgaatgaattatttaatgatctttcacccaagttactccaggagctccaaggatgtcactcactatactaagcatctgcttttttttttcctttggtggatttttcaggcacctagtataagccaaccactatacaggtctctagaaatttcaagatgaataagatcatgtagtctcttccttgtgaagtttgtagtctggctaaggacacagacccactaattctgcctccctctccattcttttgctcaaataaaaaaataggattctctcttcattgatctcttttactcacccccctcatccaacccagcaacaagtctcactgagtctacctctaaatcataatatccttcactttcatctccatttctaccactataatccaaaccagcatctttctctttgactcgttagtcttccagctttcactcttgccctttacaatttattctccccataacagccagaacgatcttttgacaatgtaaaaagagcatgttacttccgttcttaaaataattgctcctcatcacactcttaccaggccaatgaggatgattgagctcaattcttcacttcatcccttaacagaattttgcctccatacccttgctatggcttcttggtaggaatcatgtacttctccacctcttgacctagaaattggccatatgactcctttgaccaataggatgttagcagacatcaccaaagcagaggctcaacatgtgcttgtagagactggcatgccccttgtgcttctctgacctgccaagagatgttaagccctggtacttcctgtgccaaagaaaatgtggagacatatggagcaaatttgaggtgaacccaaatcctggagcaaagccccaccaacccacacacctgcaaacaggcgcttaacctgtgtagttgtacaggactccttgcttagaagagccccatgcttggtttaatgttcttctgttactgttttgaatgttttaatatttttaacaagggccctacactttcattttgttctaggcccccaaaaattatgtagctggtaagcaagaataaatgtttgttattataagctactaaattttgggtggttttatttatgttctttctttgtagtacctatcaacttctgaagttgcctctccacttacttgttgacaattgtcttctccaaatagactgtaaacttcttaacagcaaggaccttgtctatcttgtgtgtctttgtaggcccagggcctgatgcatcccagacttccaatcaatgctagtcaaataaataaatgaacaacttccataatttctaaaatcaggcaaaaagcacaagagcctcatggacaaaagtattggttctatccaaagacaggaggtttacagaagaggcaatgcttaaatttcttcatctccttcactcatcctttcttgtcttttatctattcagagtacccagcacctgagtgagattagcaacttctacaaaatcaggtttttctacagtcatcttccaaaaacatagatggaggagaaaacaagaaacaccccttttctcagaccactccaaggataagttcactgctcgatacgttagggggtggacagaggtgttcactgtccccctggctttcttcttcctatttatttaataacatgatgccaagagttttatctgggcactgatcactcagctcaagcctcctctgcagccagttgtgccacgtgactcatttcagccaatataacatgagcagaaataaattacactcaaacatttgcttcacaaagttgctataagaaccttgtgaagtatgagctaacatcacacataaagggcttagaagagtgtctgactcatagtaagcacccaagaaatgtgagtcacagtcatcattaatatttgaatcttcaattttgcactcattataaaagaatagtttatgaatcttccaccgttctcacagccatgtagtatcccaagtctctggttatcgattcagaggctgttccttcattgttcttcattgtcttccattgtcctttcttcattgtccttccagtgtattacattggagaagacattgcaatggaacaagtcactaacctagcatttcccctgctatattccaactcccataggtaaaggcgtgccggggtctcaggaaaatgcatcccatctcagatcttatgggctgctttgtgctcaccaggcggctttacccagcatcagcatttccaaagacatttagaggctcagtagaagtgcccagaagcacttgactgctcttgagtaataactagcttcctatttgcaatattttgaaaacactgtgccatagtctataaaaccggaggcaattatgtgagaaagtgataaaatgaaataaactatttgccctggaaagccactgattctgaggcagtgttgtagatgcacggttctttcttgaatctttcttgaatctttctggcacagccaaatgatacagttaggtgttatgagcacatgaccttcaacataggcaatctggatttgagtcctagctccaccctttccaactgggtgaccttgggaaagtcacagtctcaccaagtgtttaaatgtggcccacttcatacaattgtagtttatgtaaggagcaaatgagatgatggaggcagagcactctcaatagcaccaggagcacagtgggtgccactgttattattgtcgcattgctcaaaactcaccgggcccaagtcagctctgtcacatgactttcagcagcgcttcctgacaacaaagctgtttctgcaagtcaccaacagccaacagacccagtggacaaataattttaactgtcgcagagagacttcaatttcctattggtcaattaaagaattcgtaactgcctcctgcccttcttgttcagcattttaaatggtgctccctaaatagaacatgtttcgtcctcttttagcccagcccttcccagtcaggagaatctttacgtgggttgttctaatccacattcattttccattttggagtccagcttataatcttgggaatcaagtcctccactggcttctcaccacaggtgattctgggaacaggcctcccagaagagcctctgaaaaacctcctgggcagaggtgtggccctaacatattttaagcagaggaggaaattctcttcaagccacacaggcaaaggttcatgagaaagtgctttcacacagacaggctcaagagactcctcgactctgaagaggcaggaacagaattcatgagaaaatgggacaagaattcagccctcagacccacagcgctttcagatattaacacccttgccttcagtttctcccagatagcaggaaaaagcagcatgaaccatcacagctgaatcaagcacaggctgggcaaaaacaaactccctcatgtccccattgcagaattcacctcttggccagcgtgaaaatatccagaacaatacaattcaggaataagccatcttatttcctactggtttctgttattgaatcaataaaagttttccattttaaatatatacactactgtcctgaaaataatgctcagagcattttaaaaataagttaagaatattcctcaattgcatgtaaccccccgtatccaaaggaaacaaggtctcaggttatcatgtggacggaatgtggttgtgagtaggacgagaggctcagtgggtctctaagagctcttccagtgcaataatgaaggcattaaattaccaggtcagaggccccagttcacaaagaaataatatcagtttattatttctaatcttattaagttagaaaatagtcttgagatgcaatgtcatcctagaatggctaaagtattgattatgtgaggctgcactcatggatagttcaaggagcctgattttatttaatttcagtaatttttaaagcattctaacaaattttctataaagtaaataatcctgaattatttccataaataatgtagatatatggtcagatttacttagtatttaccagttacatattttgcattacgagttagaaaaaaaagaattatttttaatcctattttcccaatccccagtgtcttccttgagaaaaatagacttttaaaaatatatattgcagttttaagaaaaatatggatgttatcaaactaggacttgtgacaatccattgatgctgtcattttcttataattgcattatgtccaaagctgaaacctcaatgtgctatgatttcggattatgcaaggaaaagcctatagccaggcattgttacaatgtcaacctgctgcagctggaattatagacagcagttaaccctgccagtgcccctttctcccctgcctaccagcagagctccacttgagggtagggccagaaagaagcttcagtctcctcagccacaaaccacattctccccttatgttcaaggaaagtggccccagtctctggtgagtgggcaagactggctactagagccaacagcttaatccaacattgaatgaacacctactatatgccaagacccaggccaggcattcaaggatacaaggttttcttccttctagaagtttccagttggatgtatgtctggataatgaaaggcttgggaaagtaatgtccagggtggctagggacctcttctccatgactagatattaccaaggctaaaaaagtcaccaccctctgctaccaccaccacattcatgacattgttctcaatatccttctttccttccatatagacaattttttttcattctccaggcaaataacatggcacctgccacgtcccaggtgctgtgccaggcattaggaatacagcagtcagtaagatctagattaggccatttagagccttacagtctaatggagaatacaggcaggtcaatgaaaaccatatggtatcatacactgtataagagtagacacttggtacgaaaggatcatggaattctttctcggggaggagacagctaagctgagtttccaaacatgatgacaacacatacaaagggagatgggaatggagtgcagcattttagacaacacatgcaaaggcccagtggtgagagaaagagacatgacagggaactcctaattgatatgtcaggaatacacagtgcaaggaggcaagggaggagcccccagtcctgctcccaaaaggccctgcatgaggtgctatggaattggctctatggttgactcacctggggtcagcctccaccagtggctcaccttggcctgtgtcccgtaggccaaagaatccagcagtctcttccctgcctctcactcacatcccctgaggttgttaattagacttttcctatcccaagatttcatgagcagtaggcaaagtgccttcatgcaattagtgagcctgaagttaccaacccaaacctgagactcacgccctcaagaatgtttcctctcaggatatttgttagctcagaagacatgtgtgagcaaagtatgttatttagtgacctataatgcctgaataatgatcacagtaaatcagacctcattatgtgcaggagagccgggcagcccaactggctaggtaatgaggtctaatttaatgccctggtattattctccacatgtttgctgggaagttaggggtgggatggcggggttggcctggtggatccagaagccctgggatgttcagcagttacctagggaggctagtacacatgttaggagcttgggaaagactgtgctcagcaatgctcagtccctcccagtgggttacaacaaggcctggtcctctcacagtggcttaaaccagaaaagcttatagtcacaacttattacaacaaacaacagcaccctggaagctatttctttgaaataaaaggaaggttacaaaggcaggaaacgccagcacagatagcaaaatcagaatctccatgaaaagaaatattaactgtcagagggttcacttcatgagtcatgcgtctcagaccagtttgtgatcgagtctgctcagcatgtcagagccaggggaggtggctcttggtccagccttctttgagtgtgagtagccctcatttatttcttgctttgaggagccttttccatagcaatccaatattgtggtttttcattcttcatgcacagccttttctcattgattacctaacatcattcgtttgggcccgttccatacaaaagtcaatggagagatcaattttaaccatttgatgtacaaaaatttgctcttaaaacatccagagactgaaatcatttatcttttgttcaccaactcataactcttttcctgctgttggtttcttgttgggtagcagacatcaagaaggagacagccagagacctttgcgcaggtggccttctctggatccccatggaactatcatctaggaaacctctgacatctgatggcagttttaaagggtaatatctgtgtgtgacatcaggtgccagacaggctataacactcaacacgctatcagctgaagctccctcactgcccccttcatcagttttcagtcctctcattcctatcagtggaatatggtgaaacccaacaaagcagactgcactgccacgtgttgggggctcacataaggcggattggctccccacatgaaaagcaatgtttggtgcaaatcctccttgtcttccatatcagcaaaatagcaggattctcttgcattttccccgagcaacaactggcgcatttatttctacagggcacaggaaattgcttcctccacattctctttggacttgaaaaagattcttagatctcccccttttctgggaactctgggctcataatcagacaaaaaaccttttagtaataccaagctgtgatgcaagataatcatcccaagtgtaggagaacagcagagagagactcaattgtgttttaaagcactctgaaaaatagcaaacccattcatttgaactcttcaaaagtattctgcattatagtttctctagctggtgttttagctgaatatggcattaaatcttcattgtatggcaaagcctctaacaagcaaaatgggaagaggctaaatgtgcattggctgccaaggcagaggtttctttattgtaaaccagaacagtgagatgggtgtgggtgcagtgggctagtggagtagaatctgtctgggattcaaagtgatcacaatatggtgaatattgactatggtcaaaatatcctggaaaatcacataggatggtgcccattgatgatggacacactgcctctcgctaaagtcagccctgctagattttctctagcattgaaataggcctatgtctacacttgaacttctgtctagggactagttgtcatgaaaactgtgtgcctataaacagtagaatggcacacagcattaaaagaggctgatgctgtgaagggccgggaagactgaagtcatctgcaagaacagcaaagttatgcttcccacttcatgtacaccttctcccagtggtcctcaaccttcagccctcatcagaaccactggaggctggttaaaggacagatcaagagtcctacccccacagtttctgattcagtaggtctggggtgggcctaagaatttacattcccagtgaggctgtggccaactctgcaaaccactgatttggggggttgtgtggactgatgggaacaactttctatactaaccactttcctgcacttccatgctgccttacttgtacatctgtacccacatttccattttctccaatcttgaagtaatcgtctgtctctagctatagtttctaccagctttgcttcattctattattggctttttttccaggttgcagagaaatgtatgatgcccttcctaatgtctaaaaaatttcatcaatcttcaattccttgctgatattggtcttgcattttctctaccaccccaccagcagtgcctagatttgccagaacaccaaccctttaatatgtagggcaatactctttttttgttcctttgagctaattcaggcattctcacatgcacacattttattggccattataggtcaaaacctacccccacaaaggccacagacaagtaaataacacacgtggcacagtgtgttcaactcaagatgagagtcagcacgttttcaataaggcacagtaactattcaccagattattataggattcagagcacataggagatatacagtcatgtacgtaagagtgtgtgtgtttgtgtgtttatttcagagacaaataatgctaaaatactgcaatccttcacaggtaggacttcagtatcatattcatgctaagagtacattgttggcatcacttaaattgtctgtgatgtacttgattgactgtgttttatggctagtgagaaaaatagagatatatagtttacagtaacaaaaaagagaaaggtggctatccacctcacatctaattccctggtttcagaaggtaactcagaaaaggttctctcccacgcaattaagtgagctaatgaaaggcaatttacacagcagaaagagaaaataactaaacaaacttatttaacctatggcctcatcaggaccagagagtctccttcctgtagtctagaactcctgaacctaagaaacaattcagttgattttcgtcttttgtctgcaaacatctaagaaatgttggttgagaatagagttttgtgttaagctgtttgaatttttgaaaaattatatatatatatatatatattcatgccttatatgtctctaatatcactaaatttaatcaatagtggtttttaaacaaagtatcattttctcaataactgaaaacagaagtattttcctttgtgtctgtctttgagttttccatatctaaagctgagagtagtgaggggctcacactgtcccaaacagataccaccatacaaagtgactatttttataaatactgtcttccaggagcacagcgacctctgcaaaagcattcttgcaaactcaatattatctcatggtggcaaagtgatagacctataaggggtccaattattcaggaaagacttgaggaatgttctgcaataatgtcggagtaattcaagtctctactgctcccatacctgcagtctcctcccatcaaagtgaggaatctgttgagagttttttgaagtcataacttcccactttgctaagaatattatagccaatataccacaacatctttatccactgtgtgttttttctctcctacgctgtaattaaaatgtccaacatttaaatactttctattgtttccagcttagtatgggcaaaggttgtaattctgggatagacctaattacaaagtcccatgtcccattctgagccaattgcaagcttttgcaagaattttataatctggagctctgacatttcccaagtgaatatccacaagtagtgttagtgcccgattgtctgaagaaatattgatctctccaagctacaagcatttcatgtttggagaatatatgatccacactagatattattcttgatctacactagatattcttttactccagatgtaatctacattgaagattgtgaaggatctgtagttctttttctttctccatccataataagcgccattctccagttcctacaggttgttcctaggctttatttacgtatctcgttctttcagaaagtcctagactgatgttgtatttttcgaagtaatgctacctgttctatcagcagaacccagaaatttcagtggtttagcaaaaggaaagtttctttctcgctcatgtcacagtccagtgagattattcctgattgggaagctctcctccatatgatgaatcagggacccagaatcttcccatctcgtggctgagcatcttcatcaggcaactcccaaagctgccctagaagtcatttccatcgtaaccagctgaagggataatgaacatggagaacctcacaagggagcttgaatatgacaggcctcaaagtggtgtaattactgctgctcatgtttcccaggctcaaacccagtcacacagccacttaattgcaatggaggttggaaaatgcaatgggctgtgtaagcccagggggaagaggaagcaggtttgctaattcccaagcagcctctgtcacaagggcttttgcatccttttggacatcgtcactgatggaagatggccataggactgaaacagctggcttgctccgtgcagacttctccttcctggtcttctgatttctgggtaagggaactcctgggcctgcccatggggagcatcttcttttttttttttttttttttttattatactttaagttttagggtacatgtgcacattgtgcaggttagttacatatgtatacatgtgccatgctggtgcgctgcacccactaactcgtcatctagcattaggtatatctcccaatgctacccctcccccctccccccaccccaccacggtccccagagtgtgatattccccttcctgtgtccatgtgatctcactgttcaattcccacctatgagtgagaatatgcagcatttggttttttgttcttgtgatagtttactgagaatgatgatttccaatttcatccatgtgcctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcaagatttatattcctttgggtatatacccagtaatgggatggctgggtcaaatagtatttctagttctagatccctgaggaatcaccacactgacttccacaatggttgaactagtttacagtcccaccaacagtgtaaaagtgttcctatttctccacatcctctccagcacctgttgtttcctgactttttaatgactgccgttctaactggtgtgagatggtatctcactgtggttttgatttgcatttctctgatggccagtgatgatgagcattttttcatgtgttttttggctgcataaatgtcttcttttgagaagtgtctgttcatgcatcttctaagacaagaaaggaaagaaaaagtggcaaaatgaattaccaataaattatagctccttggttatcagggacacgtgtgcatacattaaaaacaattaagcagacatgataggaagctaagtgtgcacagtgagaagctctgagaagtaactggtaggtggcccacacaatttcaacccctccttagtacacagctggggctggcattctgctacagatctgctaagtcacctgccctttactcattgtttccctggtccccagcatcagaaggaagttcaactagggagtttgattttgctgagctggacaaagcaattttctggtgtcatctcatttgctagcaactgtgagatgtcagcaccatgcatggtgtggacccaggtggtatgtgcatgcccagatacacaaagagcatacaacaaatgtctggagaactgtgagaaagactctttcagagcaataattctgtgtgatataagaaagccagagagttaactgtcaccaaggtcctgggagtaatttgatttttatggtaaaccgggagacctttttccctaccattcctattttgagtgtaactttatcttgtttgcttttatggatgctaaaggctggaaacctttaacactgagaaagttctcagatttaatctggacattgttcagccagatttgccaatccaaatgggattttcggcctctgtggagagaagggatctggaagcagggagatgcacaaatgcacagtcacctcttcttcccagccctcattgctaaggccgaaggaagagaaagaggtcaaagaaagggctgggtattcccctttaggctctaccttcctgagaagagttaccctgtgtgggtttcctcctgatccctgacatggaacaaactggatcccagaagagactgggtatctgcggagcttgctctttcgtggatctgggggcccacagtcttcagcctaccacagaaatgtttcattgcttgggcgagagacctcactagagccctgtagccccccacaggggaaaatcagcagggccattttgtgtagtgcttaggattagaatgcctggtgttcaaatctttgtaaaagtgtcctgtgacattattacagtgccctatgtaattcaactgctcaaaatgcatttgagaatttgtcacacttcttgctttgcttctttctttttctctctggcctcccatatcatatttctttaagcgatcattatcttcacagccagtgagcaggaagaggaaataaatgaatgtctccttccttcagtgaatgaggaggggccccctccagatagtcctttatatcctctcctgagagacatttgattccaagttgatcacgaaggtcatagttcacagtcaacacccaagcatctacacagcagcattaaaaagaggagttttgtcatcagtgatgaaaaggaggacaattggggaatttcaagtagctctaaaacacagtagagttctcacactcaaaagcagacaagggtcaacaggtaatgaagagtgaaactggctgggaggagattgggggcaaactgaagagcccttggcccactggaagggccaccactccccaacatccattcatcactgccaggccaaatggggggccactgttgctagatccattgattttctagagaagcaggggaaaatgttcccatatgaattatcccattctccaatactgaaaattaattcatgctttcaaaaatactttgctggccaacccagacacactgaatggtggatgtccatggggacttcactttgcaacctctgtaagtctacctctctacaaataattgagggccagctattattgatatgctcttcttgtccatttgtacatttcctggtcataggacttctgtgtgaggtagtaaaatgaaataatcctcattaagaacatatcactagagaccaggagcagtggctcatgcctataatcccaacattttgggaggctgaggcaggaggatcacttgaagccagtgagctatggcctcctgtgagaaccactgcacctactggacaacagagtgagactctgtctataaaaatataagtagataaaagtaaaaataagaacatttaactaggaatacagataaaataaattcaatctacggtggaaagtaagaagctacctcatctccttataaaactatggtcttttctcagcagtttaaattattcaacattattagatgtaatgttcattgaaagaagatttttgaagtcattcaaatccaagaatttgttcttaggaagcctggccacagacattactaaacagcagcattggacaactgtggaaaattcctctcaatcagacctcaagaaagatctgttgattgattggaaatgggagaactgcttgtcctcaggaggacaagaagagaggatttgaataaaagtgctgaaaatctgaaacaaagaaagggtcctgtaaacagcctagataactgggcagacaagcctgcctgacttacgaaggaatatgacccatccatgatgggttccattaaaggatcaaggaggccttcataaggaagattggaggacatgcctgtggctgtatgcacatgtatgtatgtggcctttggctaaaggcctggaccagagtcccccagagtttggagtttgattacttcaaacatagacatctacactactagatacatcttctttactaagtgtaggcttcacctccatcccactcccacccccaaactcatcccaaggttgagaatcactaattaattggcctgaattcatagtcactggacaaggttattggacatacactgatttcgttatcacacaccttctaaaagttaatgaaaggtttttattaatccaggttttaataggctacatttcttcatacctaaagaagtaaaatgggggaaaaattgaaaatagtaacaggaattgattatttttaatctttgtaagttcaagataactcagttgattgttttgtatctctttgacagaaaaacgaaatcaggcacacacaaaaccggattctctgtgtcctcatgaaacctgcctctaaggatgcatttctatttattttttagtagaaaaattatcttccttatggtttgcctgtgcttccttttcattgctgcagggtttcagagcctggggaactgggcttctggggtccaggagagtcagtgatgccggcagatgctgtgtcagtgccttgcacgtgccatcctggatcttacggaggtcaagatttttcctccttcttttgttcatcttgttctaggggtatgagagtgcttctcccttgtttaagaaccctaattagggattttaaatcatatacttagtaataactgtaagagcaatttttaaaaagtttacaacagggtaggaaatacaaaatagtcacactaatataaaaaacaccctcaaaaataaaatgcatagacaaaatatcagaaatatttttcacaattttccttggtcatgggagatttttccaatcttctttctacaattaatcaaaatgaaatgccatttaacttcagagagatgctttttttcctttgatgatgaaagcaaataatggaaataaatgagagttttattacattcaacttttctttgctgaacatcaattcattctataattaaaaatgtattttataatttacacatttttaatttatgaagttaagtgtctttgttacctggtctcagtcatctacagcagggagcagggacaggatgttatgaactgatggtctccacagtccagcccctagtgctcagaatccaggggtactcaggcactggacgttggatctcagcatcagcaatgagctgcatcatctctgacaggaatgggtgataagaacatttcccttcaccatttttaaaagccaggtccttgatttgcatgggcaggaagggggaacatggttgtgggggtggttagtttaccacatcacattttcacattttcatctatcataatttagatctttacatttcttgagttggtgactgatagcctccaaacacataaacactctccacctgtacagaatgcaccagggactctgctctcataaagtcaggaccaaggtagaagtgaataaaattctaaagcccactccttagcagtagtaagtcccaggatcggccacggctacagaaggtgacagtttctggatgctgtcagtttgcagcaaattgaagttttgtggttttatctattaccagaaaagccctccaaaaaaatgtagccagtggggaagaaagcaggagtccaccgtctcatttttaacaaggaccagctgaaaaatgaaggcgcacaccacacaaaccagcttatgtctgccaattcatttcctggccccaaaagaaaaaaaaaaccctcgtgtttcctcttatgcaggccaaacatggcaaagcaccaagggaattctgaatggaatcaattgcacttgttactaactgagttttcttttattcttatattaccaagggctggatactcagctgcaagcaattataatgaagagttactgagtaatggtttccagattgctccatgatggggcattaattgaaagggacaatttaagagcttaggccatgtaaatgcatttcttattctgtcagattgagaaatttctggatgcaaaaggctgaaatgcttagaactgataaagacttaataatgcccatttaagccggtattttcaaaacgagtttcatgtttttaagagaacaaatattaaatggtgaacctgtgagcttgttcattcaaccaggacaatgatctaaatagcacattggcatgctgcactcatattataaacatatacattgtataaaatgtgacttgtttagtctgttgcattgcaaagccggttaagtttgcaagtaaacttttatttttcagttctcatgctattatgatgcatattgagcaccctctcttgctctcttgctctctatatatgctttaaaattttaaacagcatttaaaaacacataaattagttttatatgtgtatgcatgctttaaaatttaaaacatttctaaacagatttgcttgcatatgaaagtggaccttctcaaaaattaattgtgaagtccgtatcagaaagctttattttggcttttttaaagtgggcttttatttccctgagccgcattaagccgtaacattttcaaagaggttctctgatatgccacattaaagataagtatcataagacagtaagacagttaatgccaagcaaggaagaaaatcaccagctctctcaaaaagggggaaaaaaagagtagtactcgtttttaaagtctaatttcagacttctgcattagtactagttttacttatgaaaacgaaggaagagaaggaaggagggagagaaagagaaagagaaagaagaaagaaggaaagatggatggatggatggtagacagaaagaaatagatgcagatacattttaagacatgaattcatcgttgaggagagatggacaccactgctttttctcattctgttttctaagtctgaattgccatctgagaattggacttttacctttccttctgacttcagtctggcattctggatttgtgcacagtagctgtggtgctgatggtagacttctcctagagtcttgacacaaaccatgacatggatggcaacataggcagaggaaagaagttgtcaacctggggaaattgagagcattcaatccaagagaatgaaaaggaaaggcctcgtgttatacttgttattatacattgcccatttttactcattcattcaacaagctatgttgtaccctttctccatctgtacttcacatgctggcaaagcacaaaacaaggatgaaggcatcttatctattcatgggcatatcttcatttattagacaattcctagactcttccttggatggaaatcttctttcttattggattagtcattcatagaatgaaagccctgaattaatatctgactcttcaccttgggctgttctttatctgatagttgtgaaagtaagctcaagcaccagtgaaaaaatctggtggtcttttctgctcactgtaaagtcaaggtcaagccccatcagaatgtcccaaacagaagtcaaaaacacaagcacttgaaaagtggaaggtcaatttgggacagggttgaataccatcataagtaataaagtaatccaagctaattattcaaacagaactgtcaagaatccaagatgagatagggaaagcattctttgccagcaaaaagcattgcctcaaatgatccctttttagtcacaaaaatctccactatgtatctgtcctttactttgctaccctttcttttttccattcattgctgaaatctgacattttaactgaaggttcaaaacccctttatttatttccaagatttaaggggaaaaggtttcttttaaaacatcctgaatttaaaaataaataaactgaacaggaagacttagactgtctatttcaattcatcttgtgatttctcattttgtggattgtactgataaattattgtaagtcacatcgtaattttgcctaagaaatgtgagcatcatcgggtgtttttaaaatataataggggccctctttcacccagccatttcctgggctgctgctgttcctagtagcagccaaacacctgaacaaacccaggaattccgggccaaatggttctgataacagcagatttgggtagaattgatttgatcaaataactcatacaaaatgcagcttaataggtgtccttattctcaggactccactcaactagagagaagagagtgaaaacacatcctcttttgataatgtagtttattccaaaaaaaattttgtacgagtacatacacacatatttgaataatatatgagtgtaactactacacgaaggagtatcattataatcttggatcctgaacatatgcttaatttcaacagcttacagaaaagaattaatgttgcatgcataagggtgcagtgaaaactttggacgttgagttagagggttggttttgttctgttttttaacaatttcaaagttcctaaaatgcagatagtatgaagaaaagaactgattttctacatgactaaaaattcagagtcggcaagttcatgcttatgctaagcagttttgcttgaatcagtacctggaaaaattaaggtaattcctgtgtttacaggctctattcaagcaaggcaggagcaacatttgagagggattaacaatcaaaaattgaaaatctaccatcaccacacaagcttgccttttcattttgtacagatcataaaacatgtaacacggaccagacccttgtccggcaaatgttcacatcctaatttttaaaaatagcttttatacacaattgctctctttgcaataaaacaaagatttgtttatagctacaatttaattaagaaccttttcgaagaggaagatctggaaaccagggatcttattttttcttttttttttttccaccagggttgtttgtttattggtttaattttccctgaagtaaaaatacactttgaaatgtaacatgtcattatgtaatttgtagtaacaaagtgcaggcccttgcacacgacagcaaacaggaccgctccggctcacagacagtccccatatccacagccccctccccagtctgattaacagcctgtataaacattcagccaaccagaacagcggccagtgcacaatttggtcagccataaaactgccagccaaacacagacacgggggggttatgcagaaatcttaatttgggggaaatgatcaaaactgagacaacatggcccccacagagatcaggaagagctaacctttattttcattaatcccaccccacctcccaaatagcaagggatgctatcaccactgaaggtaaaatgataaataaaatgtccctgaaatgcagcgttgcagagggagcatggtcaagagctccacccctgaacagcaaaatcttaagggcaaaaataagcttctattttaaggagcaattttaaatggtctgagttatttgggaaaggtcctattttgacatatccagaatggattccctccatcagcatgttttctattgatgcaaggaaaactaatatgtattctaattgtgcagaaattggtgaaatttatacaaagggtgttttgtgttttttttttcccttcccaccattttcattgcccttggcaaaagactttagacccttcacataatggaaaattcaaaatgttcgacgtaaatcaaataattagtaagaaacaggttttaaaaagtttttttttagaatactctcgcaagatggtgaacttgttttttctggcttgggacaggatttcatagctcacttttgagactatatggtacccaacttttaacagaattgagtcttttaaatattctcttttctgaaaatatgctggtggtaatgacagtgattgaattagctatagcaaaaagacattgcgttagtctagttcctttctcctgaatagctttttgctaactggttactatagagcattgggcttcacagaaatttttcacaattttcacctttgttctagtcttgctccttaatttggaatctctaatttgtttgagaaaaaacaaaaacaagaaagcatgatcagccaccttaccaatgctctcccagaccgggttacccacgtcttccttcgtatatctaattgtgctcacaagcgtttattttttcctctcgtaagaaacctgcatgcttttttctaggtggctttctgctaaagaaattaataactaaacataatgcaagctccaaataaaatgagaaaatgtatagatatattgaataattattttttccaggccttaggcaaaccacttgccatttcatttaattctcacaaaacctatgagttgggtatatgtattatccacactttttttttcttttcacagattagggaactgaagtacaaagagtttcagtaatttgcccccaagccacatagcatgtgaacagcagagcgagagtactagctcaagcagcctaattcaagaatcaatctactgcccctcctagatatgatgttattgtctttgtcgagaggtaggtatgtctcagatccttagggtcattgcaaagaggtggacaaggagccctccatgatgatttcacttagttagtaagtgaggtagcctggttaatctaaggagcatcagtttcaaagtttgaaagctatgggtttcttcgcaagctcaccattgattagctgcaggaccttggaaatgtttactcacatatcccagcttctgtttcctcatctgcaaaaaagaaaaaattttgtgagagttaaatggaatgtcattttttttaatgcttcacaaacatatagaagattttcaggtcttcttttctctcccctagctaatccatttatatcacgttgtgatcagttttaatcattataacattacaaatatactttatgaaattacctttctagggtatagcttgatgaaaggatttcatatctaaaacaaaattttaaaccgaatatttgggtacattttttttaactcattggatcacactaaattgtagatactctaaaaaatgagttaggtctcctaagtatggctgaaaagtaggcacatttgccttcactccaaaaaccagcaagataatttctaatattcatgaatgttcatttcaaaagcatatggcaattgcacatgggctactctttggtcagcaagttaaagaagagcagagatgtcaaagaagcttcctctctgatatcatccatcaacttatggttgttggaccttctctgtcacagcctgccttcaaccgattctctctcattgttggaaaaagggaaaaatgagcaaaaactacaacaagcaataattcaaatcattgcccaaaatgttcttccaactctgtgagttacataaccttaacctatcttgaaaaccacagatttccatctccttgggatggcagaaagcaacagaatattctgaatgacattttcaggtttatgggtttgacatatctttcaaaacatttccgaattttccccacttcattccccaacacctcccaggagcacttgcagagagcaggcctaatgttttcgatgataaattagttgtcaatatatagacaagttactttttccaaagcctcttggagcagaagcgtattctacttcctctcaaaggccctagaactacctgtgtactggcatgctcacaagaaaatttttattcacaagaataatctgttgaaaggaggatagattttcaaatggagtttcaaataatcctcacctttgagatcatccgtgctcacagcccagtatttttacaagatgaaatgatttacagaatcaagcctggaaaaattggagggcaactccaaaaggcaagaacatgttgccgagtcaatcattcatcctgccagggaaacttttgtagtttccaaactgttatgagacaccgctctctatccagggcagaggaatcgttgaaaaggcaggaggtatgctggccacacagccagcatggagagctggagtttttggcagggcacttccaccccaaaagcagacagagtcctggaagggcgttcgtgtaaacaaagcaggcagatagcttcaactctgcaatgaggcgcaacctttcccagatcaaagcctggatcacagagacagccctgaagaactgagtgtcctttctggaacatccagctccaggggagagacttgaactggagccacaactttgccacctgtagccaatgacttggcacacgaaagctctcacagggtggggagcctgcagctgctcccacaacagaagatcaatggaaagataagacaacacagggaagaaaggtttcttactcgagatactgaagctgagatcatttaactaaagcttgcatccaggcaacccaagttctctatgcagtgttgaaaggggatggaaatcagtacagggtcataagctctgaagccaggttgctggggctttgactctctactctgcgtttactagctgtatgacctatgcctcagtttccttaccttcagaaggacctaatagtgcctcctccataggatttaatgagtgactgggacactagaaagctctcaaaatgttgccattattatttgaagttacacagacctgggtttgaaccaggtttggctacttagcacttttgtgaacttggagaaatgacaatctttgggtgaactccccaagggtaaaatggatgttaatacggcccttgcagtattgccatggtgatttaattttgtatgacacacagtaggcactcagtaattggcacttctgattattttcatttttcctggtttctgacagagaaacctgacaggactggtgaggctgcaagaaacatagccagtaaaatttaggatcctcttaagtccccaaagcttcatccatatgcaaaagagatacatccccagggaagactgggtcctggatgtttttaaatacacaacttattttattttaagagcaaaaagagaacctggaagtgttcccaaatttaacatctgcaggcagataggatgacgaaatgtattagtactgaggaataactttctcccgtcttcttggaaaacatctggggtattaccctttcctccactcattcccccacctcttaccccaaagctgactctcagccgacagtttatcagcaataaatggaaacacctgtgtggcagataaggccaactgagtgtgatcagctgaggaaaccttagggacgcatgtcactcaatatttctttttccatgccaggcagggcagaggcacaatctagcctgtgacagatggcaaggttcactttctcattcattcattcattcattcattcattcagttagtcattcattcaaaacaacctcaggaggtcagcaggcccagctccctgcctgaaataggtcaatgcctgagccaccaggtgaattagaaggctattgatcctgcttttaaccacatctgcaaaaagacattctagaaactaactctgtgtcttgttcaaatctttaatcaccctttcttttgtgaaaccaaaccccctccagctacaatttctcatctttatagagatgagaaatatcatcttctgtaccccatggccagtcaaaaagtatttttattgccatctctgctgtaataacctccccaaacttgaaaactctaaatccggttttcttcccatgtccccacaccatattaaacaatccccacctcctttgctctttcttcaaaggtcctactcatctactctttaattagcttgtttcttttctctcaactcattccagcatctacacatcatttagaaaccaaaacttgacacagaactctaatcgttgacaagagatgtagctgctattaaagtgaaaatgatccattgtgtgttttcacaaagccactacctggacccccaagcaagttacttaacatttctgtttcctcacctgtaaaggtgattcaatcataaagaatgaggtctgtgaacatgacattaggaagacctaccagcagccggtagtctgtaaaaggtaaaagtacttcttttacttcctaaaagaagtaagttcagaaagacatatagaaattaaccaggtcaagagaagaaagcaatcctaccagaggcaactgcctgtgcaaaggtcctgaggcctgacctgaggaccaggatgagtagatcccagagaacaagaaaagggttgtgaaatgaggctggtgaaggaggtagaacccagataacacaggtccatgtaagccaggagtttggttttttttttcaaggcactgggaagatgatgaagttataagcagatttatatattttttaaaggctcctggctgcagaataggttggacacagagaggatgtggggagagtaggaagctctccaggtaacccaggaatgagactgtgagagctcagactacggtggcatttgtgaagatgaagagacatggctagatttggaaatgagaattaacagcacttcactgattcactgaatatggcagtgagcgggagggaggtgtccagggtgctgccaagtgtctgatttgctcatcttggatggcgctgctgtttactgaggtggaatgctgggggaggaatgggtttgaggaagaaggcatgagttcagtgtttggacatgcagagtctgaagtgctgtgagatggccaagtcgagatgtggaataggccatgggatttatgattgggagctcagaggagagcctaagctggagatataaatttaagagtcaccagcatatagataataattgaaaccatgagtacgaacgaggtcacggagggagggtgtagaatgtgaaggagaagagggcagtgtatcaagccttgaaattctccaatatttaatggtaagcaagaggagaatgagccaggaaagagactggggagagtcccaagaggtgggagaaaattagaatgtcaggtcatggaatccaaaggaagaggatattttaagaagaaggtgctgccaacaagagacacacagaatggccaagcaggacccatagaatgtgacctgtcaggaagtgaaatgtggcatttgtttatccttaaggatctcatctaggttacattcctgtgggattttcaggattgtgtgtgctcctgggttttgttaactcggaatttttccacctttcctatgcacagctaaggcttactgttgcatgttatgactgaactttctatccaacgtgatcagtttagcaacaccagggttatatctcatctatccagatgcttctgctgttcagacaggaaaaaagtcaaaaatctcaatgattcttgctaaagtcctgtcactaatatttgtgtgtttactaatagaagcctttatttagctttcactgagagctatttaacctttacaggttttacaaggatcaatgttcggtttcttaatccatagtaaaatggaaaaaaacctgtgggcaggggccaaggtggaggaggaagaccaagaaggaaggtcactgaggcatgtgaaaattgttacagtacagtcagtcctcattagaagtagattaaaatctacaaaaaccaggcaaaagaaccacaaaattacagcagtctgagtccatttagtgaggagtaaatacaccttagtcctcagtaacctttggagaaaacatcacaatatactgcctgttaataacagagcaaccaaggaaattttaaataaatgcttgctacgttaaaataagtgggggaagcctatcatgtgattttcttttctgtcccttgtattttctataaagtggttttgagaactataggctcaatcagtttcaagttaaatttttgggtaagaattcactctaggaggtaatgtacacatcagattgttcggggatgttaggattgcccagagggctccaggatcatcagccttatccaatagaatgtttcctgttggcctttcacctaatggtttcacagctattaaatatggtcccctagatgtatcattttattagatattaatacattcagaatgtggcaaactctacagtgcaaataacttagttttttaaacaaataaattgcaaggaaaaaagccagcgggaaagagaagctacagattaaaatatatttaagagccacaacaaccaaatccagtgtataggtttgtcctgcttattagtaaatggacatttgctaattaactgcagaaattttaaaactgactggaaatccaatcctattttttaggtgtgatgacgcatggtaattacacattttttaaagtccttatcaagatacatactgaaggatttataaataaaatgacatgatgtctggtatttgcttcaaaacaatccagtggatgggggtggtgggccatggaagaacaggggagagggcttggggagagaggaaatcagatcagccttgagctgccgtgaaggctggatgacgggcacctgtgggttctcggtgccctgctctctactgtggatgacttcttgaaatttctctaacaaaaagcttaaaaatagagagaagaggccaggcatggtggctaacgcctataatcccagcacttcgggaggcccaggcgggcagatcacctgaggtcaggagtttgagaccagcctggccaacatggtgaaaccccgtctctactaataatacaaaaattagctgggcatggtggtgggcacctgtagtcccagctacttgggaggctgaggcaggagaattgcttgaagccaggaggtggagattgcagaaagccgagatcacgccattgcactccagcatgggggacaagagtgagacgccgtctcaaaaaataaataaataaataacgggaagaagtcatttcttcttcatcttgttattttggaagaaaacatttctaaacatcttcttcagcagggtagactgaacaacactaaaaacagattatttagaaagtccaatggtgaatacaaagataaattaagaagaagcataccttggagtaatggaggtgtgactatattattacctcagtaattgaaacaaccaaattgaagccaggcgagaaatcactccacactatgatgggttagagagctccaatgcctcaattagaactgatttctaattgaaacactgctgaacttcaggcagcaaaacccgcttctgtcgcacctctgtgactctgttccgaaagatagggttctgtgcttcagtgagctcctgtatgaagcccaatccccctacgcttctccttcctttgctctatgttcctctgctccagagaagtcacccattcatttgctaacttaggagtggcaatgccagtaaatattttgagaagttttagggaaaaaaaatatttaaaatgaaattcaaactactatggaatggactcttcactttcaagccatcaactctctttccttcttacctggtcatgtggttcccatccagatccatcgttgcccccttgggctccctgggctacctgcttcgacaaggggaaggccaccatgctgccctctgcagctccctgggtgaagggaggacaggttggccaggcagggaaccgcaggcaagggcctgtgactgactgactttttggttcatagtcatctgggttgcatatgcctgaaaacttctggggtttcagggtacatcagggtcactggagatggccagttcagagaatacccagcatctgaggtttttgccccctctctgcttgtgtttttacctacaccatttcctgagctcaataagccaatcacccactgaattcctattcatcttttaagagctcacttcaccatcaccaaatccgcagatcttttcccaacctgctcatcagagctaaggggcccttcctctccttccaatagttctctgcttgtaaagttcttataagatttaagtatctagggaaccaactatttggtgagctcctcgagggctggactgtgtctcattcacctgtgtatccatgcccggagtaatgcccatccctagacagtgcctcatgttcacccctgtgcatgtgaacaggacacatgagctctgtccatagctctccaacccccttccaccgcttgtctctaaccaaccccctttgcctccttcctgctacccctccttttccataccaccactttcccacaccatctccttcttcccctgaatcaagaagtgagaacatcaggaaagagagggatcaatttcatgccagagtctcaggctgtctccacggattttcccatgccagaccatttggctagtgattgctgaactagatgagaattctcagccctacccaggagtcctccagctcccactgcctcatgggcccatcacagctttctggatcaataaacctctccttcagtcaataggagctttgtgaactaaacaacagatgccacagggcctagaaggcaaataaatatggttattcaacattttatcgcactgtgtgtaattcaggaaatttaattatggtctccctagcaacagtaatgcaacttcaagcctggtacacaggccttgttttctggtgcacaagggagtgaccttcacgccttcacctggatggagaccatgcaatctggctgacttacagttgccatgggaaacctcagtgagtcttcctcccaaatcctctgcttccaaattcaaagctgattttcagcatttggtatggagactcgggtgggggaaggcactaacataactccagacaagtataggtagttaagcatcaaaggcacagatccagacgctggatacacttgagacacagaatgtctgagcaggactctcagaaaacgaagtgtcaggatcagacctgcctactgttctattgcctagagcaggggttattaacttggggtctgtgatgtccccaaagagagactgatggcatggtgattgggagcatggattccggtgccagacttcacaggttcaaatcctatttacctcttccatttatggagctatatgaccttaggcaaaggactcaccttccctgtgcctcagtctcctcatccataaactaggggtaacattattgggagaattccgggtgatttgattagttttgctttggagcacagagtaatactggacctctaggcaggatttactaatgacagcacttagctattttgcatggccccacttgtaatcctgtgcctgagccaagtcagaatggggacgtgtcacatatgggctcccttgagtttgttcttttttattttctgagaaaactatatttctttttccactcctcactcctctgcgaactttaattaagccctctcccatctagagagccaggcgagggttaagttttgtttttgaaaagcctcacaagcttgcacagcagcaggttttgccacagtttgacagttccagttcagctcggtgcggctgatttataagacactgagctcattggctttatcctctgttctctcccagtcatttctcaatcgagtcgccctggctggaaacatctgagaaagaaatttactgagagatgcacagacagcctattcacatttcataacttttcaggagccttcccccagaggagccagcggtagccagttaactcatgcacaatccctagctagtgtccctgcccccatcactccactcacctgtacagacaaacccaggtcccctccaaactcggcttctttgactctaatgctaagtgatgtagccatcacagcacatactgttcttagacctcgcccagcctcgcctgtgacagcaggattagacagggaaatatgaatggaaggcacccgatggatttagtgatttaattgtctgagcacttaaaaattcaggattaattccacttaagtgcagttgtttctttctcattaacagggatctgtttagaataatttatagaaataggaacctaatggaggctcaaaagaagcctttgcgtgacttatcaaccttgctttccccttctctagccagcccctctccctgcaccaatctggtctcaacatatagaagcctctaatctgaaactggtgtttcccactaaatcctccatttgtgcttgaagtaatttgcaatggccactttctgtgtcttgttctcagatgtgtcttcgtcaattagtgcaatgtcacagccgtgtgtagttattgtaactccagctgtgagctgttaataataaacttgcccacaggacaaccctgtcatatggttgatggtcaatcaagactaaaatatgcattagaaggaaaaaaaatgctcctgtcaacagtgagtgggtggaggtcattggttaggatgccggcatgtagctgcccagttcgggttaatgtcgtgtcgtcggcatccttgactcgctcccactctacgatgtttgtcctgagacacaaaggcgtgataactaaaatgacacagctggaatcagaagacaagtagacaaaacatggtgaaatgtagaatatgggtcagggaatagggatttgttgaaaagaaacatagctcagattctttagtaggaaaagaagacagatctgcgttttggtcatgggaaatgatctgtgggctacaagacaaattttatttaatgggagttctgaggcaaataaaaacaagctgatttgtggcaaatgagtgaagaaggaacagtcacccacttgggtgattcctattaattttcttcacaggatcacgaggtgttttgattattttagttcagttttaaattttggttttccaaggggtggctatgagtggggagactcttggcaaatagatgaaccttgacttagaaatctgccccagtatgaaaatctaatggcatttacttgtctcgatggctaaactgctacttactcatctctatgtcagtttcatctgcaattactaagaacgagtacagaatggtaaaaagccatgccaactgtctcagtcagtccatgcttttttgtgtgtttaaataagttctcaatacaatatctatcatagatagcatttcataataccctgaaggccacactctaaacaatctccagtctcttcactaccacaggtctcggttcaacattttctgttaataactgaaaacccagggaggccaaggcgggtggatcacctgaggtcaggagttcaagaccagcctaggtgacatggtgaaactccatctctactaaaaatacaaaaattagctgggcacggtggtgcgtgcctgtaatcccagctactcaggaggctgaggcaggagaatcacttgagcccaggaggcagaggttgcagtgagccgagattgtgcgtgcactccagtctgggcgacagagcaagactccatttcaaaaaaaaaaaaaacctgaaaacccaggttaaagcagtacatgcaactttttctttgaattcaagcattccattgcctccttttaaaaaagacatgttttttttctcctttctttatcttttttttctgtgctggtcaggaagtgaaatgattcaattcctaccgaggtttctttttcacagaaagaatgaaatatttgtcctctactaaaaacagaaaaactttcaattggcattcaaagggtaatcacacaataagggccttattaaaagcctggagccccgtttactcactgtggagcctgacttgattattcgataattagaaacaccctgctaatgactggactggagtcttccctgagggagtgcccccttcaggcaacgcattatttgtgattacacttttgtcattaagaaggtaaattactcacttctctttcctcccatattctttccagatttgcctgaaatttgtgggaatccagagaaggctgccctgtctggagatacccacacacaggcacatgtgcatacacatacatgcgtgcttctcctccatcccagttagttggttgctaagggtttgctgaatttcctgtcattctgaggctgtttcacttgctcagtggttctcagctgggtgcgtggcaatgtctggagttgtgtttggttatcaaactgcaaagaggagaggagctactggcatctaactag

SEQ ID NO: 361 - DNA, 23778 bp, Homo sapiens
ccggctaatttaatttttttgtatttttagtagagacggggtttcaccgtgttagccaggatggtcttgatctcctgacctcatgatccgcccgcctcggcctcccaaagtgctgggattacaggcgtgagttaccgcacccggcctatgcaatcaggtatttgtaataatgaaagcagtaattcagaaatatgttaagcctgacaaaagtcttttcttgctggcagctgcagctgtctgggtccctagaggttcatcttacttactgaaatgtggtttttaattttaaaccaagaaaaacaaaactccaatgtatttgatttttcaaaagaaaaagttatttaacaagtcaaaatgaaagtaatatatgcataaagagtacagaaagtttaatatgagaactaaaactcacctttttcttcaggccaccactccttgtccccagtgatctcttcaagggtaaccacttagattcttagtaatttttatagaaaatttagcatggatatcatacatctgtgtgtgtgtgtgtgtgtgtgtgtgtgtgtgtgtgtgtgcattccaagtcttcacaaatggggttgtattataaatactgatatatacctggctctttcacttaatcagaaggctaagtgaccatctgtttgagtccctagaaatatactgtttttttatgattgtacaatgtctttttttatgacagtatcacaaaatattgtattttagtcttatcaataagtctttggattattttcctgattatttttattataaataattctgtaaagaacattctagtcagtgggaatattatctgttcagtaggctcaatttctaacaatggaatcgctgagtcaaagaatgtttattcattgttgattttgatcattactaaattttaccaatctgtaaggtgaaaacttatatgtgatttgaattttttttacttttgattcagattgataccttttgctgattacttgtcattttattttcatttctttgaattgcttatttacattaattgatcagttttttattatcttttttctggtccttttcttactaatttgtacaagcattgtataaattagaaaattagctctcaactgtcaaaatatgatgccaaccttttcttttttgttattgatcttttaactttctattttttggcatttttcttaatagttccttggttttgtgtcatgtttaggaaggcctttcatattacaaaattaaagaaatatttccccatgttttcttttgatacatttatggtttcattttgtaattcaaaatttcagatccatctggaatttattttggcataaggagtcatttccttttcaaaatgatgaagcagttgtcaccatattatttattgaataatatgttaatgactcattattactctaataaagtgtatggcttagatttcggaatcagaaataactaaattcaaatgttggtgtgaatgttcttttgttagatttaatataggcttaatagtgtagagtcacaatatcttaactgaagctcttggcaccacatgcattatacttcactatgaaggatctctacctgcattccctggttgaacctgctaattaggaggtttacagggtgtcaggtcatggtggctgtcatctcttcctattggtatccactgaaatccccatatttcataaggtttctggttgttgatctacttagatctctttccaagccctgaatagtcttcattctctcagatactctcagctctcattctctcagctacttctgaaccccttcccttgcgcaggacatatttctctattcttctgaatctttatgggtgggactatggggaactttctgcagttatctcagacccctattgcccagaatttccatgcagccatctttattacagtgttccctgtggcaggctggtgtctggggatattctgtgaggcttaccgcctctctgacctccgcccatggtatctctcccttctcagatccactaaagttatctggaggctccagtcttatcaaccatcctcttgttcagacacccagagcatctcaaaccccgtttttaccttttgcatgctcctcttctttccgtcccagtggcaaacttcagctctgtctggggatggctgggtaggaaaaactggttctgagaaacttaccattaaagatctttttgtcctatgcctggatatcagcctttggtaatccaaaggcaaggatttaattcttttgttctcttcactaaagtatcaaccctaccctaaagcaagagacatctcaaagtctttgatagggaagagacacaggttaagaaggaatcactgaagagaaagcacattagttaatatgttggaattctagtcctctatgttactatgatattcaatactatagaaaaaccaactttcagagttaaaaaaaaagattaaacaaagccaaatttattacttttccaggtttaataaaacaattttaaggggtttcatagtcatcattataaaaaatgtcaacatagccattcaatgaacttagttggactttagccaattggtgaatattataaatacctgcaaatatgtttcattattaggtgttgccatcttggccctgcttcctacagagttataaattctctcatcattgactcctggtccacagaatatctttgttatacctaatagaaacacccctaggtatccattattgtgatgtatttttccttttctcctccagcattccaatatcctggtctctcatagtcaaaattttctattgggagaaagcaattgaagggctgccttaattattcagatttatttttccttgaaatgtattttgaagattttgattttggcagtaatgaatttcatacgaacattttactggttatcaaaataatttgcaagaaccaactagggccataatgttgaataaaaagtatttaaaatattctatagtacattaagatttttcacttgaaattattatgcagtatgaaatggataatttttgactgcttgaaaatatttcagtcactaaactaagtttagatttagatttcccaaagccaagaaaatgttaacatgatgttccacctacaattttaggaggaagtctatataattcttgaatttaaatgtggatcactaattatagttataacactaaattattcctgagtgggtttgtttagtattcaaatgtcatcccagaggaggaatcttttatctatagagctgtcatagataagcaatataattcgaaccctctttctaactaaaatttatttttaacttgaaagaacacatcacactgcccacccacttactcactgagaattgtgccagtgtgtggaatccctgctacaaaattagctaaattattttgccaggaattcagggtaagctaagttcattttggaccttgtccaacaaaatttatttagagttaatactagagaagaatctcacttgaaaacatttcacctatatgtatgcggtgtcttggtagacagggtgcctgaggacagtggcatagcaactttccagtgaggtaatttaatttgttaaattaaataattagatttattcctcatgttgccttggggtgatgaggaggagttaaggacatggagaaaaaagggcacagtaaattttggtggttatttttaagtctgattaatgatgttttaactgcaggtcatagatttagccgatggactttcgcaattcaggaaaactgtcagagaagactcattctcactgaaggttcatttaggttgtcagtagcaaagaaaaagatattgtacgaagctgccttggaggcactcgcataaaaattatgttaccatttatctatagttgcattgagttattcttataaactgatgatactaccaacccaaattgacaattcttgagaatacacacacacacacgcacatgaaaagttttcataaaaatgctgtttgataatttgtgtcctgttatctctaacaagtaaacaggtaaaaataaaataccttcatgcggtgaagaagtataaactgaaaaatagactcctattttgaaacctagaaaaaagttgtgctttaaacttttctctgtcaaatgagaattgcttaattcttatacttaaggaacgtgggaaatgaaaaggcagaatgtatagtgttggtcctttgatggaatttctgagaaaaaacaaactattccagatgatgactaaatcacatagttttaaatcttctgtagatttttaatggttttttttcaaaaacgcatattgttcaatataataaatatttgtagagtcaggaaaatgacaaattctttcttcctaacaattttacaatgaaaagtaatggtagtccaactaccgaaaattctaagaaatttgtggctttcagttgtgactatgacaaagaaagtgactacagaatgtgtcacattccatcaaagtcactcagggctttgttactctttaaaaatgcttcttggtggattcacaaatgtgcagtatgatacaaaaaagaaaaaaatcacaccagttagtatctttgctagagttttgtagaaatttaagattatgataatccccaccattcatccttttgaaccacaaaattatagaaacttgatttatactctacagtatattttttgatggcttaaagtatagaatgcaacttatttatctgtgattcttctagaagggtagggaagagaaatcattttaaaaagtgtatcagaaaccaagctgagaagagttgaggagcacatctgggctggattcacgtctatgtaattcactgtgagaattcccattgaattacacaggacaataattagacccagagaaacagatcagtacttttctaacttaacatttttatcgtcatttcccccaccacacacactcttttaagtagttatttgcaggcttaccaatgataatttttaagtatttgaatatgttaaattaaatattcagttatgatagttaagtaaataaagctgttgagttctgtcttgcatgtacgactccctttctgactttcataaacattcagaagactccagctcattcagagaattttcactaagaatttatttgctttttaaaatacagaaaagtcataaaatagaaaaagtttaggcaaagacttccctttgcctgcttgggtggatgaatgaatgaactagtgcatcacactgactgcctgctctgtgtcaggttctacttgaggccccagatactagcaagccctccaggttctcacagtctaatgagatgtagcaatgtaaacagctactttttatatgatgtgaaaaaacagaagtattaatgaaatgctgtgggaacataaactaactagggagtagtaattctgccttggtggtacttgggttttgattttgatcagagaaaattagaacaggtaatatttaaggtagttttgaagaatgagtaaaattttccagaaagtttggggaatgtaattcctggtagagggaagcctgtgaataaatgcagtggcaggagcattcacagtgtgagattctaaccggtgtggacatgtagagagtcaagtgtgaggcgatgaagggagtgagagaggagtaggtagcatggggacctggaaggtaggtggaggccagatgaggaggttctatcctcagcatttttttcctctgtcctctaggctccttacctattttgggtcatggacctcttagggcagtggtttgcaaaattcattgcgtattagaatcacctacggagatttaaaaaatcgttcagaaacctaggccacatcccatagagcctctgggaatgagatccaggactcaataatttaaaaatctccagatgctttcagtgtaaaatagtgcttctcagagtgtggtcccatgatcagcagcattagtatcagccaagaacttggtaaaaatgccaattcccagaccaaaattcagacctagtgaatttgaaactatgatggggtccagcaatctgtgttttaaaaagctctccaggaggttttcatgtatgctaaagtttgagagtcactgtcatagagaatctaatgaagctgatagtttttccagaacatgtaccgcatgttgaattttaaacataattctaggtggtagatggaaattccctctgatccctttccattttctcccccaaatcctggaatccaggttaagaattctttctctgggcagtgagtgccactgacaatatttcagtaaaagagggacaggagaaactttggttatagaatgatgactgctgtaatttaaacaatgaaatggaatggggagaggctgaagttaaccacatcatgcaggaggttttgggattataaaataaaatagaacatggtgacacagaggttgtgtgtggtgatcgaaagggaacagaaaatgattccaaggtttctaacttgagctcagagtgaatgaaaactacttgggagagggactataaaaagagaaggcttggaggcaaataatggtaattactggacatgtatggggagtgcattaaaaacaggtctagagcttagttgagagatgtaggttgtggataactatatagccacatatataaacaggtagatgtagaccatttctcatcctctgttgacattttgggtctgctaattcttcattttagagggatattttgtgcattttaagctatttattggcattccagctctctatccactagatgccagcagccaataccctctgcagtgatgacaaccaaaaatgtcttcagacattgcctaatgtcttttggtggcaaaatcatcccccattgagaaccacaggtgtaaatgaaacctggcgagtagatgagattattattgactaagtggagggcaagtggtgaaggaggatccattaagtgttcataaagattgggagaaagtggcatcaagacagcacaaaaaggctgagttccccaaagaaggtggttgggtatcaaacactacccaggagaataagaattgagaagaggcctttggatttggtgatccggggattattgtgaaacagattcaatagacagctattgaagagtgacgtgaaagtgacactgcaggaggtggaagaataaacaagaaaaagtggagattgcgaatctagattacttctctaagggattggttaggaaaagatagaagaggagaaagaggcaaaaagaatagggagattgcttattttaggacataagagactagcaaacatggtggactgatagggaagtgccagtgtttccagataaatatagagctttaggctggcccagaatcttttctttactaagagctcaaaatacagataatattaattatgaaggagagtatggaaatataaattatagcagcaacatattgaataattgcaacaagtataggtgttgcttatttcatgtctatcatctaactattaatttttaccagataaaactagtacattagggaatacatttaatctacaatacaggaaagtcctgttgatatgattttgcctgtgggctgggtgactgtattagtagtgatgattttcttttttcttttttagcttctgtctttaatcttttcttttgcttcttcataaccagcatgagtgcaggggacacacataccatttggtacaagccttatttgtcttgccttgggtctggaaccacttttgcagtaacacatttagaaaagagaaatcaagagcaaaaaaggcttcaatatagtttatttttttttgccagtaactttcttgttgcacaactattatatatgaaattattctttctaaacatgtgtgtgtgtgtgtgtgtgtgtgtgcacgtactcatgtgtttcagttcccaggttcttttcatggctgcacaacttagctgcaaggccttaggtgccttatttattctttccagatttcatgtccatcatctgcacaatgagcaggggggaatctatgtgctttgaggttgtttctggctttaaaattctataattgtatgattttctttctgcattatctttgtttggtgagagcttgccttaatctgatctattccagagcaaaatctctcaggttgacttgaagctttaatttttactctggttttcacacctttttgtttattaggtcataagtaatgagctctgaatgcttaagaacctgttcaagttcacattagtagcttatcagggttgtagatagagtgaaaacaaattcgggctttcctattttctcattgcagtatttaaatccaggagaacatgttacctatgaaaatgtagaatctttgcatgtctgtcttttcttcaagagattacaaaacattttccaagtgtaataaatgaatcctttccttatgaatcccatttgtaaacaactggattgataggttctaagcaccttaatagagagtgatgtgtgagtttatttctaccactagatattgtaactgtgataaatgaatcaactatttataatggtaagttgattctccagagattgcatttaaatttattagtataatttgcattagcactcctaactttaaaactcttcttaaattccctcacccttgtgactgatactcagtaggtgggaaggattatcacaggggaatgattggctagacaatgggttgtcctaaataatatagtttttcttgggataagaagtgaacaaagtttcttttgtcctggaagttaaatgggacttttttttcaatctaagatataaattgcattcctacattaagttatgtgtatggcaacgaaggcacttgcttatatttttaaggtaatgatttcattctttgcatgacattctgtccattgaaattgagtaaaatgttttgttatataaaatttgttcctcacagcacgctgactgttaggtgttatagttgtgtaaactgagtccaagatattagcaggcttatgtttacatggcaaattcgaagcaggattgctttgagatataaaaaacgttctgaatatatgggtgtattatccactcatcctttgactatgagtgggaaagggaaaagcgggagaaaaataggagaggggaaatgaagaaaggtacacagctgagtaaggaggactaaagaggtatttacacccactgagaaaacaatgatttaaaggtgctaaaaacaaactggagaagtgttcctacttcaggatctggaggaaaaggaaaagatttaaatcattttaagcaaacatttcaagcaggaccaggacttcagtgaatactactccagggctagcttttattatcttttcaattttattattatgacttattagcactggctggattcatactttttggagaattatttaactgttttgtgtcaacatatctatgtataaaatctggaatagtctaaaacttgggggatggaccagtataaccacagcttcagctcttcttcgttatataaaagagctggcagtaccctttttttgtttctcttctcatggccttcttatttatcattttttcctttctgctttttaaaaaaatctagaatacatttctttatccaaattctgtattttcttcttaacagagctccaaacttacattctccatgaaaactttgatggataaaccaaatgcataaatatctttgccttatttctaacctctttgaccctgatatattcagttcatatcaacaagttgtcattgtcttccagattgtctagttatgtcataaatatgtgtttcaactccccaagtaggaactgattttcctcctttttgttcatctcctataacattgagcacagtgctgggccccaaatacttccggaatgaatcatgacaagctgaagactgtgtaaagataaaaagaaaatcatactgaagctcttctggcaaaaggtcagttgaaatttatgacaaatgtcagtagctgaagacgagatatgggtgttgttcccagatatgaaagggagatgacaccaacacagagaaatgtgaagcaattgttctgtattcttaacagtctgtgtataatcctaaatgatacacatgggttggcatagtgtgctcagtttgattccagggatatctcaggcttatttaacaatgctacccttagaacaacattagcatactaatctatactactggccgcgaaccacattccttggtatcttttaactggatggattgagactattgccccagatagccaggataatatttagcatggtggcctaggattttaaaagggcagtatcaggggggaaagtcatggatttaaatcatttttcttttccagggttcttaccaacaacacacccagtaaaaaaaaaaaaaaaaaaaaatcatcttctgaagtttaaatatctctttcttttctcttgcttgtgctggattatcactcctgtgcacttcactgagcttgaaaattgcaaaagaaagacacagcttccccaccccccagctcctaaactactctgtttatagtcagtttgcctccctggatcttatgttttaacacatgctgtagtgttcagattgcaaacacagcgaagggatgtttaaatcctaaaaacaaactgttttcattgcaatgtgcaaaacagcattccatgaagacatttcaattaatattagctgagtgaggggagtcctctctctgtggcctgttcagtgtttggcctctctctgctgagactgccaaccagggtgctgccaattaatgccagctgtgatctattgtttgcttctgacacctgggaagtcccagatcatcagactcctgcaaacagcagctggcttagtggaggctgccagacttcggggattctgagatctctcagcgaaggtagggggccgtcttgttttagttaaggggatagtccggaatagccagcttaaaaccccagatgacttacattaaacaacccccaaatttggggaggatcagcccaagtctgtaagcctcgtatcttactctaggttcccatagggcagtcttttaaaaaataaacaaatgttcctaatcctttcttataaagtcccaacaagtccctgttatgctgtaaaggtattttcaggactccatacttctacaggaggttctcaatttggtccaattgtgctataatttaattttacacgtgttgaaaatgtgtatgccctttctttgcctaaaaccctagccttctattacagtactcactctgatcttcttactgataagacctaagagccaacctttactgagtgcttattatgtgctaggcactgagccctttacaagttttatcattttatttcatttatttttaataagcatgtttgatcatagtaatgatgtcaagtggatgaaaagtcagttgggtacaagggtttctttttttaaccttcaaatattattgttcttaaatgataaccatgttttattctgacttgggcccgctttgaggaagaacttgagcaagttatgctgcctgactgtatttcactgtggtggggttgttagatgagctgtctcattctttcttttttggggggttttgagagagttctgatgtttttgcctagtcctctggaattataaatgtcaggaagacagaagctacctgtctgtgtcatattagtgcccttcctacaatctgtaaattctaataaggccctgtaggaatagcagaaaataccatagactctttctcctgagagagacaatgttgagacgggtggtaaccggcccagtaagtctggcccaaaaatatgactagatcttctgtctcctgatgccttctttgcatcctgaattcttttcatatggatgcccttcaaagctggctggtagccctccttctactcggggctcctaggcttcagggttggagcctgctgatggtgttaaacacacagtgactttatggtgctggtcattgaggctaaggtgaagccagttgcacttgatttattcagtacatgattccatgtctcaagaagtgaaaatccagtgaactgagcctgtgccctagttctcattaacaacttaatccaaatccacttgaaatgctcactcttgaagtcgtcagtgatgatggcatgatttgtttgctgaggtctgttagttcaataggataattataaatagaatttataaacagttccgaataatactctatttcttgtaaatcaatgtaaaatttcccaaggagttgaaattaattttacgtttgtgcgatatacaaataagtgagagcccttcagtgttcagtgctcagtgtgcaaaactacagagtcatctcacatgtttctttgaaataaactatgtaaaactaagaaagtgggaaagaaaaattagaacaaaagatattctaggtgatttcttatagtcatatcatgatcaggttaatttatataagacacttgatacatttcatctacatcagcttgtttagaagtctagagtcaaagccttctctgatccagacttggtggactatctgagcagaagaatgtgctggcaggctgattgagctatgtcattttattgagggtttgatccaggaaagaattaaaaccatactttgctctaccccctatacagtcatttagtactagaagtttgcttctataaacaaaaggccgtcatcacttcttcctctgttctttagatctttgaaaatcaagccaattcacagtggccctatatgtaatttttatagcctaaagaacatatcagaagtatctgtctaatctccctatccaccctccactattagatctagaaaaggcacgagcatcatataaaattcatgccagaaaactatctttatattaactataattattctaactataattattctgtgttggcatttttcttctgctgccctttattacataagtgggaaaactatgattttaagtaaatgaaatagccactgaactaaaataaatgtgacttgatacatattctcttaatgaaatgtctgttggagactagaataacgttttgggatactagccaagtcaaaccttaagactttttaggtttgactgatgctagggagctgctggattctggaaataaaacaaaggtgttttacacctgatagaaattattgaacatgtcgaagacaggttcaaaggtattttcatttcaacttaaaaaaagtagtgcagggaacataggtaagcttagaatatggctatttttaactgaaactgtactgactttctttttgaagatgctgatacaacttctgacactgttggtgatgagtggtgcataacagccgtttcagctctgaggctatcaaatagtgaaagagaatcttctacatacaaatcccaggacaccagaacagctcttaacagccctcactttcctgagtaagctgaaggtggctaactaaaaggcctgagagaaattactgcctaaacaatgaaggaaggagaaaacccccaaggaagacaatgtaaagattaagtaacaaggtttcaatttgatacaatgtggggaatttcagtttaattctaatttatactaatttctcataattgtcttgatcctttacgtagagatcggtttggataaaggaatcatagctatgagaaggcagttagttactcagtgaatccaaatggcaaattctctgatgagaaaggggatgtcctcagggaggtctaatcatatgttttcttaaaccaaactcttttccttttcattaggctttcttgaggcaattggctaattaatgataataaatagttattgagcatcacagatattctaaatcctccagtgtcatacatttggaaggaaaaaagaccagtagataaacttaggaagagtgtgtgtgtgtgtgtgtgtgtgtgtgtgtgtgtgtgtatgtgtaacaaacatgccttaaaaccaggaattgtggttgtaaactgggaagacatacataaaagatgggatggcttaagtcacagagacagacagaaacttcactttgtgtgatcatgcagagctctccttatatataataggtgtaagaataatcatttccacatctgtatttggactttggccccatctcttaaatcagagttataaattctgtgaagctgattaatcttattttatgggtagctgtaaataaagagaaaggctgtctttcagccttacttaaggaaaaacaagaaatctttgcaaaatagaaatttgggaaaggatgttgagagggtatgatggtaggtacacgggagacatactgggtttgctcttgttatctagggaatggaatgagggtgtcttttcaaagcagggggtaataaaaagagcttaggctttggggtgcagcagctctgactttggatcctggctctccactgaccagctttgtgactttggacatgttacttaacctctctgacgccaagttttatttgtaaaaatggagataatacccagattacagaattattttgggaattagggatgattataaaagtacacagggatgattagtaaagtacacagtgtttggcacttaataatcggtagctgttattattgatattactgtttgattgcaaagctgaaaaggcctcagaaatcacaatcagatggctcatgtgagatcatgatggggtcctctcttctgaaaacacatgctacttaagtctgtgagaggaattatggatgaattgtcacagattaaactttatgaggtagctctcgttggtgcgtgatggtttgcactttgctattcttccttttcgcatgagagaatctcatctctggaatgaaatttacctggatttatcacaagagcacatgcttcgagtttgatttggatgcgatcacctgttaccctgaaatgaaaacttctttttcttgttttgggagaatctccctggcttaattgaagaagtttcccctcaaagattcattcagattcactcagatcagagggtaatcttctaatttaaaagccaatttatgacgaaaatcctaatgcaaagaggcaaacgtgtctactagagttgggcacaatagatttgtgtagttgtaacattttttgctactttttttccccaagcaatctcaaaaacaacaacaaaaaagtatgttaacaagactagttgaaattaatactctgctattagagtgtacgcggaccggctcactcccttcttttccaccgtgctgcacgctgcagttcctagaagacacgacacgctccttccttaacgaattccatccctgaaatcagtgacgattggcatcaggccaggtcgacttcttttggactccttacaagaccttgttcgtattttgtttttattagttcttactattctaatttctctcactgtcgcatttttcattggtttaagctctcagcagtcttgctttcttgccaacttaaaaacaaacaaataaaaccaagttagcactggggcgggtttcccccaactcacagcactaattgtataatcaccactcaaaagtcaacagactaagtccaatttgtttttaaacacgggcaactcttgagcctttgcatttggaaatgtctttctgcccatttgttggatttagaataataaactgcctatgtaaatgagagggtgccagccttcagcagcccacaccctcaaactgccactcgacgattcaaacatacagttcttgaggaaaagcctgttgtgaaagttaatggttataaaaagcacttatttacatctgttttagtgtagccttgaagagtgcaattaattaagaagtttctggtgtggtaagaataatcatacagcaggaatgcaaacacgtgatttccaaagagaattttattccatatggtatttttcccctaactaagaattaattgcaactttaaagaaggtttgattgtgtctatgaaaaacattttaactactgaggaattctaaatgacttcaatttaaaattttctttttttacattgttagagtcaagaaataagtgctttcatcaagctctgagttacagaatttattagagtaaagggaagaggataaccttcagatgtcttctgtggtgaaatgttgaagttaaaaattttaaatgtttgcagactaaagacatcctcggctgtgaggcctaaaagaataaacaaaatgtgacatgttttattttgttacttaacccttgtataaaaaagcacaacaaaaaatgtatataaatcatatttttatttctttctgaaaacacggacatggatttttggtgatgatcttctatgtagtggcatcatgccataggttaaagagtggttagtgtgtatgcaaatagctttattttggtatggcagtttcttaaagcagaaagttttaaaggtatacaacataaattctgtgaagatatgttcttctccttctgttgcaatatgctacgcattccagtattttgctgtagcccagcaatgaacaatgcaaagagatgaagaggggaaaaacaaaaacatggcagctgaaagcaagactggtggagaaaggatgctcgttgctgcctaggcacagaaagagaatgtgacatcctagaggagggaaaaagaataaaaacaacttggatacaggcagagaacctatttctatcaaatgcagttacaacagttgctgagaagaaaatttcaatcaataacaaagagctcttatcacatgcaactttaatttgattggcatgacatttccattatatgctaatgaattacagatgatgagaacggctgttgccttctgagtgcaattgaacattcatcaatcagttacttaaatgccagactgtctgaaatattaaaggaagttgttgctattttggagatgaaagtaaacaaactggaaatcttgaattaattgagaaaaggatacacgttgataagtaggatttggcaagttattacttctctgagtggatgtcagtgcaggtatcttattctcagtggaataagtgtgtccctgcaaagctaactgaaaaacaaattctcttaagtgaatcctgtttttctgttgactagcattatacaattattgactattactctggggaaaaaaaggctgatcctagaatgtaataagatcactctcaagtatgcaacatttttgacaattcaagtttaaaggaaaataactatccactaaaatattaacaataatcctcaaaatagcaggaacattgaaattatcacaattgagtaacagtactaaataaagttgttgcaaaagaaaaatgcaaaagaaaaaacacatgatataaaattactaaattttcatcctttccccatcaaaaaaatccaaaatgtttggagctttagaattttaattaaggttttcatcagtctcaagccacctaaagatgtctaagtttattttttcatcatcctttccacttcccttttacttgtccttagcattttactctagatggttttcctattaatttaaaaaatagttatgctgctttacatgtgaggaaatggaacattcagctaagtgctaaaatatctaatctttgcaaaacacgaattttgttctgctttctgcagagacatggtcagctggggtatttaggtaatggcaaagatgatcaatttgcaaactttttgtgctataaaaattgatttgttaccactacctcacaccaattaggatggctgctattaaaaaagccagaatgtaacaagtgttggcaaagatgtagagaaattggaacccttgtgcactgttggtaagaaagtaacatgccagcttctgtggaaaacagcacgatagtttctcaaaaattaaaaataggattaccataatcataattatctagcaattctacctctgcatatgtatcccacataattgaagagatatttatatacccatgctcatagtcttaaaatatgctagttttggtggaaaacttgagttaaaatttcttaaatattgaaacgtcttgtcaaaactttccaagctattaacttttcccttcctgaagtcttattcatatccagccaaaatgtggaggcaacccaagtgtccactgactggtgagtggataaacaaaatgtggtctatacatacaacaaactattatccagtctttcaaaggagggaattctgacacatcatcagcatggataatccttgaggacattatgctaagtgaaataagccagtcacaaaggacaaatactgtaggattccatttatatgaggaactagaatagacaaatttacaaagacagaaagtaaaatgatggttgccaggggctagagtgaggagggaatgggaattactgttttatgggtctgaagtttctatctggaaagatgaaagatgttctggagatggatggtggtggtagttacacagcaatgtgaatgtacttagtgctcctgaactgtatatttaaaataatcaagatggtaaatgttatgtgatatgtaattaattaattcacaattaataatgaaattttaaaagttgtaaaaaatggatttgttgccaaatgactagatttacgaattaaagcaatgtctgctatactaattaggatgtattactgaatcaacacagttttttgagaattattagacttttctgcaacgtacatagagagaaaatgtcaaatagatttggctgcctctgttcgaacaagcagaggtggcactaaatgttccaaattctattcatatgagggcacttcttcttaaaacacataactttatttctttgtagctctcttagtaaattctccagagagtaagagcaaaagctgggggtgtttgaggaatagccaggggtctgagtgactggagaaacatgaagaaggtggggcagagggaggaggttagttcagatgaagtcagagagccaactagggaccatggctttttccttgcacaggatggggaaaccatggcagggttttgaatagaagagtattgtggggttttttttgtttgttttttttgagacagagtctcacttactctgttgccctgtgcagtggtgcaatctcagctcactgcaacgttggcctcccaggttcaagagattctcctgcctcagcctcccgagtagctgggattacaggcatgcaacaccacaccctggataatttttgaatttttagtagaggcgggggtttcactgtgttggccaggctggtctcaaactcctgacctcaagtgatctgcccgcctctgcctcccaaagtcctgggattacaggtgtgagccactgcacccggccatgtgatttgatatatgtttaaaaagtacacaaactgtgtactacaagggagatgaaatggaagtgcagaaatggaattctagaggtgagagattactttcacctgggggaatcctggaaacaaaaatctgaggctgagctacagaggagaaagaaatgtattccttttcacatttgagtatgcttgagaatctctaaacagcacaactgcaccaagaattctcttgcattattactctgtactattaatttgtttgttgatagcagcaaatgagctttcacttactgagtcctgtgtgagcccagactatttcagcacttaagagtccttcaatgactacctcagaggtggatctcagggtgtctggggctcctatgcacatatgtttcttgttgtttacaaagctctttggacttaatctgaatgagagttgccctaaaaagctggagacaaatgattagccataaagttttatttttcaacatttaatttttagaataattaatttaataacagattttagggcatgtattccttgctacttagtggtttatgtctcttttaggagaatacctcattatgttctctatattgtcacataagagatgctggttctgcttttgattctaggagtcagtttaagtgaccatagatgatatacgtagtgtatatcatctagggctggaaggtaatcaattaacaaacggtttaaattgcttgggcctgaagattctagagtttctgcaagaacaaaatcaagcctgtcttctatatccttgagaaaaccttctatatttatagtagtgctttcctcaaattcaacctgactgtaaaaatgcatgatgatgtgccaaataaaggaagtgtgcgtgcacacacacacacacacaaaattagtaagaattagtaacaacaaattctaaacacaagccttgatatgctaaaaactataatatggtaaaaaaataaaaataaaaaaatcaaatgctttcagcttaaaatgccctgccaaggtttttttcttcaacccaaaatgctcacttaagtaatcttctaccacaaagttaaagctatacagagtaaacagaaatagaactcaactgtgcccttccttggtatattcaaataactttcttcaacacttatgcaattctgtgaattggtaacgtcattgaaaatatgctagttttggtataagttgagttaaaatgtctcaaatattgaaaagtcttgtcaaaagtttccaaactattttttctctccctgaagtctttatttggtgcaaattcagcatttaaatatttgtgctaatttaagttttcattacattttttctttggaaaaaaaatttggttgaatgattgactaattataaaagatatggcccaaattaaaaataactgaagtttatgacattgaaggaagatatgctttatctctgtactctaaatacaattctattctttttcctgaaattatatctgtgaatttctgtattctttctattttgttaaaaaatttatttgaaaaatgctgaaaaacccaaaatgcaaaaactacttagaattaaacaatttaggaaacaacacagatgtacaagtgagagccatccctaggcactgcccctgcttcactaattctacaacagagtggtaacccagttaacctatgtttttcaattttcatgtgtttataggcagtcctatgtatacatatctaccaaacaactgactctgctattcattggtcctgtaatttaacttcgtttttctttatatctatggctagctttctatctatctaattctatctttctatctaattctacctcagatgtcacagtctggaggtctgctggggaaagggactacacataaattttgcttggtttgagccatttaatgtgtttgaaaaaatggaatttgcatcccttttgatgacaggccttctgattcctattaatttcactcaactctttattatcatatctgcttagtgatctgaagcatttatatttgcggcttccaaataatattccattatattgttatagtctcatttatttagcccctcctcatattggaacttgaagtggctcttcctccccacctttttttttattattaaaaacaatgctgtcctgatcattcttaagtacctactctatgttatttctttggtataaatttttgaaagtggggttgctcagttgtagaatattacatatttaaaacttttatagacagtgcaaattactctaaaacacaaaattaccatttatacttccaggaatagtatataggagttaaattttcttataccctttaccaataggttgtatcgacttgttaaatttttttcattctgaatagcgataaaattattatggctttaaaaagtattttttaaactattgatgaaattgaccttttcatatgtttattgctatatgtatatatatatgtatatatatagtctgtgaatttcacaatcctatgctatgactgtttttcatatggataatctgtctgaaatgtaaaatattaatctttgctttaaatgttgaagataactttttttagtttttggatgtcttttaactttgttcttttaccttttgacatataggaatttaagatttgtatttaattaaatttcttatgtgtcgctttaaaaacttctttgtcttagtaagtttgaggggcaatttatcaatttgtactcttatacagtgttggtgggaatgtaaggaatagtacacataagcaatggtaaaatttggcaaaaaaatcccatatatacacacacacacacacacacacacacacacacacacacacacatgcatatatggcatagcacaagaatgtgcaattcacagaatatatattatatagcaacaaaatatggaaagaggtcaattattatatatgtgtagaaatacacacagcactgtttaacacagctttaagtgtaagaacaaagcccataagatgttcatttcttcaatatttagtaaatatatcaaacattttctgtacacaaagcacatttgaaagcttgaaacttaaaatctaactagtttctaaaataccttaaaaaatactgtggcatggaagctagtgttcttttggaattttcattttcgatttatatgtgttttctgaaaacaacagaacacatacaacacctctccctgccgtattgttgtattaagcaatgttgggattgatgtgaagattaaatcttcatgtctgcctttatctgtctcctacttttacatgtttgacctgtgaattgaactgattttgtttacttctattcttttatctcttttatttgtgataaattttcaatattaatttacctaaaggaggtatcttatttgtaattgaaatctcaaccatagcagtaaggtgtggatttattctgaggatgatacaatggcctaaattaatgtggcaatggattccagcagtttttctgttttaagtttgaaaaactttgtaagtcttacttcttgatgatcagagaggttgttgtgggttttgtgtggcacttctctcccttaagggatctgactgatagaatcgacgtttaaagaaaagtacatgtgtgtgtatatacatattatatataatataatatatattatatgttatatagtatgtattatatataatataatatatatgttatatcgtatgtattatatataatatatattatatgttatatatattatgtattatatatattatatacatgataataatttgcaaggagtgtcaacataataaagctttagtgcagcatcctagagatatttgcagattaacaccttgtttgctaattgtgtcagtgctcaacttaagttgcaaaatatgaatgtaaagagtatgagagtcttgcagatgggattgttaaagcaaacatctgcacatatgtttcagcttcagctcatagaaataaggcttctactgtctctccatatggaaaatcattgaagagagcatatttgtcccctctcttgctggcccacttttcactcctatctactcctataaccagaaaaattatgtatattatatatattatatattatatgagatatataatatgtatatataatatgttacatattataacatataatatgtatatataatatgttatatattataatatataatatgtattatatattatataatatgtattgtatattatatgtatatatatacatatatatgtattatatattatatataatatgtattatatataatatataatatgtattatatatactatatgcatatgtattatatgtattatatattatatataatatgtatatacacacacatatatataaagcagctcttttgagtatatgttcaagtgtgctatacctctccatccagtgctctcttacaaatgctggatttgggact

SEQ ID NO: 362 - DNA, 87117 bp, Homo sapiens
actggatttgtcagtctctttctttgatctcttttcccctcaaaatttaggggtaggtttgtgtagacctgttcatggtagaacatttggtgatcccccagccagtagctgggagaacaaggaatgggtaaggagaatgaagcatctgtaaggaaaccccagggcggcagccacgtctgtgtagggttggatggcacaactgttcgatacctgtgtacctctgtgtgagtgcagggatgccttgaaaatgccaggtggcctagagcagttattaactgaaagccgcatagtgcactggggtacggaaggtcggccaatagccactgcagagggttgggtgcttcttttggcaatgaagatccggctagcagcagaagccaaaattaaatgtctagagaaggaattgcaactagaaaaagacgtgtacctctccatgtctctcctcacatccaacttagcaaacaaaattgaagaccaagagacaaaaattgaaatgttagcatgtagatttgtccacctagggcgaaagatatggaaatgaccaaaaatcagagctctcatgagaaagcccaaccgggatgtgaaaacttggaatccctgggattgttatgaagaggaagactgatgacatagaagtcacaggtgtggagggggatggggatcattggcaagctcgctgtctcatgcaaaggaaagtgaaacctaacattggcagcaaaacgggggtcagctgatacaggagactctcactgtcagggaacctaccgctgcagaactcttagagattgcaaaggcctttaaacaactaccgaggaaatccctggctgcttggatggtctgattgtgggacacaggggctgatgatatttccttaacaggagaagcagaaaaaatgagtaacatcaccacccatgcagccctgcagaagcatctttgctaaggcaaggcagacgcaagggagtcatagcttatggactggctcattctagctatgagggaggcttgacctaatgagggaaatttaccgggaaggatgacctcctggcagtcaacagaaaaggcccaagggcttctccaagaattaggaatgagtcaagtcatctatgtttgggttctcacaggacttaaaacagttttttcctgcagggatgaaaaataaattgctgaagggtgcaccaggagaatggcacaacccttggctcatgttattgagtcctataaatgggacaagaagtatatgatgtgggaaggccaggcacaggggctcacacctgtaattccagcaatttgagaggccgaggcaggcggattacttgagatcgggagttcgagaccagcctggacaatatggtgaaaccccatctctactaaaaatacaaaaattagctaggtggtgtgcctgtaaccccagctacttgggaggctgaggtaggagaattgcttgaactcaggaggcagaagttgcagtcagctgagattggggcactgcactccagcctgggcaacagagtgagaccccgtctcaaaaaaaaaaaaaaaaaaaaaaaaaaagggctgggcacggtggctcatgcctgtaatcccagcactttgggaggccgaagtggatggatcacctgaggtcaggagttcaagaccagcctggtcaacatggtgaaattccttctctactaaaaatacaaaattagccgggcatggtgacaggcgcctgtaatcccagctacttgggaggctgaggcaggagaatagcttgaacgtgggaggcggaggttgcagtgagccgagatcgtgccattgcactccagcctgagcaacaacagcgaaacttcgtcttaaaaaaaaaaaaaaaaagatgtatatgacgtaggagaagccatcacagatttgggagctactgagaaagctagggacggggtgtgctttgtaacccggcaagggctgacaaaggggaaagataatgctccacaggaagaagggggaaaataagggaaagcgaccaactagagtcaagaacaggcaaatgtggcatgacttattgggagcagaaaaattctgagaaaaaaatatgtaaaaaatgttaaaatatggaaaatatgaaaaatgctgtgttagtagccttatggagggaagtacagactgaagggctgttttgtcccttcatttctgcccctctagcagaagaggaagatgactcaacccctcattctaatactccagcctatcagagggggattccatgctgggcccaagattagcagtgggaccaaggtcaaccccacgttgcaggtgaccagaggccccatattgagctcaccatttactgttcctctcaaaaaaataaggagaagactatttccttagtagatactagggcagaatatactttaattcatggaaatccataaatacaccctggtcaatggtctgccatcactggttatggggacaaacgatctggatgagaaggactttaatacatctaggtattggggaagctcccctgccccatatgtggtgtttatttttcttattccagaaaacattttaggcacaggtattctgttaggaaagacttagcaaacttcagtggaaaaattcagatcgaaggtgcatgtagtgaagactgtttttttttttttttttctttttcttctttctttttatttatttatttatttattttttattgatcattcttgggtgtttctcgcagagggagatttggcagggtcataggacaataatggagggaaggtcagcagataaacaagtgaacaaaggtctctggttttcctaggcagaggaccctgaggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcactcgtttcagagagcacagggttgggggtaaggtcacagatcaacaggatcccaaggcagaagaatttttcttagtacagaacaaaatgaaaagtctcccatgtatacttctttctacacagacacagcaaccatccgatttctcaatcttttccccacctttcccccctttctattccacaaaaccgccatcgtcatcatggcccattctcaatgagctgttgggtacacctcccagacggggtggtggcctggcagaggggctcctcacttcccagtagtggcggccagtcagaggcgcccctcacctcccggacggggcagctggccgggcggggggctgacccccccacctccctcccggacgggttggctgccgggcggagaggctcctcacttcccaaacggggtggctgccgggcggaggggctcctcacttctcagacggggcggctgccgggcggaggggctcctcacttctcagacggggcggttgccaggcagagggtctcctcacttctcagacggggcggccgggcagagacgctcctcacctcccagacggggtcgcggctgggcagaggcgctcctcacatcccagacggggcggcggggcagaggcggtccccacatctcagacgatgggtggccgggcagagacgctcttcacttcctagatgtgatggcggccaggaagaggtgttcctcacttcctagatgggatggcggccgggctgagacgctcctcactttccagactgggcagccaggcagaggggctcctcacatcccagacgatgggcggccaggcggagacgctcctcacttcccagacggggtggcggccgggcagaggctgcaatctcggcattttgggaggccaaggcaggcggctgggaggtggaggttgtagcgagccgagatcacgccactgcactccagcctgggcaccattgagcactgagtgaacgagactcccgtctgcaatcccggcacctcgggaggccgaggctggcggatcactcgcggttaggagctggagaccggccccgccaacacagcgaaaccccatctccaccaaaaaaaatacgaaaaccagtcaggcgtggcggcgcgtgcctgcaatcgcaggcactccgtgaagactgttcttgagagaggaagaaaatgggagcccctacaacttcctgcccctacatggcgttgtcaacattaaatgattcatattgtccagggggtatgctgaaataagtgcaattattatcctcccaataagtgcaactattatccacccagcacaaagcccatgaaagagtcttgtcttttttcgcattcccgtcttttcttctagttttgttatcttgttggcattatgtcagccgctgaagcttttactgtgctgcagccatggcttttctttttttaacttttattttaagttcgggggttcatatgcaggtttgttacataagtaaatgtgtgtcatgggggtttttttgtacaggttatttcgtcacccagctattaagcctagtacccattagttatttttcctgatcctctccctcctcccaccctccaccctctgataggccccagtgggtgttgttcccctctatgtgtccctgtgttctcatcatttagcttctacttataagcgagaacatgcggtatttggttttctgttcctgcattagtttgctaagaataatggcctccagctccatccatgtccctgcaaaggacatgatgttgttctttttgtatgactgcatagtagtccatgatgtatatataccacattttctttatccagtctatcgctgatgggcatttaggttgattccatgtctttgctattgtgaataccactgcaatgaacacatgcatgcatttttttttttttttgagatggagttttgctcttgttgccgaggctagagtgcaatggtgcgatctcagctcactgcaacctctgcctcccgggatcaagcgattctcctgcctcagccaccccagtagctgggattacaggcatgtggcgccacgcccatataatcttgtatttttagtagagacaggggtttctccatattggtcagcctggtctcgaactcctgacctcaggtgatccacctgcctcagcctcccaaagtgatgggattacaggcatgagccaccgtgcctggccacgtccatgtgcttttataacagaatgatttatattcctttgggtatatacccagtaatgggattgctggatcagatggtatctgtctttaagtctttgaagaatcaccacagtgtcttccacaatgactgaactaatttatactcccaccaacagtgtataagcattcttttttctccacaacctcgccagcatcttttattttttgactttttaataatagctgttctgactggcgtgagatgatatcttattgtgggtttttgtttgtttgttttgagatggagtttcgctcttattgcccaggctggagtgcaatggcacaatatcattgtggttttgatatgcgtttctctaataatcaatgatgtttagctttttaaaatatgtttgttggccacatgtatgtcttcttttgggaagtgtctgttcatgtcctttgtccactttttgatggaattgtttgcttttttaaaataaatttgtttaagttccttatagatgctgaatatgagccctttgtcagatgcatagtttgcaaaaattttctcccattctgtaggttgtctgtttactctgttgatagtttcttttgctgtgcagaagctctttcgtttagttaaatcccattttcaatttttccttttgttgcaattgctttcagaatcttcgtcatgaaatttttgcccatgcctatgtcctgaatggtattacctaggttgtcttccagggttttatagttttgggttttacatttaagtctttaatccatcgtgagttaatttttgtgtaaggtgtaaagaaggggtccagtttgaattgtttgcatatggctagcctgttatcccagcaccgtttattgaacagggaattctttccccattgtttgctttcgtcaggtttgttgaagatcagatagtcgtgggtgcgtggtcttatttctgtgttttctattctgttccactggtgtatgtgtctgttcttgtaccagtaccatgttgttttggtttgcagtaatgtcttatggtattgggtgctcatctatggaatggagatgggccatcaatcctcagaagatgcaaggcccagagcccacagtgaagattttttgtttgtttgttttgttttgttttgttttgttttgagacggagtctcgctctgtcacccaggctggattgcaatggtgcgaccttgtctcactgccacctccgcctcctgggttcaagcgattctcctgcctcagcctcccgagtaactgggactacaggcacctgccaccatgcccagctaacttttgtatttttagtagagatggggtttcaccatattggccaggctggtctcgaactcctgaccttgtgatccgcccaccttggcctcccaaagtgttaggattacaggtgtgagccattgcacccggcccacagtgaagtttttaggggttacatggttgggtaacactcctttgatactgggtgcaataattgacaaagcccaacaatgtcaactccagaaacagtcaaagaaatccaaacatttgtgggtcttttgggttattggagagtatgcatcccatacttagcacagtttttgagatccctatacagacttatcagagaaagggcacattgggcctgggacacaccacagcaggaagctttgaacaggctgaagtgttggtacagcaggcacaggccttaggcacccctttggagggtacagctaggactttggatgttactgctgctcctgaggatatgagtggggccttatggcaaccgcagtctagggaatcagtccttttaagaaaggagccaaaaccagatactctcctgttgaacaagaagtgctagtagtagagaatgctttacagcaggtggaattgctaacaaagacccttcccatgactgtgagaataggtctaccaatcaagggatggttagaaggatttttaaacaacccacctccgctgtagccccaacacctaccttgaataaatggcatgattatttgcaacaaggaagaatgctagcaatgagtcccttaagcccagaattacatactgcattaggctctgttatgacgtgaacaaacaaaggataccacctgaccctctccaactccagcacctgacatggtaagcatccagatgatgcttggtgtacagaggactccagcaggggaaaccgctgttcttggaccgctgttgctacacagccacaaactgatacaatctggtttgatacaggtgggcatcagaggagccactgggatgagttgcaagcagcctggttaatagtcacatatgagcctggcccctggttctttgcactgatagctgagctgtattcaaaggcctaattatgtggctggctcaacaggaactagaaaagtggatgattatgcacaaacctatatggggcatgaacatgtggcaagacatacggaaaaagccgcaaagccttgtggctgatttaactgtatttcaggtgactgcacataaaaaccactcagttccacaaaacatggaagctaaaaccctaaaaaaaattagaagcatcatgccagctcaggcctctgaactattgacctgggtacataacaaaagtggtcacagaagtgcaagagtaggctgggagacagtcaaggaagcaggattactcttaaaatgtagtgaccaggctgggcacggtggctcatgcctgtaatcccagcactttgggaggccgaggcgggcaaatcacctgaggttgggagttcgagaccagcttgaccaacatggagaaacctgtctctactaaaaatacaaaattagctgggcgtggtggcatgcacctgtaatcccagctactcaggaggctgaggcaggagaactgcttgaacccgggaggtggaggttgtagtgagccgagatcacgccattgcactccagccagggcaataagagcaaaactccgtctcaaaaaaaaaaaaaaaaaaaaaaaaaaatatatatatatatagtgacctagtcctggtacagtggctcacacatggggaggccatggtgggacgattgcttggggccaggagtttgagtccagcctgggcaacatatcgagatcccatctccacaacaacaacaaaaaatatatagtgccttcccaacagctcttacaaattgtttaccatgttctctattgtagatcatattgagcaggacacattcagatattcagaaggctgtccaccatgtaacagattggcaagtggattatttagatactgtccctgtaagccaaggaaataaatacatgttaacctgcatggacaccgctactggactgctgcaagattctccctataagcaagctaatcaagccagtactattaaaggcttagaggctctcagtactatgtatggatatatctggcacattgacagtgaccgagggacccatttcgctggatatgacatgcaggactgggccaggaaacatgatacactatggcacttttatctcccatagaacctccaagcagcagggttaattgaaagaaataccagtctgttgaaagcacaaattcaaactctaatttgggaaacctaccttgcataggcagatgaatgtgttatctccaacctttatttctttaaattcagccaaagcagggacgcctgccccatgtgaccgtctaggacaacggtcccccaagcctaccactgttcccataggggtaattgagacgactgctttgcttgctcccagacctcattgacaaccagtgtcttttgcacatgaagatgccagcagatatactaccgaggaggaaacacaccgagcttggaacgacaaatagccccaggctggataggctatttcctgctagagagtgacaacaccctaaataaagaacaaaacaacctgatacccaaaaacaggctgggtttatttggttaattccgtcttttggccatgttagtcaacttgctcctcagtcttgggaacaaatgaatcattctaaagatacttggccaaattgcacaagggatatgtgatggatagcaagagactgatttttatatactatgctataatataataaaatactcattgggcatgttacagaacggacactgtgtgcaggaatcttttggttggccccaaatggaacttcctggatatgtggtaccaatttatggccttggttaccccctgcatgtttaggaagatgttctttggattatacacgggcacagactgaatagttcacacactacaaagcctatcaatctccctcatttgaaatcccactggttctgatctgttttttattggtatgattgtttggcctccatttgtcttcctcatccggttattgaagatattatctggcatatagaaactctataaagcctgtaatccctgcactttgggaggccaaggcaggtggatcagttgaggtcgggagttcgagatcagcctggccaacacggtgtaaccccatctccacaaaaaataacaaaattagctgggcgtggtggcgcatgcctgtaatcccagttacttgggaggctgaggcaggaaaattgcttgaacctgggaggtggaggttacagtgagccaagaccgtgctactgcactcctgcccaggtgatagagcgagactctgactcaaaaaattaaaaaaacaaactctacaaaaaataaaaaaaaagaaaactttaaatgatagctgcatgggaatctctcttttaaacatggaagtcactgtcatgagaaagtctgtcctcccaaattaccaggctttacatatactcacgctgcacaacggggcacttgtgcaattggaaaaactgctgtgtttatattcctgatgaatcagttaatatcgctaaattaatgactgatataaaagcccacataaccaagctctcagacccctactttgaataattggcttcacagctggtttgggtcctggggcacctggtggcataagctgcttcttggtttaggtgctgtactcgtacgttccttactgtcttgtttgagcctttactgctgctgtgttatctgcctccagtggagccaacgcactgctgctaaagctatgcactatcaagggtcctccctttaggcccagggactatcatggaagagatgagcacgtgaaattgtcagggccagttttgagaggtggagtgtaggaatacagcctgttgcacggcaacagggacgccattttgaagcaaagctgccattgagaggtgacagggtgctggaagtccgcacagcccttgctcgctctcagcgcctcctctgcctgggctcccactttggcggcacttgaggagcccttcagcccaccgctgcactgtggaagcccctttctgggctggccaaggccggagcccactccctcagcttgcagggaggtgtggagggagaggtgcggagggagaggtgcgagcgggaaccggggctgcacgcggcgcttgcgggccagctggagttccgggtgggcgtgggcttggctggccctgccggtcctgggcaatgaagggcttagcacccgggccagcagctgcggacggtgtactgggtcccccagcagtgccagcccgccggcgctgcactcgatttctcaccaggccttagctgccttcccgcggggcagggcttgggacctgcagcccgccatgcctgagcctcccaccccctccatgggctcctatgcggcccgagcctccccgacgagtgccaccccctgctccagggcgcccagtcccatcgaccacccaagggctgaggagtgcaagcgcacggcgcaggactggcaggcagctccacctgcagccccggtgcgggatccactgggtgaagccagctgggctcctgagtctggtggggatgtggagaacctttatgtctagctcagggattgtaaatacaccaatccgcactctgtatctagctcaaggtttgtaaacacaccaatcagcaccctgagtctagctcagggttcgtgagttcaccaatcgacactctgtatctagctgctctggtggggccttgaagaaccttcgtgtccacactctgtatctagctaatctggtggggacgtggagaacctttgtgtctagctcagggattgtaaacgcaccaatcagcaccctgtcaaaacagaccactcggctctaccaatcagcaggatgtgggtggggccagataagagaataaaagcaggctgccccagccagcagtggtaacccgttctggtccttttcctgactgtggaagctttgttcttttgctctttgcaataaatcttgctactgctcactctttgggtccatgctgcttttgtgagctgtaacactcatcgtgaagatctgcagcttcattcctgagccagcgagaccacaaacccaccagaaggaagaaactgtgaacacatgcgaacatcggaaagaacaagctccagacgcgccaccttaagtgctgtaacagtaaccgcgagggtctgcggcttcattcttgaagtcagtgagaccaagaagccaccaattctggacacatcatgatgaccagtggtccacttttgcatagcaaagtgcactgcagcacagtcttcaaacaatgcctgctgcataaataacccttcacaaacatgcttctttaacctccggagtggttatgggttttggcaagaaagtctgagatgtgaccagctgcatatattttaccctaagaccttgctatagaaaggatgttttctggagtgtccatcgtcttgcagctctcccagacgtggcttctgttgcttagtccttgttcaaaatttcttttggagaaactggatttgttagccacttatttcattcagcctttgttccataaaagggtcatacatgtaaagtggctcccaaacgctgaaggagccgagaaaccaaaaacaaggcagatagatccagtttgtcagtaaatggtgatttgctggggaatttacagacagaagtgtagtcttgggtggcagcaagtcaggtagatctccacacctgttacccccagacccagggcttaccccggaaagggtgtatacttcctgtagagacaattaaaagcaacctttcagaacaggcaggaatgctatgtgcgtcgtagcctgtaatttatgccataatatcaaggttgctttgatctaaaggcaggggctggatgtggtggctaatgcctgtaatcccagagctttgggagggagaggagggaggattgcttgggggcaggagtttgagaccagtctgggaaacaaaacaacacctcatctctacaaaaaagaaaaccaaaattagttgggagtggtagcatgtgcctgtggtcccagctacttgggaggctgaggcaggaggatcactacagcccaggagttagaggctgcagtgggctgagattgcaccactgaactccagcctaggtgacagagcaagaccctgtctctaaaaacaaaacaacaaacaaaaaacgaagacaggatttacagtaagtacatgtccttaccaagaacagtaaataaagtaggaatgaggcccatgtgactcatgggacctgggttaatcagaagtcaacatggcagattagcatccaagatggagtcactttgtctccacagcctctcagctccctcagtctttgggggaaggtttgcatgcccctgctcactgaggaacagagaggccacgctgagccatatgcaggcaatcatcatcatctgctcacttaaagggatccagaaaccagaagggaaagacaagttgaacaccctgaaaaggtgcctcccactgataggaactgtggaaacccttatgtggaaaagcatgaaaagaaataagatcaggcaagggtgtccagctagatcattttttaaaaaaatagtaaaacatgtattttcaaattttaatagacaaattgaaagaggctggccattatagagaattatgctagtaatccggaagagcaagcgcgaaaaataactcaaacagacacaattatacaggaataaaaatcacccggcaaatataatacatttggaggatagatccaggaagactaacgtgcaagtaataaggctcaaaacagagaaaaagagacgaaatggaagagaagaattagaagggaaaaaagaagagctggaatagagaaaaaagatttgagtctgtctatgaaaagcttcaccaagtacaactctgtaaatatactaaaaaacactggtttatttatttatttattttagacggagtcttgctctgtcgcccaggctggagtgcagtggcgtgatctcagctcactgcaacctccaccttccaggttcaagtgattctcctgcttcagcctcccgagtagctgggattacaggtgcgtgccaccacacccagctaatttgtgtgtgtgtgtgtatttttagtagagatggggtttcacaatgttggccaggctggtctcgaactcctgacctcaggtgatccacccaccttggactcccaaagtgctgggattacaggcatgagccactgcacccggcctaaaaccactggtttatatactttattttattcttattatttttttaaatttgagatggaatctcactctgtcaccgaggctggagtgcagtggcgcaatctcggctcactgcaacctctgcttcctaggtttaagagattctcctccctcagcctcccaagtagctgggattataggcgagtgccaccatgcctggctaatttttgtatttttagtagagatggggtttcaccactgttgaccaggctagtcttgaactcctaacctcaggtgatccacccatctcagcctcccaaagtgctgggattagaggcatgacccaccttgcccagccaggtttatatactttaaacaggtgaactatatggtatgtaaattatagctcaatacagctcttaaatttttaccaggcacattatgtaaataaaaatttttatttcctggccggacatggtggctcacacctgtgatcccagcattctgggaggctgaggcaggcagatcacttgaggccaggagtttgagaccagcctggccaacatggcaaaaccctgtctctactaaaaatacaaaaattagccatgcgcggtggtgcgcgcctgtagtcccagctacttggaaggctgaggcaggagaatcacttgaacctgggaggtggacgttgcagtgagctgagatcatgtcactgcactctagcctgggtgacagagtgagactctgtctcaaattttaaaaaattatttccaaaaataaacaacaaatgactcaaatgaatgggcattttgagctagaggaaggagaaaaggggggagtccctggtgagcaatttaccttgtgattgattcacatagttgtgctgtgagtatctcattactcccagcaactggggtgtgcaggtagagtttggaagcatcattacccagctttcgtcatggaatacacctactcctgtaatgtgacaaagccccagcccaccaagcatgcgtgacccaagcaaaagtccaggaagtggacagggttaaagggctgcccatctagacctgtgcctttgcactgtggatttagcacaatgatcttcacgtggcatctgtgcccccacatcttgggcgtacataaagacttcctgaagagtattatgcaggcgtgggttgtttgatgggaaccattttccagatcttcaacttccgtatgtgcttgtggcctagaactgatctgtctgagggcacctctgtggtcagggctacacttttctgactcttctttgatgaacatccaacatttcctctgtagctcccatattattattaccacatttccgcagggtgtagaacatttcagggtgtcaaataaagccttttagtgaagggatacctcaaaaaccacctctaatttagggatcatatacccagagtaggacttcctgttttctcctgcctcatataaattcctgtgaagggctacgtggagtgtaaggaactggtaattttggcatgtgttaaggtgttatttacgcagatacactgtagaatgaagtaacaggagtaataaaaacttctttttttcctttcttttttttttaacaatctcttctcttccatccactctttaaaaatgcatccctcttgagggagtatctcatgagattggagcaagagcagaatcagcagaaagaatagaggaggcagtggcttatttaaccaaggagaaaaatcccatggcagccaacccaccttatctgtctgtctgcctattttagaatattcaagatttgtcaacaacttgctgggacaaagcaatgtgctatgaagcacacttccctgaattgtacaccattttctgtaaggggaaagagcttcctgttcactagtttcttggtttaggtaacaattgtgtatttggcatgatttcaaggagaaagatgttgtaagctccaactgattaatgttacaccttaagataaaagacacttagagaggccatacggcatgtcagctaagagcacagattgtggagctcgaatttctggtttcaaatccaatttcattgtgactttccacaaattccttaattcttctgggtctcagtttccatatttgtaaacatgagagtgaaaatagtacccacttcatggggttattgtgaaggcttagaatagtcctgcatttcgtaagcgctctgtaagttgtgttatttttaaaatgttaggtaagtgggccaagcgaggtggctcatgcctgtaatttcagcactttgggaggcggaggcgggtggatcacctgaggtcaggcttttgagactagcctgaccaacatggtgaaaccccatctctactaaaaatacaaaaactagctggcgtggtggcaggcacctgtagtcccagctacgtgggaagctgaggcaagagaatagcttgaacctgggaagtggaggttgcagtgagccgagattgcaccactgcactccagcctggtcgacagagcgagactccgtctcaaaaaaatgaaaaataaaaaatgttaggtaagttaatgattcatattttcttgaaaatatggaaagacgtatcataagagaagcatttttgcttaattcaccaaaaagttactgggggctataaattgaacacagagtcttacaaggcacaggaaattttttagacgtttataaacatatcttttgatgcagaggagtatgacagggtgatcaataaaagcttttcaagcaaaaaattattacagaccatatgacatcccagaaaagacaaaactataaaggcagtcaagagtcaatggttgccaggggttacgagggtggggtgatgaataggtggagcacagaggattcttagggcgtgaaactactgtatatgatactacaatggtggatgcctgtcattgtacatttgtcaaaacccatagaatatacaagagtaaaccctgacgtcaacgaggtggggaggttgtgcttgcgtaggggcagggagtctatgggacctctgtacttaccacttaattttgctgtgaacccaaaactgctctaagagataaggtttattaattagacatactgtgatatatgtatagcagtagaatatttatgttactggtatttaatatgatatatggagagagaccagtagaataatatggggaaagtaaaatggaactataagttcgtagagcaggaggaaccatttaaaaacctagactattgaggaagagcttgcttatatgttattcaaaaggataatggaagctaggtgcagtggctcacgtctgtaatcccagcacttggggaggctgaggcgggaggattgcttgagcccaagagttcaacaccagcctgagcaatatagtgagaccccccacatctcttaaagtaaaataaaatttaaaaaaaggataatgatgagtattgagatgctgctagtgtttagagtctactggaaacattttaaagagtagtaaaaacttttattatttcaatgtctacatttacaatatggtagaaattacattctttgcaataattaaatgtatgataaaaaatttagattaaacatagacagaggagggaaaacagcttttcaaaattgtttttgaacgtatacacaacagaaaatttgaagatgggcactcaagcacataggacatttctacacaaatggtggctccagatagctgaagaagcttaagcagctgtaggagagatctccaaatccagggacagtggctgccatcagagtggtccgtttgtgggaaaatgggtcacagacatagaccatatcaggctatatttcacagaaaatcttcttctttttgttactttctgatgaactatatgctatatggaaggtaccattgagactccttgtgatgaaaataactctacttgaattgggggtaaactaaaattagaagggaaagcagaccccttgtccagccaggttgaagaaaatctaagccggtacagggtgaggttgagagagatggcagcgagaatctggaacacaggcctttcctaaatcaaactttcagcacaggtcattcaagggcgaatttcaaatctatgctatgtttataaattgtgtactctacgtaattgccgggtccctggaattccctactctgtgcgaaactaatctcttactctctaaaacaaacccaagtcctaagcccacaacccctgtttgctctttccttcctagtcatcagaaccctcatgactcagactctccaaggaggcatttaaaaaaatgttctcggaccagtcagctccactcgagcaacctgctcttaactcattaattttcccgacatgtcccttatgatgactcgtccatctgtttttcaaattccacatagctgggcctctgtagctttgtggttttatattccgcatactttctaacagtgacagctccagaatttctatgtcagatgaagttgggaacaggcagtctggttggaggaagatattcaggggccagactcaaagtcctgtttggacatgacaacctccttttataatggcgaagagcacaggctctgcagctggactgatagtttaattcctgactccatcacttactaactttgtgagtttggccaaattacttgacttctccatggtttagtttccttatttgtaaaatgaagacaatggtagtactgtgtctcagagtcgttggatgccaatgcaggatcccagtgaccagatggaacgagagggagctcaggagagaccagcttgaagggccgaagtcttgttcccacattgccagtaggaggcataaattccccctcagaggacgtgcaggaaagaagtggaggggagagcccttgaaatggggggaaaacagtcctgagaggggcattaaatttcatatggccaagtatttacccaaaagagacctgaaacattgttttctttttctttcttttttttttttttgagacggagtctcactctgtcacccgggctggagtgcagtggtgcgatcttggctcactacaacctctgcctcccgggttcaagcaattctcctgcctcagcctcccaagtagctgggattacaggcacccgccactacgcccagctaatttatttttatttttatttttattagagatggggtttcaccatgttgatcaggctggtctcaaactcctaacccgcccaccttggcttcccaaagtgttgggattacaggcgtgagccaccaaaatttttttctttcttattgtttttaattctccccccaagcttactgaggtaaaatagacaaaaattatatgttttcagcgtgtacaatgtgttgatttgatgagtatacattgtgaaataattaccactatcaaactaatgaacacatcaccaacacatatttaccatttcttttctgtgtgtgttagcaaatttcagatagacaatacaatattgttaattatagtctccatgtgattaaagttccagaactcattcttcttataactgaaagtttgtacccttgactgttgtttttaatctttaaattgaggcttaaaatatatgcagtaaaatgtgcagagtggacacataagtgctcaagtcgttgaattttatttaattctttaatgtatttattttaaagaaatagagacagggtcttgctatgttgcctagactgctcttgaactcctgggctcacacaatcctcccacctcagcctctcaaggtgttgggattacaggcatgagccaccgcacccggccaattgttgaatcttaacacatgcatacactcacctacccgctttccagatcaagatgtgccacattcttatcaccccagaagcctcccctgcctcctccccatcagtgccaccctagaggtagccagtattttgactttaatcatcatcagttgatttttccatgtacttgactttcatataattagaaccatacagtatgccttccaaaagagacacttttaaaagaaaatgaaatttcatcaccaatatttggcaagcttatacccgtatcctcatttccaaccccaggcttccctgccattggtgggaaagagagtctggaaactgagttgggtgagttatagcaagccaaactacatttttccttgcatatctgaattacacggggtaaatttcaatcaactgctagttgtgagcctagaaatagggacgcaggtgagtcagggtccctgacctatgcttaagagccattgccaaagattgactcagggaaatgggtagttccgtgccccatcctcttccctactcacttccgcttgatactagaagtgagactcactcagtgtccactttccccacccttggagagctcacagggagtggagtgtatcactcacgtagccatgtgctgctctgcagctgggaaggagcactctggagaaagccgggcgtgtgtcctgatgctcttatcaccctccaaatccccagcttcccctagatagactgctattgacctttaccatccatttgtttccttttcttctcttcttccttctttcttctacaaaggcctcctgctttgaaaatgaggcatacccagggaaaacaggtttcaggtcagctctggttcaaagggtgggtcccttccactccgacaagtttgatcccctcattctgcctccctccctgcccctcctcatgtgtgcgccctctggtcttgccgactctgctctctcctccgccttgattcctgtagggtacatctctccaaacggccctgcagaaagcacagcgcagaaatgcccctccctggggagggaggacccaaagttctggcctcccctactcagtatcagctataaatgccacagacacgtttgcgaggaaaaaagaagaaaaataagaagccaaactgtggagcaatttgggggctccccccaaccatgccatctgcctacaaggcttaccctggcactggctggcctttgggtctttttgtgcaactttattttctatcaaggcccagggggtttgccccttgtctctctgcctctttgacctatccttcctttggaacccaggcatctaaatgacaacttctatgtgcatcatttagagatgagaagaggaaatatctctcctgctttctggttcctgtggctgcttctctttggacttctgggacccagtaagtgacttagcagttaaggagggagaggggcatggaggccacataagccctgaaggagatggggaatcccctgcccaggcatgactcttcttccagaaacaatgatgattcatttttttttttttttttttgcccatttctgcaaaagccagtactgatcccaattccactgaccatgattctgatgctgtcttagaagcaaatctgtattagtctcccccagctgtggttgtgagcacatgtggtggggcggtggggcggtgctggggaaatggaggggggtgagattttactttcctttgtatcttggataaaagtttttttttttaaccggaaaactctagttccaatagcattcttaattccaaattaaaaccaggatctcagtctaaagtcaagtaaaaatccttcaatccttctttgttttttttccataggttatttgggtacaggtgatatttggttatgtaagtgctttattggtgaattgtgagactttggtgcacccgtcaccaagcagtgtacaccgcacccaccctatctgtagtcttttatctctcgtgcctcccccgtccttcctccctagtgcccaaagtccactgtatcattctcatgcgtttgagtcctcacagcttagctcccacctatcagtgagaacatacgatgtttggttttccattcctgagtaacttcacttagaataatagtctacagtctcatccaggtcactgcaaatgccattaattcattcctttttatggctgagtagtattccatcgtatatatatgccagtttctttatccaccgttgattgatgggcatttgggttccatgactttgcaattgtgaattgtgctgctataaacatgtgtgtgcaagtgtcttttttgtataatgacttcttttcctctgggtagatacccagtagtgggattactggatcaaatggtagatctacttttagttctttaagaaatctccacactgttttccatagtgattgtactagtttacattcccactagcagtgtagaagtgttccctgatcactgcatctacgccaacatctactgttttttgattttttgcttcaacccttcttcggatgctgcctgattccaaatccatgtataatcccctgagaacttccctggtagaaacaaaccggagttcggccactgaggggttggctctgacattggatcagcaatggctgtgaaaggaaacagcccaggggagaagtgaattgggctccgtgtgactccaatgggctgtctgagatagtactgttcactccagtctttgatttcttacatcaacatatcttccctaattatgagacaccaggttaattggctcatccattccattgcctttactgtaggatggctcgtcaagaagtgggaggtgcggttgaaagagaaggtataggttggatgatgtggaggatttggagtgcttcccccttcttcctcagtatgcatctgtttcctgcaccccactctggattcgctccctcgcccgcttcagcacttccctcggcgttctttttcttctctttccccttgccttcaccctgaatgcttcaactgttctctacctacccatgccttccagatctgcccgtcgcctgtcctaatcctgaactccagtcctatctgtctgattttaaacaagagtccccttacctcagaagaaactgtcattcatgtagtcattcaacaaacatttatagagctcctcctctgggccaggcactgctgcgtgctaggccatggtgaggaatggagtgggaaatgccatggtcttgacccccatggaacacttggtctactgtaaaacatagacttaaataatatttcctaacaaaagggagcaagtgtgcaagggctgaaaggcccctcctcttttcctaccactagatctataaagtaaccaacagtgtctcctgtagccccattacagtggattagcaaggaccaactcctccatctgaatgctgggcgccgtctcaccctcctgccgtctcaggggctttgctcagtgcatttctccttcccctcccatctcactttacctttcttgggtcctttccatcagcatccaaacaagctcagttctgtatgcacaagtatcatccaaggagacgattaaaaacttgggtttccaggccctgacaccccaccaagcaagatcttgattcagtaagcttggtgggatggcgtgggttcttcagacagtgtgatcccagaggtccctggaccaaacactgaatgatgtccatcctaacgtccccgcatcactcctcagccaccacctctccctccactctcctcctcacccccattcttttttttttttttggagatggagtgtggctctgtcgcccaggctagagtgcagtgctgcaatctcggctcactgcaacctctgcctcccaggttcaagcgattctcctgcctcagcctcctgagtagctgggactacaggcgcacaccgccacgcccagctaattttttgtattttagtagagacggggtttcattgtgttgcccaggctggactcgaactcctgagctcagacaatctacccaccttggcctcccaaagtgctgggattacgggtgtgagctaccgggcctggcccctcacccccattcttgaaggacttccccacacttgctatgtcacttctcacctcccactcacttgtttattttattttattgtattaggtaatggatgtaagcagttctgaaaaagaaatacttgtagtcctacaaggcttctcataaaacttcagcccctgattcccttgccccaattgcttcttattctgagtcctgcttcccagggttcctgttggcatttacgttcatactgcatttatctatttatttagagacaagatctcactctgtcacccaggcgggaatgcagagacaccatcatagctcactgcagcctggtactcccgggctcaagggatcctctcacctcagctttccaaagcactgggattacaggcgtgagccattgcacccggccataaattctcttactaccattacttctttgttggttgaggttttttgggttttttttcctgctttgggcatgatttattgtcttccttctaatgaaaagaaagatttaggttagaccactccccctacacacttactgtctcacattcccgctcacaattctccccaaatgactgtatcaaatttttggtgttaaactagcatttagtgtttacattatgataactataaattttacctctagtaacatttataactgggtcatataattgcattgtgatgacattataataagtataaatgacctctagtaacatttataactgggtcatataattgcattgtgatgaccatccgttcttgtaatttttgtttttctagatattaataatagcctcatttttaaaatgtccatagttttcttcatatatgtaattaattcatcccaaaacctccaccagaagtatccctgtcttttccaaacacatgaggcaatctatcagtttcacttttttcccttgagcaatcccatttggaagcctctgtccaaccagagcaatcccatttagaagcctctgtccaaccagtactggttgcttgctagatctcttgtcctgcaatctgtattcagcaacattctggaaattcccttttttcccttgtaaattcttatcttttttctggctttatttttccatcttggagcatcactttctctagaagcttcctgagagagagagtttatggtgggaaattattttaaaaccttatgcactgttagggtaatgctaagctgctgtaacaaggagatcccgaaagtggctttgaaaaacaagtttatttttctcccttgtaccagtcctaaggtaagtattataggatggtgggagctctgctccatgcagtcattcagggatcctgggtgaatatggttcttccgtcttcaacatatggtttccagtgtcatcatcatttcagcccaaggagagggaagaaaaacagtattttgtattattttatgatacagtcagtcaaagtgcagccacaagaggagaggcttacaggccctagagacaggaggcatggcactgccatgcgggaccacctgagaaagacatcaaggtagtcaggaggcagaagacaggagtgaaggaaagatttatgtctttccttttattgggtttctgtgggaaaggcaaggaaaggcagggtgaacagtttaggattggctggtttgaataattcctgtgttctttgagctatatggctgattaccacctagttgcctagtacttgactttggaatgactaaggcagataaatattgtttcctggagtatatgggccagatagaggagctatggctctggaatggttagtctgcatatcagctcatgctcctggctggaccctttgctacttttaagaattggctagccctggaaggtcctgtctctccctagctagaaaagtttgttaagatgtcaaaacatgataatatacagaaattaaaaatatatatacaagcagaaatcaaggaataggtatttactcttaaagaaatgaagtggaaattaatatgtattccttcccttcaggggcctctgactagggcttagacatgtagccctacctagctacaagagaggttgacaaatgtaacttagccatgtgcccaggaagaagagaaaaatgggcccagctgtccatagaccttatacatctgaaaatgtcttattccaccctcacatttgactcatagtttagctggttatagaattctaggatggatatgatttttctcaggattttaaaggcgttgatccactattcctagattctagattgtgaagtctgatatttagattactgacctcttgtaaaagacccattctttttattctggaggatttcagatttttaaaactactgttctaaaatctcatgatatggtgtcatagtatggattctttcattgtgttaggaatttgcacagtagaaagttgtatcagtcagttctgggaaattttattgcatttttttctttgataattgcctctcgtccattttctctgttctgtctttctgaaaaaatcttataatttggatgtttgacctcctgggctgacactctaattttcttatatttcttcttctgtcttccaactctgtcgttttatttttcttctggggagatttcctcagcttctaaagtcttcaaatccttctagtgaattttgaggtttttttttttcaaagagatcttttttttctctacaaccatttttaagatggcatctcttacttttttttttttttgtgggtgctatactttctcttatattgctgaggacatttgaagttggttttgctgtttgcattgtctcagttctctctggctttgcttcatagggatatttgttttggtctctatatttcaagctagagatttttctcaaatatctggtaatcccagaatgtcctttgcatttgagtgaggcactaatatgatgcctggaagctctgtgagcaggggtagggcctgtcaactggtggacttagctttagggtaatttagcagagacgtggcagtttagattgggaagatcctcaaaatgtcagtatctagtgttggctaatttctttccacaagaagaattctccagatcctgtctagagcatactagcatagctgctgaagtgctggaagctgagcaagggaataggtaatgtgggttttacatttcagggtgtaagcatttccttaattgcatagtttcagtaaaaccttttgagaggtgacagggtgctggcagccctcgctcagtctcggagcctcctcggcctcgccacccattctggctgcgcttgaggggcccttcagccccccgctgcactgtgggagaccctctctgggctggccgaggccggagccagctccctcagctttcagggaggtgtggagggagaggcacgggcgggaacccgggctgcctgcggcacttgcgggccagcactagttccaggtgggcgtggcctcggggggccccacactctgagcctcgggctggcgtggccagcacagctggccccaggcagtgaggaacttagcacccgggccagcagctgcggagggtgcgccaggttccccagcagtgccagcgggtgctgcgctccaattctcgccggacctcagctgcctccctgaggggcacggcttgggacctgcagcccgccatgcctgagcctcccccacgccgccatgggctcctgtgcagccagaacctcccagacgagcgctgccccttgctttgcggcacccggtcccatagactgcccaagggctgaggagtactggcgcacggcgtgggactgacgggcagctccatctgcggcccaggtgcgggatccactaggtgaggccagctgggctcctgagtgtagtggggacttggagaacctttatgtctagctaagggattgtaaatacaccaatcagcactctgtgtctagctcaaggtttgcaaatgcaccaatcagcaccctgtgtctagctaatctggtggggactcggagaatctttatgtctagctaagggattgtaaatacaccaatcagcactctgtgtctagctcaaggtttgtaaacacaccagtaagcaccctgtgtctagctaatctggtggggacttggagaatctttatgtctagctaagggattgtaaatacaccaatcagcaccctgtgtctcgctcaaggtttgtaaacataccaatcagcaccctgtgtatagctcaaggtttgtaaatgcaccaatcagtgctctgtggggacttggagaacttttgtgtctagctcagggattgtaaacacaccaatcagcaccttgtcaaaacagaccaatcagctctctgtaaaaccaatcggcgctctgtaaaatggaccaatcagtaggatgtgggtgccaccagataagggaataaaagcaggctgccctgagccagcagtggcaatccgcttgggtactcttctatagtgtggaaactttgttctttcactctttgtgataaatattgctgctgctcactctttgagtccacactgcgtttatgagttgtaacactcactgcgaaaatctgcagtttcactcctgaggccagtgagatcacgaacccaccagaagaaacgccgaacacatctgaacatcagaaggaacaaactcaggacacaccacttgtaagaactgtgacactcacggcgagagtccacggcttcattgttgaagtcagaccaagaacccaccaattctggatacactttcactcctgccttcagcagtgcctgggattactgatctagagtttctttggtttcagtatctccagagataaaaccctaagctgttaaaaggaagagaggtgtattcatccaagtgcttgagtggaaggagtgatctggagctgagagacagttcctagctacattgtatttcaactatccttcctgtatttagtcacatgccacacccaaatctttagaggaacccagttgcaattcccgaatctttccaggattccacagaattaataatctaccagtagttgacttactctcacccccaatggaggcctgtatgttgaagctttctctgttgtgttggagagttaccactcatctgcctattaccttcaaaaaaacaaaaatatctcctctgctgttatctctccatcgtttgtccttgtggaggtatgtgttttgttatttctctactttttattcttctatgaaatccgtaagcctccatatatacttattcttttattcattccaattggggtctaccccatcatgcaaatctgttttcaataaactaaactcacttccatattgtctctgaatccaatggacatggcccaggccatatcttacttgatctctctgcaaaaatcaattcagttaactgccatatttttctagagcctctctattctcttgacttccttgattcactttttagagttttctttctgccttagtggatgctccttctcagtctcattcatttgcgtctcctcctctatctgagtgatgcagtggccagagcttggtccagcgccctattctccaacatactctcccagacaagcgatctcagtcagcttcatggctttaaatacaatgtatatttaaatgacttccagtttcacgtcttttgatctgatttctcctctaagaactaagtgcaggtttccaactgccaacagtctcctggatatctaatgggcacaaaaagttcaaagtctaatatttccaacttccacttcatccctattcattcagataaatagaactaatttccaactctgcgtaagccccaaagctagaagttgttcttgacttcttttcgtgtcatccaccacatgcagcctttcaacacttcctattggttctacttttctaatttcaaaacatagcttgtattcatccactgaaaggtatctcccctgctaccatcctagttcaagcaataattactgctcttaattttttcactcttgccctcctacatgcccgttttcacacagcatcttttaaaaacataaatcaattttgttttctactttctcttcccttcctgaatgattaagccccagatcattaggtgaggcagagcaaagcagatatcagggttggacaggaggggagacagcagtggcccagagaaggatataagaaactgaactgggccgggtgcggtggctcacgcctgtaatcctagcactttgggaggctgaggtgggcagatcacctgaggtcaggagttcgagggcagcctggccaacatggcaaaactctgtttctactagaaatacaaaaattagctgggtgtggtagcgcatgtctgtatttccagctactcaggaggctgaggcaggagaatcccttgaacccgggaggtggaagttgcaatgagccgagatagcaccactgcactccagcctgggtgacagagcaagaaactaaattggatgaagtggacttctccacagagtggcagcctggcatgttttgtcagaatcttgtgagggtgagagggagtatggggtggagggagtatgggctgaaaatgaatgaatagaataccagtgattttgtgagacaatgttttgtctgcaatatgtattattgaagttccagaaaaaaagggaaccgaaaacatgtttaaagaaatagtagctgaaaaaattaaatttgatgaaaactataaactcacagatcccaagaactcaacaaatatcaagcaaaataaactttaaaaaatcataccaaagtacaacgtaatcaaataactaaaaatcagtgataaaagggaaatcctagaatgagctagaaaagacacattgtatagagaggagcaaagacaagcataacagacttcctgtgaaaaaccatgacaaccagaagataaagaagcaacatcattaaaatactgaaagaaaaaaatactttatcaacctagaattacacggagtaagaatattttcaatatgaagatgaaatgaaggcttttctagacaagcaaaaactggaagaccttgcctcctggaaattgactttttttttttttttttttgatacggagtttcgctcttgttgccccaggctggagcgtaatggcacgatcttggctcactgcaacctctgcctcccggtgagaggtgacagcgtgctggcagtcctcagagccctcgcttgctctcagcacctcctctgcctgggctcccactttggcggcacttgaggagcccttcagcccaccgctgcactgtgggagtccctttctgggctggccgaggccagagccggctccctcagcttgcagggaggtgtggagggagaggtgcgagcgggaaccgggactgtgcgcggcgcttgcgggccagctgcagttccaggtaggcgtgggcttggcggccccgcactcgaagcagccagcgggccctgcaggccccgggcagtgaggggcttagcacccgggccagtggctgcggagggtgtactaggtcccccagcagtgccggcccactggcgctgcactggatttctcactgggccttagctgtcttcccatggggcagggctggggacctgcagcccgccatgcctgagcctcccaccccctccatgggcttctgtgcggccggagcctccccgatgagcgccgccccctgctccagggcgcccagtcccaccgaccgcccacgggctgaggactgtgagcgcatggcgtaggactggcaggcagctccacctgcggccccggggcgggatccactgggtgaagccagctgggctcctgagtctggtgaggacgtggagagtctttatgtctagcttagggattgtaaatacaccaatcagcaccctgtgtgtagctcaggatttgtgagtacaccaatggacactctgtatctagctgctctggtagggccttggagaacctttatgtctagctcagggattgtaaatacaccaatcggcactctgtatctagctcaaggtttgtaaacacaccaatcagcaccctgtgtctagctcagggtttgtgagtgcaccaatcaacactctgtatctagctgctctcgtggggccttggagaacctttatgtctagctcagggattgtaaatacaccaatcggcactctgtatctagctcaaggtttgtaaacacaccaatcagcaccctgtgtttagctcaaagtttgtgagtgcaccaatcgacactctgtatctagctgctctggaggggccttggaggacctctgtgtccatattctgtatctaactaatctgatggggacgtggagaacctttgtatgtagctcagggattgtaaacgcaccaatcagcaccctgtcaaaacagaccactcggctctaccaatcagcaggatgtgggtggggccagataagagaataaaagcaggctgcccgagccagcagtggcaacctgcttgggtcgttttccacactgtggaaactttgttcttttgctctttgcaatagattttgctactgctcactttttgggtctacactgtttttatgatctgtaacactcaccgtaaaggtctgcagcttcactcctgaagccagcgagcccacgagcccactgagaggaaggaacaattccacacgcatgggcttaagagttgctaacactcactgtgaaggtttgcagcttcactcatgagccagcgagagcacaaacccaccagaaggaagaaactccgaacacatctgaacatcagaaggagcaaactccagacatgccaccttaagagctgtaacactcactgtgagggtctgtggcttcattcttgaagtcagtgagaccaagaacccaccaattccagacacactgggttcaagcgattttcctgcctcagcttctcgagtagctgggattacaggcatgtaattagccacaccatgcctggctaattttgtatttttagtacagatgggggttctcaattttggttaggctggtatcgaactcctggtgatctgcctgcctctgcttcccaaaatgctgggattacaggcgtgaatcgacaggcaagactgacatttttttttaaatgtaaaagttcttcaggaagaaaaaatttagatctatgcaaaaaagaatgaagtgtgctggaaatgataaatatatgggtaaaaataaaatttttttcatttaaattttaaaagataatatacttgagtaataatgaattatgaggcttatatgtagacataaaatgtatgacaacagtggtacaagggatagaaaaaggaaatggaagtgtactgtgttgagactctcatgcctttacaggaagaggaatgagctcactgggaggtagacagtgataaaggtgtatatcgtaaatcctagagcaaaggcacacaaataagaatgatatttaataagctaatggtggaaataaaatggggtcaaaaatgactcaggtcatggtgcagcggtttatgcctgtaatcctagccctttgggaggctgaggcaggtggatcacttgaggccaggagttagagaccagcctgggcaacgtggtgaaaccctgtctctactaaaaatacaaaaattagctgggcgtggtggcgcatgcctgtggttccagctactcaggaggccgaggcaggagaatcacttgaacctgggaagtggaattggcagtgagctgagatcccatcactgcactccagcctgagtgacagatcaagacgctcaaaaaacaaaacaaaacaaaaaacaaaatactgggttaattaaaaaaaaaaaaggcgaaaaatggaggaaaaggtaagaagatcagacgagaaaaatagaaaacaaatatgaagactattaaattcagggccagctacagtggttcacacttgtaattccagcactttttggggctgaggcaggaagattacttgagcccaggagttcgagacaagcccaggcaacatagggagaccccatctttacaagaaataaaaattaaaaagtaattagccaggcatcatgactcgtgcctgtgatcctagatagttcggaggctgaggcaggaggatttcttgagcttagaaagtcaaggctgcagtcagccgtgattgtgccactgcattatagcctgagtgacagagcaagactctgtctctaaaaaagaatcagacccaacgtatttataattacattaaatgtatatggtccagacaccacaattaaaaggcagagattgacacattggttaaaaaagaaagccccaaataaataatattcaaccaagaaatacattttaactaactataactacaaatagggtaaacaataggataaaaataagaggaagaaagatacggccatactgtatgttagccatgctaacatcaatttagaaaaaaattgagtgactatttcaaaatcagacaaaataggcttaagaagaggtatattattagggataaagagagacatttcataattataatcacaacacaatatttactaactacaaagggagaaaaaccagcctggatacaccttcttaatcaagtaatccaagagaacatcatcaatgatgggacacattgatattatctgtcacctgatagtatgcaaagagaagaatacagcatcacttcagtggttttcctggcaaagattaataacatgagcctaatcatgatgaaacattacaaaaactcagtttaaggaaaattctataaaataattgacctgtaatcttcaaaggttaaaagttatgaagatcaaaggaagactgaagaactgcaccagactgaagaagactaaagagacagaacaacgaaaaacaacacacgattctgaattgaactggtttactattaaagacattattagaacaactaacaaaacttgaaagggatctaaggatcaggtggcagcaatatattcatgtgaatttcttgatcttgatggctgtattatggttgcgtatgagaatatataaagtattgaaggataatgagacagattcagggaaaagggttctttgtgttatacttgttacaaaagaatttgtgattttttttttcaaaataaaaacaaagagaaattaaccagagtatgttattccagtgggtcttcattgtatttgagatgaaatttaacctttctaccatggtattttgctaaactctgagtatacccctgtcagcaaaagaaatgtgggcttatgttcttgtaaagaagagtttagaatataaagaatgtaaatacacctttgggttatgtgttgttaaaaaggcaggggtcctgcttcagagattatggttagaaaaggtctctctaccgcctcgttttctccttcagtaactacattccagccaccctggtctcctatttattcatgaatcacatcgagctcattaacaactcagggtatttgtacttatgctatcaatctgtgatgtccttctcctggcctttcaaattgctgccttcttttttttttttttttttaagatggagttttgcccttgttggccaggctggagtgcagtggtgcaatcttggctcactgcaacctccgccttccggttcaagtgattctcctgcctcagcctcctgaatagctgggattataggcatgcgccaccatgcctggctaattttgtatttttagtagagatggggtttctccatattggtcaggctggtcttgaactcccggcctcaggtgatccgcctgggattacaggcttgagccactgcgcccagcccaaatggctgccttcttatccttcagatctcagttcatatgtcagttcctcagagagaccttttctgactccagtatctaaagcagcaccactgctttctttaacagcacttaagccaatgtgtatttatattttatgttgtagctctcttctttactaaattataagcccatatcccttttgctgacaggagtatgcccagagtttagtaaaataccaggtacatgttaagccctcaataactgaataaataaatgaataagaagtactgagtatatgtgaaagtaacactatactaaacctgcaaattcatctttaacccattcccaccaccttatttgttctccacctcaggctctgagaataccacagccttcacaaaaggctccgacaccaccacagcctccatcacaggctctgagaccaccatggcctccaccatggcctctacttcggccttaactacaggctctaagatcaccacagactctaccacaggctctgagacaacctcagcctccaccatggcttctactgcagccttcaccacaggctctgagaccaacacggcctccaccacagactcagggactactatagcctccactaggaccttcaccacaggctctgacacaaccacaggctccactgcaggctctgaaactatcgtggcctccaccacagtctctgggaccacaacaacctttactatagcctccactacagtccctgagactaccatggcctccagcacaacctccactgcaggctctgagaaaacgatggcctcctccataatttctgagaccaccatggcctccaccacaggctctgagactgccacagtctctaccacaggctctgagaccaccaccacctccactgcaagctctgaggccactaaagtctctaccacaggctctgaaaccaccacagcatctactgcaggttctgagaccaccactacctccacctccatggcaggctctgaggccaccacaacctcaactgcagactccaaggtgatcacggcatccagcatgagctctgagaccactgtggcccccgctgcaggctctaacaccaccacagcctctaccacaggctctgagaccactacaatcctgattaaagcctctgagaccaccacagcctctacagcaggttctgagaccaccaccccctcccccacaggctctcagaccaccatagtctctatttcaggttctgagatcaccaccacctctacggcaggatccgagaacaccacagtctctagtgcaggctctgggaccaccacagcttctatggcaggctctgagaccaccgtctccactgcaggctctgagaccactacagtctctatcacaggcactgagaccaccatggtctctgccatgggctcagagaccaccacaaactctactacaagctctgagaccaccgtcacctctactgcaggctctgagaccaccacagtctccaccgtgggctctgagaccaccacagcctatactgcagattctgagaccactgcagcctctaccacaggctctgagatgaccacagtcttcactgcaggctcggaaaccatcacaccctctactgcaggctcagagaccaccacagtctctactgcaggctctgagaccactacagtctccaccacaggctctgagaccacaacagcctctactgcacattctgagacgactgcagcctccaccatgggctctgagaccaccaaagtctcaactgcaggctctgagaccacagtctccactgcaggctctgagaccactgcagcctctactgaagattctgaaaccaacacagcatttactgaagattctaagactaccacagcctctactacagggtttgagacaaccgcagcctctactacaggctctgagcctaccatggcatccaccatgggctctgagaccactatggcctctaccataggccctgagaccaccaaggtctccactgcaagctctgaggtgaccacagtctttgctgcaggctctgagacaatcagagcctctaccgtaggctctgagaccaccacagtctctaccacaggctctgagaccaccacagcctccatcatgggctctgagaccagcacagattctaccacaggctctgagaccaccacagcctctactgaaggctctgagaccaccacagcttccactgaaggctctgaggccactacagtctccaccacaggctctgagaccactacagtttctatcacagactcagagaccaccaccacctgtactgaaggctctgagatgactgcagtctccaccacagtctttgagaccactacagcctctactgaaggctctgagatcacaatagcctctacttcagactctgagaccaccacagcttctactgaaggttctgagaccactacagtcactaccgcaggctctgagaccaaaacagcctatactacaggctctgagaccaccacagcctctaatacaggcttggagaccaccacagtctttaccataggctctgacaccaccacagcctctactgaaggctctgagaccactgcagtctctgccacaggctctgagatgaccacagtctctactgaaggctctgagaacactacagtctccaccacaggctctgagaccactacagtttccaccacaggcttggagaccaccaccacttccactgaaggctctgagatgactacagtctccaccacaggtgctgagaccaccacagactctactgaaggctctgggaccactgcagcctccactgcaggctctgagaccaccacagtctctactgcagattctgagaacaccacagcatctactgcagattctgagaccacctcagcctctactacaggctctgagaccaccacagcctctactacaagctctgagaccaccacagcctctactgaaggctctgagaccactacagtctccaccacagactctgagaccaccatggtctctaccacaggctctgagaggaccatcacctctactgaaggctctgagaccactacagtatctgccacaggctctgagaccacagtctctactgaaggctctgggaccactacagtctccatcacaggctctgagaccactaaagtttctaccacaggttcagagaccaccaccacttctactgaaggctctgagattactacagcctccatcacaggctctgagaccaccacagcctctactgaaggctccgagaccaccacagcctctactgaaggctccgagaccacctcagcctctactacaggctctgagaccaccacagcctctactacaagctctgagaccaccatggcatccatcatgggctctgagaccactatggcctctaccataggctctgagaccaccaaggtctccactgcaagctctaaaatgaccacagtcttcactgaaaactctgagaccaccatagcctctaccacagcctctgagaccaccacagtctccactgcaggctctgagaccatcccagcctctacagcaggctctgagaccaccaccaccacctctactgaaggctctgagaccactacagcctctactgaaggctctgagaccaccacagcctctactgaaagctctgagaccactacagccactaccataggctctgagaccaccacagcctctactgaaggctctgagactaccaccacctctactgaaggctctgagaccaccacagcctctactgaaggctctgagatcactacagtttctaccacaggctctgagaccaccacagcctctactgaaggctctgagaccaccacagcctctactgaaggctctgagctcactacagtttctaccacaggctctgagaccatcacagtctctgctgaaggctctgagaccactacagtcactactatgggctctgagaccaccacggcctctactgcaggctcagagaccaccacagtctctactgcaggctctgagaccaccacagcctctattgaaggctctgagaccactacagtctcctccacaggctctgagaccaccacagtctctaccacaggcactgagactaccatcacctctactgaaggttcagagaccactacagtcactactgcaggttctgagaccacagcagtctataccacaggctctgagactaccaccacctctactgaaggctctgagacaaccacagtctctaccacgggctctgagaccaccacagcctctaccgcagatttggagaccaccacagtctccacctcaggctctgggaccaccacagcctctaccgcaggctctgagaccacaacagtctatatcacaggctctaagactaccaccgcctctactgaaggctctgaggccactacagtttctaccactagctctgagaccaccacagcctctaccacaggctctgagatgactacagtctttaccacagtctctgagaccaccacagtctctaccataggctctgaggccaccacatcctctgctgcaggctctgaggccaccaccacctctactgaaggctctgagaccaccacagcctccactgcaggctctgagaccaccacagcctccactgcaggctctgagaccaccacagcctccacttcaggctctgagaccaacacagcctgtaccacaggttctgagacctccacaccctccagtgcaggctctgagaccaacactgccttcatcataggctctgagagcaccatagcttccactgcaagcttggagcccactgcaacttccctcacaggctctgagaccaccacagtctctatcacagcttctggggccactgcagcctccaccactgtctcttccaccacgtttgtactcaccaaggccactgacgtttctatccagcccatcaccaacacacctatgtcaggtactaacccccatgtcttctttgagcccacacattttaactccagtggcaaccaccagctgttcacctgtttctatcatctctgccctggttcaagtcaagccagcacacagttagatataatttcctcttctaggctgggcgcggtggctcatgcctgtaatcccagcacattggaaggctgaggcgagcgaatcacgagatcaggagattgagaccatcctggctaacacggtgaaatccagtctctactaaaaatacaaaaaattagctgggcgtggtggcgggcacctgtagtcccagctactcggaaggctgaggcaggagaatgatgtgaatccgggaggtggagcttgcagtgagcagagatcgcgccattgcattccagcctgggcgacagagcgagactccgtctcaaaaaaaaaaaaaaaaatgtcctcttctggaatcctaattgcctctactctggtctcacctctttttttttaagtgcccaccacttccattgcaatcagaaccacaatatagtaaaccacaagtgcatcatatctgtcacatcttcctccagcaagcccgcctcaactctactggcccatcacagttttgtgaaatgctcccacttcggtgccaagtagattatctctattcaaccaaccatctgtgacactgccacctcctatcaatgtattgactctagaccagaggctggcagaccacatttcatgggtcaagtctcacctgttacctggttttgtaaagttttactggaacatagtcatgcccattcatttatggtttgtctccagctgcttttctgcttttccgtgtatttgcaacagagacagcctggcccaaaagcctaaattatttgctgtttggacctttacagaaaaaatttggcaacctttgctccagtctgagaccaaacaattttgttcattctctggcacttgccatcagcaagccggttacatctgattctatcctcttggttctaagcatactcacttctattctcatgactggtgctgtttgtgatcccattttaaccacttctgacctaggcacacccatcgctacctaagccgccaccaccgcctctgctgtgttgattcgtgctcacacctgtctgagcccaccctctcctatccctgtgagcagccttctccacttgggtcaggtcctcctacatctgcccaagcacactcacctcacctttgctgatcaccacagtgtggtagatgatgtcacctctgtcccagccacggccactggcatgcccatgagtgaatccaattctaccatctcctcctccagctccctccttacacccagtgatcacagtcacaaaagaagcagggcctgccgctttgtataccagcccacccacttatttgatctgctttgatttatttattttcaattttttccataagttattgggatgcaggtggtatttggttatatgaataagttctttagtggtgatttgtgagattttggtgcacccatcaccctagtagtatacactgcaccatatttgaagtcttttatccctcgccccctcccactcttcccccaaagtccccaaagtccattgcatcattcttatgtcttcgtatttccatagcttagctcccacatatcagtgagaacatacgatgttcggttttccattcctgagttacttcacttagaagaatagtctaaaatctcatccaggtcactgcaaatgctgttaattcattcatttttatcagcccaccctcttctatttgggtggccacttctgaagtcaaatagatcttccacttctgaacccatcgcgataacgtttcctcaaacttctgcctcctccatcaccaactccaccaggtgacacattctacctccttctctgtatgacacccacctgcattctggggacatggccacagcagaatcgctttctaccatctctcctcccccaccacacctctcctgagccacctccaccataggtttgttagattcaccctcctctggtctaagcacccccattcccctttaatcatctctgctacaaatgcatcatcttgtgtgacctgtttcataggcaccagaaccactggaaccagactcactgcctccagctctgtcaccatggcccctggaatggacttcacggcctctgctgccagccatactgtgccaggaatagtcttaaacacctctggcctgggtacatccactatgggagcatcatctaccacctcagcccacggcgtcaggaccaccacaggatccacccgtgagccaaccagcagcaccttccaggaaacaggcccggtgtccatgggcacaaacacagttagcatgagccacacacccacaaacgtgatcaaaccaagtggatatttacagccctgggctatcatcctcatttccctggctgcagttgtggctgctgttggattgtcagtaggactgagtttttgtctggtgagtacccagggtgggttcataggggagcctggcaagaaggcaggggggaatcatgtcagcagtgctttggaaaaatccagaatgagaaaggggagtaagttggtgcgctcagaaggaaagaatcacctagcctgatataaggaccagagagaatgcttaagtcagagaaagtgagaagcaaagtagaaaaagaggagggaaaagatggagttggggccaaagtgaagggaaatactgacagaacaagggaaatactgagagagaacaaggaggacataaacataaagaaagcaagaagcagctgggcgcagtggctcacccctgtaattccagcactttggaaggccaaggagggcggatcacttgagtccaggcatttgagaccagcctggccaacatggtgaaacttgtctttactaaaaatacaaaaattagtcgagagtggtagcatggacctgtagtcccagctactttggaggctgaggcacgagaattgcttgaacctgggagatggaggttgcagtgagcagagatcgtgccactgcactccagcctgagtgacagagcaagatcctgtctcgaaaggaaggaagaaagaaaagaaaggtaggaaggaaggaaggagagagagagagaaaaagagaaagaatgaggaagaaaggaagaaagcaagaaagagaaagaaaggaagaaagaaagaaagaaactgagagagaaagagaaagaaaaaagaaagaaggaaagaaagagagagagaaatagagaaaagaaagaagcataaaaatgttcagccatccaaaatgcgggcttccgattgtctcatgtatgacaaatttctggtcctcacagcaattccttgtgtggcctgtgactgttactctctgacctcccactccatctctgctctctggtcttgattgttctttgaatacatatttttcttacatcgatttcacatttattgatgttcttcctgttttcttgtgatcctgcgggtaagttaccatttgaggagtgaagcagagtataaatcagtggtgtgctggagctggctcatcctggcccacaagagattgtgcagttcttcccaattctgagctgagtgatgtgacactggtagcttaaaatatgctgggttggaaatacttacaccacagcaattgtcaaacactacaaatcagcacttttccctcggagagcctgttattaagtgttggacagcataccactggtaaaaatggacaaaatgaaaaatacggaagtcacaaaagatttggataatatagtcaatttgctgaggttctttgttttagaattctcagcctctctccgtatgtggactacataataaataccagcatctaagaattactccctaaattactttattatttcatttgcaagatcaagagagaataacgaaagtgaacattgagtttttactgcctgctaggctcaaggctgaatgtttaaaatgcataatgttatttaatctggcctacaatcccgtggccatattatattcatcttacaagtaagggatctggagcttcatgatcttagctatttgccccagcacatgtagtgagtggcagatataagactctaactcaggttagttggattctggagttcatgcctataatctcaaggctctgtgtagacagctttctagagctctcaattccacgtacctgttctgagctttcttagctgactaacaaagagaaagactgtctgtaaagtgagtctctgtgcctttcacataggggtatggatttacctttgtcttggaagtccaaaaacacataaccttatgatctgcagagctagggcctgagtacgcacataaagatgatatgttaataaggtaacaaggaagcttattttgtcagacggagaaagagtaaaagaacaaggaaaaagagagacagagacagagatcatagtaaggatggtggtaaagagaagagaacatgggcagtttggaaaagtgaaaatctgacattggtgaaacaggcatgtatggtgattagggagaggagacttaattttcatttatcaatgtatttatttttttcttttagagaaaccttttcttccccctgagatattgtggtatttattacccccatggccacagccacagccttggtctggacctgaacttgggcctgggctctgggacattccacagcctgggaaatgcactggttcatggaggagaacttgaaatgggacatggaggaacacacggctttggatatggagtgggccatggactgagccacatccatggagatggctacggagtgaatcatggcgggcattatggacatggaggaggccactgaggacaccatggagtggatcacagagggagccaccaaggaggccacggcaggacaagatggctgtggccatagattgggtatcaaaacatattatgggtgggagggggtcatggaggagaaaaaaataatgatcatgaaataattaaaatggagcataggaagcttcccaggatgtgatccatggagatggacatggactaggtcaagaaaagaaccagcaaaaggacctcagagactttgactggcttggaggggacttcaagtcaaagcttctgtgagtttttcctgagtctcagcctctgttgtggggagtcacgacaaccaccctcaggacatcttctctcccatttcccgccacatcagggtcaacgtttctcatccctgtgtttcctcatggtgctataaatattaccaagacatgtctaagaaacaaaagcacataatgaatgtattatcagggccacacacgtattcgttttcctgtttgttctttcaggttttgttttttttttttttttttgagtgcttattatgtaccaatcactatcccaggagcctttaaatacgtcatcatttggctgggtgtggtggctcacgcctgtaatcccagcactttgggaggccaatgcgggtggatcacttgaggtcaggagttcgagaccagcctggccaacatggtgaaaccccgtctctactaaataaatacaaaaatcagccaggcgtggtggcgagtgcctataatcccagctactcgggatgctgaggcaggagaatcggttgaatctgggaggtggaggttgcagtgaggcgagattgtgccactgcactccagcctgggcgacagaggaagactctgtctcaaaaaaaaaaaaaaggtcatcatttaatcctcagaaaatatcttggtgaccttgaggtaggcaaagatacttagatacttaagcaagacacaaaaagcactagctattaaaagaaagtgtgatgatttggacttcattaaagcctagtatcagcatatacctttaagaggtatattcttaactataaaaggaaagtcaaagatgggagaagatattgcaacacatatagctaacaaacgactcatatccagaatgcagaaagagctacaataagaaaaagatgatgcaattttaaattgggcaaaatatttgataaatagttagcaaaagaggatatcaaaacagccggtgaacatttgaaaaggtacccaatatcactgcttatcagaagtggaatgtaaaaccgcaatgagataccactacatacacacactgtaatgactagcatttgaaagactgccagtaccaagtattggaaaggacattgaacaactggaactctcacacattgttagtgggagtgtaaattgatacaattatcttgggaaaatgtttggcaatgctaaaattaaacacataccctatgactcggtacttccactcctgagagtaaatatccagcagaaatgaatacctgtgtccaccaaaagacatgtaccatgccagcttcattcataccactgcagggtggaaatttaaccccaaagtccactaacattagaacaggtaagtaaattgtgacatattcatgcagtggaatgctacccagtagtgaaaaaaaaaacctatgaaatcacacaataacattaatgaatctcatagtcagtgttgagtaaaagaagtcaaaacaaaagtgtacctactgtataattccattcacatgcagttcaaggccatgtgacattaacctgttgtaataaaggtcagagttgaggatgccttgggggaaaaggctgaccgggagaaggcatgagaaagccttcttgcaggggcagacaggggaagctgagaatgttctgtgtatgatctgggtggtgattacaagggtgtatagatatgtaaaacttcattaaaatgtgcacatgagatctgtgcactttatggtatgtaagttatgtctcaatttgaaaaatgaaaaagatattctgaggctattttctcagcatattatgatttccttggtcagagaatgtggttggagacacatgacgataaatgaggcatttggtaagcccaaagacagtggtgctgcaggaagcattgtgtgcaagggaggcaagcagctattttcaatgaggacaaatcacctctctctttaggttgaaataggtctgatataattaatctgccattctctctggagaatggtgccacataacggggccaacactgatctctgctgttagcagttgaggcactcagccatggattatctgtccagcttggccttggtgaggggaaggccagctcactgagccttgcatacgcttcatccctgccagcctgtctgctttgtccatgtccctgctgagcgagcactagagcagctggaaaaagagattggctgacgtctgcagaatggatcgcttggtcaacctcatcatggaagatttcctctgtagtgaacgcccattggtgaacagtcacatgggatgcacatactctcaccatctgtgcccttcccaagagactcgtccaccttcctctttcccagacttccttgtcatcaattcaccatgtctttcctcaccctgagttatctagccaaactgttagccactgcctattgatcagggttaactgtaactggtcatctctttgcccaggcaaagtaaacaaagcagatgcattctttacaattcggatcactgggagaattttccttccccactgtcctgcagggctgccgtgagtggggtggtaatgctgcagcagcctgctctctgtggtgttagaatagcatgcagaaccacccacacaccagaggaaaccaaatctttcctttctcagtcaactagacataggaaacccttcatgtgactgtgattatggagagagaggttaggaatgtagctggagatgccactggagttacagctgcctactcatgcctcttacttgtgccttgaggaactaactcagccaaattcgcaggcaccacttccattcaaggaggtgagcactgctaagtatgcccagtctagtgtggtggtgcagacaacacccagttcataaagggcagctcatgtttcatgaaccctcgcatgctgaggacccaagattaagtcagatgctaggatgtggaagagggcttgcttttgctccaaaactctggggacctgtgccgtggctcttctactagctacccagtgtctccacacagctttctgatgtaccacagacattttaggcaacattggatctagtcagcaatgtctcaagcagccttatggccttgctttggttcccacttgaaagtggggaaatatgcgcagacggagcctagagatgaactttgagtaagatgttatttatgttcttttttttttgagatggagtcttgctctgtcgcccaggctggaatagtggcacgatcttggctcactgcaacctccgcctcccgcctcccgggttcaagcgattctcctgtctcaacctctcgagtaggtggaactacaggcgcctgccaccatgcctggctaattttcgtatctttagtagagccaggtttttaccttgttggtcaggctggtctcaaacttctgacctcaagtaatccacctgccttggccccacaaagtgctaggattgccggcatgaaccactgtgcccggccacgtcatttatgttctaagccccataagctccaccctgacttgtagatcgcaatgatgtcttgtatgttaccctaaaggtttgggtgttttcatttccccattgcactgtcacgatgataaatggctgagattccttttgaaagctaggaggaagattcgcggcacatcctggtggtggtggtggatcttgctgccttcccttcatttctaggtctgtgaacaggttcgggcctgggaattaggtgagagtctgtggcaactcaagtcagctctctgttcaaccacctggatattttcacttatatagatcaagtaagattttagtggttaattgattaatgattaattagccatagccaaagagccctgattacagctctggtcgtgatgcccacatcgataatcatgcctgtcttgtctctggagggaaagccctaccacctacctactgtttcctgaagattccaccatgcccactgaaatcaggaagctcatttcaatggtcagatcatccaccattgcatttagcaaagagctgctacagagcttttcaacgatgctggtcctctcccttctaatgccttgatgaagacagtttcaatggaaccttctgggaggacgtaatgaaagagtgagtgagcaagttgcacatattaaatccattccaacataactctcttcctaagtcttttgatttttttcttccgcttatactaatgaaatactgggatctcaactttatttagtgtaggccaccactaagtccacatttcaagcaaccgagagaactattagtgcaactcacacctacttgagctaatgttttgaatctagaacatgtgataagttcacccatgtatttgttttctatcagtgataacttactacaaatgcagcagcttaaaccaacacccatttatcagaccacagttctatgaggcgggtctggggccagcatgactgactcctttgctcagtctcacaggttaaaatgaaggtgttagttgagctgcatcctcatctggaggctggcatctctttcaagctcacgtggttgtggcagagtccagttccttgtgtttagagttgaggcccctgtttccttgctcactgtcatctatggttgttttcagcccctagatctgactcaacgcatggagctggaggccacgaggggcattgtaatagggcctgtggtaggcagaataacagcccctcaaaaacatccacgtttcaattcccagaacctggaaatatgttactttatatggcaaaagggactctgcatgcatgatcgcattaaggatcttgtaatggggagattatcctggattatctgtatgggcccaatgtgatcacaaaggtccttataagagggagatgagaggccgggcgcagtgactcacacctgtaatctcagcacttagggaggctgaggagggtagatcacgaggtcaggagttcgagaccagcctggtcaagatgatgaaaccctgtctctactaaaaatacaaaatgtagccgggtgtagtggtgggtgcctgtaatcccagcctctcagggggctgaggcaggagaatggcttgaacccaggaggtggaggttgcagtgagccaagattgcaccactgcactctagcctgggcaacagggcaagactcaatctcaaaaaaaaaaaaaaaaagagggagacaggagtcagagtcagagagatttgaagatgctgcgatgcaagctttgaagatggaagaaggggccacaaaccaaggagtgctggaagcctctagcggtggaaaaggtgagtaaacagattcttctctagagcctccagaaggaccacagaccagctgacaccttgactttagcccagtaaaacctattttaaacttccgatctccagaactgcaagataatatatttgtgctatcttcagcctgaatttgtggtaatttgtcacgcagcaataagaaactaatacagggcctgaggaaaatctgtgtccccttgccaagggagtgctgtgagggcgtcactatagggtcttcaggcaagagaaagtgacttcctcacagaggggaggaggggctacttctgctggcaaggaaagctctgcgggatttggaggttcaaagtttttcagactcatcaaaatctacccaggtgtctccactccaattctgggcttccgttaacaaatattccaaatgtcacacacgagactggcaaagatataaatgcaagttgaatataattctccaatctgcagaatcaaactgtgggtctggttttttcatacatagtccctgtggctttgagagataagcatgtcttttagaatattcagagaaagctctgtgttcgctggcaatgccttgactgaggatgcagcagaggggtcatttttttcctgtaatctcccagtgcagccacccacagtcccggcagtcaacactcccagcttcacgatctgtcacagcgaccacctgggctcccggcccttcccttcaacaattgctttattccaggcaccaccacaggtgataacttaagtcactttttctatcttttgctgtgtaatacaaagacttcattttatactagcatgaggtcgcccctgccctcaagcctaatgggtcagggaaccaatcccagattgccacctttgaacgtcaattttctgaaacctcttgttataccaaatactgtaacagtcagagttcacttatgaaaacagaaaccactttggatatttcaagcataaaaggatttagtacaagaagtagatgtttataaaaccactcgaaaaggtggtgtgccgcccattgcttcccattctatacacagtgattcacgctggtcacacgcagtcagctctggcgggtgcatttgcaccacgagaagtgagttgttaaacatttaccagcacacacgctgcaggggacctaaggagagtgatggcactggaaagaggaatgctcctgcttctaatcctccttgatagaggcgctccccttttgtttttgaagaatttatagaagcttttccaccggggagcttcagctaggtcttctcatcagtgctgtgtgccagacaagccagatgatcaaggaagtacctacactttggacactgtcagtttgcctggggactgagagcttacagtccaagcttgcttcaactctggctgaggccaacagagagagcccaaagacaactgaaggagcggcagaaaacaaatatgggaacggggtaattggcttccagttccttcattcgcaggtcatgaaaaaaacctggggctagactccatgagagtttttttgttttctgttttgtttgtttgtctgtttgtttgtttgagactgagtctcgctctgtcacccaggctggagtgcagtggcgcgatctcggctcactacaagctccgcttcccaggttcacgccattctcctgcctcagcctcccgagtagctgggactacaggcgcccgccaccacgccctgctaattgttttgtatttttcgtagagacagggtttcactgtgttagccaggatggtctcgatctcctgaccttgtgatccacccgcctcagcctcccaaagtgctgggattacaggcgcgagccaccgtgcccggcctgttttctgtttttttgagacagggtcttgctctgttgcccaggcccttgaactattccacttcccactcctccccaggcccttcctaatgggactaagtcatcctccaccctcacctaccttctggctgctgtaccctcctctctaagcttggggattctgccactgctcacagctggaagaacaacagcctacatgtccaggccttgcccagtccagatgatgctttaaaggccttcttcttcttcctttttttttttttttttttttgagatggagtctcactctgttgcccaggctggagtgcaatggcgtggtctcagctcactgcaacctctgcctcctgggctcaagcgattctcccgcctcagcctcccaagcaactgggactacaggcatgtgccaccacaccaagctaatttttgtatttttagtagtgatggcgtttcactatgttggccaggctggtctcgaactactgacctcgtaatctgcctatcttggcctcccaaagttctgggattacaggcatgagccactgtacccgccctaaaggccttctttgaaagagaaaaagaagaggtggcattctgtgaaggaacatcaaggaccagacatccagcttcccctgcagcccaggtccccctagcggtgcttctcttcagattgaggacctattctttggagttccgaattcctagtagtccagccctcagatctccaccttgagactccaccctcaagattctcattttctgcctttcccttctaaggcttaatcccatcgggactaagggaggagccttcccttccagcctcacacaggcagactatctcaaaagaaagagaaagcaattttcccttgcatgctggctgtttcacttccttctacttttaggaaatggtgagtgattttgtttaaaagagaataatcttggagtttgagtagagtttggggaaagtgttgacaacttctgggacacacactctgtccttgttgcccccattctcttcaaggcaggagggatgattattttgcttctttctctccaatgcaacccagcatctgtcctccgttctgttctcagtggcaactcttctgcccagaagatggacctatttactctataatacatcattcccagatataggcgcattagagttggaagagaacttgaattagtgtctgaccacccgtaataggcagggatctatttccagcgtctctgacagcagtcatctagcctctaattaaacacttcatgagacattgctgttccacactcacgcagatttaattctctctagaatctgccccagcatggctttgactcttgtgttttatgcccctgaccaacacaaaaccagtctattccctctccacaggccagcttttcatctcaacttctcacttagtttctctcttggctctgaccctaacctaaggcatcgacacacagttttgggattcttccctcaaatctaaattggcaatccttatgttagtccagacaacaccaaggcaagaacatatgtggagggtgaagggcagcacctacatccagggagagaacagggccatcgatgaggagagggtctatagggatctgggaggtcaagggcttggttgttaatgggatggaaaatcagaacagggtagaaaataggcatgacagggaaagaagctcagtctcaccttaactctaactgatccaacaagaaagctgagccactttcctgaatcccagaagatcttatttcttcaagctgacatgactgattctttactagtccatgtgtcaagaccatctggggtcccttaaaccagtggctcccaaactattttttttttttgagacagagtcttgctccgtcgcccaggctggagtgcagtggcgtgctctcagctcattgcaacctccaccttccaggctcaagcgattctcgtgcctcaacctcccgagtagctgggattacaggtgtgcaccaccatgcttgtctaatttttttgtatgtgtagtagagacagggtttctccatgttgtccaggctggtcgagactcctggcctcaagtgatcctcctgtcttggcctcccaaagtgctgggattacaggtgtgagccactgcgcccagccccaaacttttgtgttcagaagaattacccgatgtagtaaaaatgcacatcatggtcccctcccaaaccgattccgcttgattatctgccccctagaggaagggcacaatactgtttggagaggagcttgatgggccttcaacttttctcttacgttctttagtcggagagtatcatgaatagttaaaagaataacaccatcccctgtaaaccctggtcttgtaactcccccatacctgggatatggaataatgcatgggttaagggctttaggggctggctctggggtcagactgccttgatttaaatcgttgttccactacctactaactgtctgacctggaactagctgcttaacttctctaaacctcaatttacctatctataaaatgggggtaatattagtttctatctcaaggaggtattgtaaggattttagtactaatttatatgtggcacttagcacagtgcctggaatatagtgagcattcttaaatgacagccactattattatcactagtattactcatagtagcggtagtggtgaacaaaaccaaatttccagtggagccaaccagccaccctttcttaaccagctgtaacttccagtgaaatcaccacgatcatccccccagattaaccccaccttccagtggaatcactgtgaccacccctccaggatcaaccacaccatccagcgaaattactgtgaacactgccctggaccaaccacaccttccagtggaatcaccatgaccacccctccaggatcaaccacattatccagcagaatcaccgtgaccacgctccctggaccaaccacacctcccagtggaatcactacaacccccctgccctgggtccactatatcttccagtggaactaacacaacaaccgcaacctccagtgtcaccagcacaagtgcagcccctccagggaatgagggaaggtctaatggatgcctgaggctgtgggaagtcatcctagtcactctggccttggttgcaatggctgtgattctcttcacagggctcttttatttcatgagtgcctgatgtgtgggaaatcctttttctgagggagggagtgcagggaactgaggagggaagcagggtagagagagtagggtcattgtgtggctaatagggaatgagaaatcaggagagggacaaagcaagacagagacagcaggtgagaaccagcaagagagagggctagaaaagctggtacatgttcagaggaaattgatgaggagagaaggggccaaaggagtactgaggctggggaggccgaatggggagtggggacacgtgggatgggagagcactggaagaggggcataactctgaaccatccatccttttgttttctagagaaactctctgtgcctaagaaacctcttcaccaaagatcttcacatcccaaaccttggtccatgtcctcaaggatatcatggagtccaagatgggtcaagtgagactgaaacggattttagagaccagtgttctcccacaggcatggagctgatgaggagacacagtgtccctaaaggcaggcacttcactgtcctcagggtggggaggaccagcggtctcggttttcctcacttgcccccagggctgctcctcccagctctgctccagcccctgacactcctaccttctgtttagttctcccagacctgaaacaggaggctatcgctagtgctgaatgattaaataagtgcatctgctctatgtgacagccagactgtgggtgtgtgcttgtatattgctgtgaagagaggtttcctatatcatgaggacactctttcgctgtgacctcccagttctcaaatcctagcatgaaatccagagacctcacatctgtcccattttcttccccactccttccctgctccccgaggcctctgggtcgatggaagaacggagtcaggagagatgggggaaggcaggtgctggtctttacagacgtgtgttgcatggcaggaaaacagcctctgcgtgagcctagaacatgaactggaggaaagtgatcctgttttcatgttgtgaggtaggaaagagcttgctactggggccacccttagacatggccacttttcctggccactcacgtctgctctgggctgcaggtgtgagttgccacctttctctcctgtgggctcccagcccagcaactgtcctgggcagggagaatgtgctcccagtttttgcaagggcaggactggcttgccctgctacggtctagatcctcagcagctcccccaaaaccaggcctcagagggcacacatgccagtgtcagcaccatgctcaggcctggtcccacccaggcttctggtgcaacttgctctcgcactcgcacacgcaccccactgattcttcctccctgtgaatcactcgcctctgctttatcagtttcaccctctgctaagtctcttcagcttctgggattctcctgggtctttgggagagccttaacaggaccaagctgtttctctaagaacattttacaatatgatgaacaaaactgtttttaggctgggtgcggtggctcatgatgcctgtaatcttagcattttgggaggctgaggcgggcggatcgcctgaggtcaggagttcaaaaccagccctgccaacatggcaaaaccccgtctctactaaaaatacaaaaattagccgggtgtggtggcacatgcctgtagtttcagctactcgggaagctgaggtgggaggattgcttgaacctgggaggcggaggttgcagtgagcagagattgcgctactgcactccactgtgggcaacagagaaagactctgtctccaaaacaaaacaaacaaaaaacataacaacaacaacaaaatctatttttaacagatgcaagagagtatctactgtacaatttatttgcatgaaattcaacaataggcaaaactaatctatggtggcagagatcagatctcctatgagggtgagggtttttaggaagggggcactttctgggtgataggaatgttttctatatcaactggtctgttggttacacaggtaaatacacttgtcaaaactcagctaacagctgggtgtggtggctgacgcttgtaattccagcactttgggaggctgaggtgaaaggattgcttcagcccaagagtttgagaccagcctgggcaacatggcaagacctcatctctacaaaacatacaaatattagtcgggtatagtaatgcacacctgtagttctagctacttgggaggctgaggtgggatgattgcttgagcccaggaggtcaaggctgcagtgagccgtgatggtgccactgcactccaacccgggcaacagagtgagaccctgtctcaaaaaaacaaaacaaaacaagaaacctccactaactgaattcttaagatctgtgcatttcactttttgtaaattttacctcaataggaagaaaaaatgtatattcgggttttttattttgggattttttaatttttatttttatattagggttttaaaataataccttgaagatatttatcagtgtatccattatctcctcttcagttttaagagcccccagaccttttcgtaaaataattatcatcttttgcactcattttttcattcattcattcaccatatttactggacacctgcttggcatgaggtctcaaggagctggggcagctaggatgaccctgtaggtcacagttgggtgagggaggtacataagttacaggccaacgcatcaagtagtatgaatggaagcaccacaggaggaaacatctaacttgatgaggggaggagaggctgactcacatagaaggtgacatttggattttgaggagttagcaggcatttacgaggagcagaagaggaaatgccaggcaagcaagcagcttgtgcaagactgggcatggcacggccagtgaaggtcagaagacctgtggggctggagagcacagcagagggagctggggctgggggctaatgcgtggctttgaacaccactccaaggaggccagatttcatcctttaacagcacaaagcccacagatcactttaaggtgtagtgggacacaattttttccccaataagaacacttcaatcagctgagtgagtagaaaatagaggctggaaaccagcaaaaatggtgttgtaatgcccctgcaaagaaagaagcaaatagacaaatctaagaccacaaaacatggaaatgggaaagaagaaaagaagtggaggctgggcacagtagctcatgcctgtaatcctaacactttgggaggccaaagtgggaaaactgtttgagcccaggagtttgagaccagcctgggcaacagagtgaggtcctgtctctacaaaaagttaaaaagattagccaggtgtggtggtgcacacctgtagtcccagctgaggtgggaggataacttgagcccagggggtcaagccttcactgagctgtgattgcgccactcactccagcctgggtaacagagtgagaccctgtctcaaaaaaaaaaaaaaaaaaaaaaacgaaaacgagaagaaatgtgaatttcaagagatttctgcctagcacttttttaaaaatccccaactccagaatttatggtgacttttgttaaaagtcctgttttagggaggtcttcatctaacgagctctaggcaattttcttaaaactaattcatcaaatgactaattctttgaatttttaaattttgtttaaatcctattcagtgtgattccctcctgctgcaggctggaggctgggagacagagggagactggggaatgtcttcttgatttatagcatgttttctagttaagaaaatactcaagataaatatatttatttataacaattttcacatgaaagactttattcaaaaatatgtgcaagaaaaaattatttattcttgactctgatgaataattgcaaatatgattcctatgaatagtatataaattatatctaaaactataaggctacagactatacgattcccttcatatgacattctgaaaatggcaaaattatagggaaagaaacaagatccatgttgccagggtttgggaagtgggagaagggttggctctaaaggaacggcatggggggagattgaggaggatgaagggattcagtgcgccgaatatgtgactctaccatttatcaaaatccatagaactgtacactacaaaaagtgatttttagggtatggaaattcagcaaatcaaccaggatgtggagggaaagatggaaagcagactctgacaaatgactcatgtaagcacagtgaaacggatggagaagaaggagctggcctaagtaactttgaaaaactgttttgagtcaggcatggtggctcatgcctgtaatcctaccactttgggaggccaaggcaggaggcttgtttgagtccaggagcttgagatcagcctcagcaacacagcgagaaccccgcctctacaaaaagttaaaaaaattagctgggcatgatggtgtgcctgtagtcctagctgctcaggaggctaggatggagggatcgcttgagtccaggagatcaaggctgcagtgctactgcaccccagactgggtgacagagcaagaccctgtctcaaatttaaaaaagaaaaagaaaagaaaaactgtgttttgaccataaagctaaagacaaaaaaaaaaaaaaatacagaaacactgtactgtagttggtaaatgtgtttctggcaagggtatgaattagcagttctgaaaccactatttgtttattagggttgaaaaaataagtaaaaaaatatgtttatagacattcgtagccatgtcagagaaaggagttacaaataaagaaaagggagagactagaatgaaccccatgttgctggattaaagctggaggtgtcaaaatgcacccatgcttgtgtttaaaacacaggttgagcaaccctcatctgaaaatccaaaatgctccaaaatccaaaacttgctgagcaccaacatgacaccacaagtcaacatacacaaactttgtttcatgcacaaaattatttaaaatatcacgtaaagttaccttcaggctacatgtataagatatatataaaacataaacaaatttcatgtttagacttgggtctcatccacaagatatctcattgtgtatatacaaatatttcgaaatccaagaaattgaaaatccaaaacacttacggtctcaaacatttcagataagggattcaatctgtatatgcagacaggtaattgcagaaataaatacagacctgtgtttatgcatgagttagtttacatacatacgtttcctagctctaacttccgtgggggcaagaagcagtgacacccactatgaatgagcacacctagtacccaaatcttggtttctaaatattattctctaatacaaagaggagccagagctctgtggagaaatagttgattccagggcctggatggacaaaataaaaaatgagcatgaagcatcttgtaataccagaatgcaagaaagtgttttaaaaagggatggagagggccatgcacagtgtctcatgcctgtaatcccagcactttgggaggcccaggcctggggatcacctgaggttcgtgagttggagaccagcctgaccaacttggagaaaactctccctactaaaataatacagaattagttgggcatggtggtgcatgcctgtaatcccagctacttgggaggctgaggcaggagaatcacttgaacccaggaagcagaggttgcagtgagccgagattgcaccattgcgctccagtctaggcaacgagaacgaaattccatctcacacaaaaaaaacaaaaaaacaaaataccacggatggagaggctgggcacagtggcttgagcctgtaatcccagcactttgggaggccaagacaagtggattgcttgagcccaggagtttaagaccagcctgagcaatatgacaaaactttgtctctacaaaaaaaaaaaaagttagctgggtgtggtggcgcacacctgttgtcccagctacttggaaggctgtggtgggaggattagttgagctcaggatacggagattacagtgagccaatattgcaccactgcactctagcatgggcaacaaagtgagaccctgtctcaaaaaacaaaacaaaatagcaatggagatatcagctgggtgtgctggtgcatgcctgtagtcctagctacttgtaggaggctgaggcaggaggatcccttgagcccaggagtttgaggctgtatgatgatgccactgcaattcagcctaggaaacgcagtgaagtcttgtctcataaataaaacaaaacaaaaaaaggatggaggacattaaaacggcactggagcccatctgaaagagctcccagtggccaaagtttgagcaacaaaataaatagtgatagtattggatcataactcacagaacaaaataaacatttatgagtccattctgatataaacaaatagttgaataaataaaatggggagagggcacgactttttcttacagaagaatttcaattaataaatgtagaaggaatctaatctatcaccattaggattacacacctgtaatcccgggtgctcgggaggctgaggcaggagaattacttgaacctgggaggggaaggttgctgtgggctgagatcgtgccattgcactccagcctgggcagcaagagtgaaactctgtctcaaaaaaatatatatagtattgtaccaacaataacttcttagcttctataattgtatatataatctctcagtttctataattgtactatgtaagatattgacatgaggaaaagctaggggaaaaatatacgggaactctgttaattatttttgtaattctctgtaagtctaaaattatctcaaaatgaagttttaaaaattctaaaacaaagccaaaccaaaaaaattctattgacctgtacatgaaaaagggtgaattttatcatatgcaaattatacctcttgacttagaaaatcagatattttccttactatactcttttgaaatctattcattagttatactaaatacatacaaattcttttgagtgtgtttaaatactatgtttgaaaatgttgctgggtgatgtggctcacacctgtaatcccagcactttgggaggctgatgagggaggatctcttgagctcaggagttcgagaccagcctgggcaacatagtgagaccttgtctctactaaaaataaaaaaacaatcagctgggcatggtggtgcatgcatatagtcccagctactccggaggctgaggtggaaggatcacttgagcctgggagatcgaggctgcagtgagccgtgatagcaccactgcactccaacctgggcaatacagcaagaccctgtcaaaaagaaagaaagagagagaaagagaaagagaaagaaggaaagaaagaaagaaagaaagaaagaaagaaagaaagaaagaaagaaaggaaggaaggaaggaaggaaaagagaaaatatttaatacattcaaataatactagtagttaacatagtcagttacatgtggtaaactagccattcattaaattgattttcaggaaatcagctgccttctaagagaggaacaattcccggcccacctgcaatttcacactcctcttttagttagaaggacactgggaaagagagaggccccacaaatggtgagagacatctctgaatgaagatgggaaccaacaatgatcttctaaagagtgggcaaggcagggataagggtcagagaaggaggaaaagatgtgggtattctcattcaggcctgacctcaccacaagtggactaattttgtgcagtgatatggcttggctctgtccccacagaaatctcaacttgaattgtagctcccacaattcccctcatgctgtggggagtttttctcttttcgccaatcatctttctcttgctattctcatgactgtgaataagtctcatgagatttgatgggtttatcaggggtttccgcttttgcttctttctcattttctcttgccgccactgtgtaagaagtgccttttgtctccctccgtgattctgaggcctccccagccatgtggaactgtaagtccaattaaacttctttttcttcccagtcttgggtatgtctttatcagcagcgtgaaaacagactaatacatgcagtaattgagaaagctcactggggtgagggcactcgagcagggggagcaaggagagagatccgtgggctggagagaagccaaggaagaggatttgggtggatgattgagcaaagagtgaggttttaagagacagagagattgggtgttttagccccctcatgagtgttcctctccttctgttggaggaccttctcttggtccttaccaaatgtcctctaccctctgacacccagctctcctcctgccaagcatcatcccccaggcaggcctggcctatgccctccttggtcatcctgactttactgtggccacctgtgggaaggaaggccgaggccctccctgagcactgaaacaccgggtggaggatggttttcaactaggctccacatcagaaagcagtgcactcacgctgacaggcttgatcccctgtggctgctcgactctgggctctggtccaaagctgagagccccccttcccctcatgacagcctcttctgccctgcccggccactcctttgagtgacagggggtaattgagaagctgctcctccctccaggaaggaagacccggagctctggcttccctcggcaaagcacatataaacccacagccactgcgggtggaaggagaagggcagggtggaaaaagtttgagagaaggagggaggaaaaggtgtcctggctagcaccatgtggattctcttgagatgagaagaaaatgccccgctacgtcccccttctgctgctcctgcttctcctgaggtgttcagaacggggtggaggagttaattttggtgagaaggatgcaaaagtccccgggacctggagagatggagtcagggtccctggagaaggagcctcttgggactcagacagggccagtcccgagcgaaggtacggaataggtgagtgaaccttgggaactccggaccctgttatctaccctcaatcacctgccacagggaagcagggaccccagcgtctttctcatatccccttttaaggaaatgctctgcttttgattttgtgcattttatttaagtttctttgtttcaactttcctggagaaatgaaaaatttggcactcctctaatcccagcgctttgggaggatgagaaggagtgggatcccttgagcccaggagtttgagacaagcctgggcgacatagtgagacaccatctctacaaaaaccaaaaaaatcagccaggcgtggtagcccatgcctgtagtctaatctactcgggaggctgaggtgggaggatcacttgaggccaggaggccaaggctgcattgagccatgattgtgctactgaactctagcctgaatcacagaacaagaccctgtgtcaaaagagagaaagaaaaagagaaagaaaagaaagaaacggtcaggtgcagtggctcatgcctgtaatcttagcactttgggaggctgaggcgggtgggtcatctgaggtcaggtgtttgagaccagcctggccagcatggtgaaacccagtctctagtaaaaatacaaaaattagctgggtctggtggcgcacgcctgtaatcccaaatacttgagaagctgaggcaggagaatcgcttgaacctgggaggtggaggttgcagtgagtggagatcgcgctattgcattccagcctggatgacagagggagactccgtctcaaagaaaaaaaaaaaaaagagagagagagagggaaaggaaggaaggaaggaaggaaggaagacttgaaccctattagaaaaatgtggagcgtcagcagtagggagggatgactagatttgggcagagtaccaaaagttcaaaatttatgccatgtaagctacatgtattcctaagaataagaatactcccaagtcctgacggctgcctggggcagtgagggctggagacgaagaggactcatctcttctttgtacttatacctgactcagtgttgccctcagtccaactagatcacacccacacccctcatgactcctcccctaagcctgcccccataccaccttgaatcttccctgcctccaagcctaccacgttagccccagatctgacccagaagctgtctcatgctttttttttccttttttgagatggagcacctggccagctgtctcattttaaatcatataccaagcatgacctgagtgtaatctctaacatgaatcacagcttctgcctcattggtttgccagaaccgcaggcacaaatggatgagaggagacacctatgaacatggagccagaataccccaattgctgaaacaccagttcagagaggagtgagcttgagaaagagtcaggtttagtgtcccacggaaagagaccagacctggaaaagacagagtcaaagctgggtgagcaggccttcgaagggcgtggctcagcaaagataatccatattgtagtgcaagaggattcttgtggaatatgttttaccagaattaaaccaaaaatgccaaatgatccctaactggaataaatctcaccacattacctggggagaggtgtcatttggatgtgaggatagttatgaaaatactgagcagagcagatgaggataggccatcaacaattcacattaaatgagattactttttagtaggactaagccaaagcatttccactaagcacccagagaccagccctaaagactcaagaataagagaaaatgatgtaactgcagatggaaggaccactgaggaccacatcactgcagacccagggaccaccgaggactctgtcactgcagacccagggaccactgaggacaatgtgactgtggacccagggaccaccgagggctctgtcactgcagacccagcgaccaccaaggactatgtgtctgcagacccagggaccaccaaggattctgtcactgcagacccagggaccactcactgagaactttgtcactgcagacccagggaccaccaaggactccatcactgcagacccaaggaccacagaggactccgtcactgcagacccagggaccaccaaacactccatcactgtagacccagggaccactgaggactctgtcactgcagacccagggaccaccaaacactccatcactgcagacccagggaccaccgaggactccgtcactgcagacccagggaccacagaagatgaaaccactaaacatggtgacactcaccttctgtgaactacttcagtcacagcagtgaaacccaccaggctcctgacacccatgggaattatcctcatatccctggctgcaaccacagtcactgttgtgctctttgttggattgggcttcattgtggtgagtatttggtctgggaatattcagggcatcaggggaacgaggccaactgaggataagcggtgggcatggagagctgaggtacagaggcccaagaaatcgtcaggcgtgaggaagcctacatagagagagctctgcaaagactcctggaaagacagaggtggagagaaaggaaaagagcacctggcacaaaagatgcagaaagcattggggacagaggaagctgtgagagacaggaaggagagaaagggaagagaggctgagagtgagaaacataagaacacaaacatggtaagacacagcgggagtcagggcaaagcatgaaccgttaggtacagatggatgtaaaagaggaaattttcctaagaagacaaggaactggggaccagaggagtggatgaattagaaacattctgggtggtccactcatatcagaaattacatattcttgtgttaattactacctactctgaagttctgaagaagatttttttaaaaccaaaattgagtgggtttttatgagccaccactaccctgcaccaaagagacagtttgtaccagctctcaaagaggagctctgggtatttttctgtctctgagggtccctgttgtttctacaagaggagacaaaagaattccatgccagccctgcatgtttcatctcaccaaactcccagctggaatcatcccaaaagcagcagcagggaaattcccacagggagtggcccaaaccctccagagatggggccaattgggattccaaagaaagaagcccagatgtcagggtgatcaattcaaagcatttattaggggaacttacagaggactgcagcaatcctccctgccgacagggagggaaaagggatgttctgcctaagcatgtctgtagcaagggggtcagggtatggagtttatatgagggtttagggaatttgactcagggctggagccagtttctttcaacgttttgggcaacaacctagatacctttattagtgcctgggagtgttcaaggccctggtttgcgttcaagcctgctggggaaaacctgcagctggctgggtcacagaacggtcaaggcaatctgtgatttttggtcagtctgatcagaaagaaaaggaggtgatctgggggaccccacattgtggcttcctctcgctaacatttgatctaaaacccaagcctcctgcttctggcctgctgcttgagggggaagggctggtcctttttggccatcctgacctacggattaagtgcatgtcgaaattttaacaagtggcggcttgcaggattagccaactcgggcaggtcattaaagcctcgttaattcttgcggtcattgatgccattgtgcactgacccctgctccaagatgcaaatccacagctttggatcagtttgtaagtgtgagtaaagccgaaagtaatgcatgatacagatgaggtgttcacatttaattctgctaaaatgacaccatgaaactagagcattctgaaggatgctgacaagaggaaaatggaatgaaagcgtccatatgtacctgactcatgcatgagtcatgttcagtattcaccagtagagggaggaccttctggacttcgctgttaccataaacaattggatttctgatcatgtggatcaccatgaaaagttggacactcttgctctagaacaaaagatgctttccttcctccaaaccaggcattggcccagagaggtcactagcattagcaccttcttaatttcatgtagagactaaaaacaagagatggctcaaaaggctcagggtgtgggaagtaagaggaaagtctatgctcccaaacttgctaaatttttgacttttaaacctttaactcgaaaagttttaaaaataagaactatattaccattcctcccaagtttcatttgtcaaaatgcttttttctttaaactttaatggtttaagttttttttaagttgttttaaaaaaaacaaaaaaggtttaagttttttttggcagggtgcggtggctcacgcctgtaatcccagcactttgggaggccgaggtgggtggatcacgaggtcaggactttaaggccagcctggccaatatggtgaaaccccatctctactaaaactacaaaaaagttagccagccatagtggtgggcacctgtaatcccagctacttgagagactgaggcagagaattgcttgaacccgggaggcagaggttgcagtgagctgagatcgtgccattgcactccagcgtgggcaacagagcgagactccatctaaaaaaaaaaaaaaacaaaaggcttttttttccccctaaatgtcgtccacatttttggcaagtattgatctctagtagtcagtgtcaggatctgaagaaaacagtgacatctagcagactcccagagccagggaaacaggctgggcagaagtgataaattacaaaccaccagggttaagagaagaacagagtgttaaaaccaaaccattttcttcctccctagaaagagtgtttcctgcctccattaaatccatccaccagggttatttatcatccccatgtcatggactacagtacaccataaagaggaccccagcagtgactacagttggttctagaaaaaggagacccctcatccgcctctgcaagactatacagcatgatgtgtatcctcaggcctccactcctccgccctagtctggagccctgggaccaccacatgaggaaggcagctggcccctggaataagcatgtggaggacactcagaaggatgcccatctgctctgagtgtctcctaattctgcctgaccttggttacttcctctggacaatcgcctttacctatctaccaggttttgaggaattacacacagctcaggtataagagatattcggtaagtctgatcaaatcaataaagcaaattttatctgtttttgtctgggacatatctctacattcattcatttaaccaaaaaaaaaaaaaatgttttttttgagacgaagttttgctcttttgccccggctggagtgaagtggcgcgatctcagctcactgcaacctctgccccccaggttcaagtgattctcctgcctcagcctccctagtagctgggattacaggcgcatgccaccacgcctggctaatttttgtatttatagtagagacaagggtttcaccatgttggccaggctggtcccgaactcttgacctcaggtgatccacccgccttggcctcccaaagtgctaggattacaggcatgagccaccgcacctggccttaacaaaatatttattcagtgcctagcatgagctcaacactctacgtctcccagtctgtctatctcagtctacctgtaagctgaaggatacaacttatctcttaagaggactatgcccgcgttctcctaccacccaggccaaagggtcacatttacaggatgtagtcaactggtcattcagcaagtatgtatgagcacctgtgtgggactggccaccgtagcaaataaatgagtctcatcttagtcaatcgcggtgtgaaatgaggacacgaagtccagacctaacctctaagagaaaagccctgcctgatagaagaagagatttgtccttacttaatgcaaatgcaccatattcatgcacctatgaatgatggctaagaccacagacaaggccggggcattggatataacagctctgtgaggagctcaggacaaaaaccaaagaatcaaagatatgtgaagacagttgattattgtttgctcactactgatgccactatgagcagcatcaccaccagtgttaaataatggaattgtagtattatgatacagagtcggaaacacggaataataaattaaaatactaaagtgaaaaaattggattgattaaataaatattaaaccaatatttctcagacttatgtgataaacacctttaaaggaaaagatacatatatatttttgagacagagtctcattctgttgcccaggttggagtccagtggtgcgatcttggctcactgcaacctccacttcctgggttcaagcgattctccttcctcagcctccgagtagctgggattacaggcgtgcaccaccatgcctggctaatttttgtatttttagtagagatggagtttcaccatgttgcccaggctggtcttgaactcctgacctcaggtgatccacccgccttggcctcccaaagtgctgggattacagtgtgggccaccgtgcctggctggaaaagagattttttgagaactcgccatgttggcttaaacgtaaatatatatgaaacagaaaatgaagtataaactccttatgcttatagctctactgttccaataacgttagaagtaacagcagtagtttaatgtaatgcatgatatttctttactgaagaattcttcgctccaacattaatattgtagtgattgctacagcctagtttctcaaatctcatttgccacttgatgttttccttctttcatggatcgtctctgtacaagctctctcaagaccttcagtctctcagtcagctgcgggattattgggcccttaatgcaaatgcaccgtttaaattttaagacagttctcgttctactcttgttaggctgtgcaattgtaaagactaatcatttctattagctttatgttggttttatattggtcatcaatagaatccaggaaatgcttatattatggggattttcaagattattacctgaaggaaaacgtgacagaaacagctctagtctccccttcccttacacttggagaacctgagttttgggggtgatggtaatgtgcccagctgaagaaaaccatttcccaaatccccaatttcccggtcccccttgcagccagtgcagtgaggagatacagctctggccaatgtgataaaggcataagttcctggggatggtgtcccttccagatgaaaaggccaaagctcatgaggagaaagccctttgccccttccccttcgttcctcttcctacctggaatgcagatatgagacctggggctcagcaatgctgaggtcagggggagacccacagcagggtgaaggcttcaagctgagagtggagcagagggaagaaatcacttgggtgcccgatggcaatactgagccctgggctgctcctctcggacatttcgtatatgagatgagcagtgtgccggagctcagtgaggtgagcttcttgtgattccagctaaatgggatcctaaatgatatgacacataaacatcatctagaacatgcagacttctgcgaatatctccatgacacatttgggaagacacagtgctcaggattttaagaatgtgggagctacacatagtggggaatgggagaataataaaatgatctccctcttctgcccccatggaggcagcaagtggccaagggagaattttgtgattagagatacttgcatgaatatcagtttattgcaggaaaaaagagtgacagaagagtctcttggttaatatacaggcaggaaaagtccaatgtgtttctataaaatcttcctcctgaagttcaggctggggtttggggctgggcatttgtcaaagggtattggcaagcacaaggaattccagaatctgccttggtcttcaagggggcagaacttttggtctcggtacaagctaggtttgtgcaataaacaaaggaattgctagagctacaaattctagctgagaagtctgtgtgcttgagtttctgcacctcaaggacaacttagagcaattgaagagaccatgaaatctctgtaaatggcatagaaactttagcatgcaaaagcatgcatgcaaaaacgctagcatatcaaaagcttttcttttctttcaatcaagttaatttctggccaggcaggatgacacacctgtaatcgcagcactttggcagaccgaggtaggaagatcacttgagctcagaagatctacaccagcctgggcaacatggtgagaccttgtctctactaaaaataaaaaaaaaattagccgagtgtggtggcacatgcctgtaggctcagatacttgggaggctaaggcaagaggctcgcttgagcccaggaggtggaggctgcagtgagccatgactgtgccactgtactccagcccgggcgacagagcaagatcctgtctcaaaaaaaaaagaaaaaaagaaagaaagaaagaaaaaggctgggcacagtggctcacgcttgtaatcccaacactttgggaggctgaggcaggaggattgcttgaggcctggagttcaagaccagcctgggcaacatagtgagacctcgtctctacaaaaaaattaaaaattagctgggtatggtagtgtatgcctgtagtcccagctacttgggaggctgaggtgagaggattgcttgagcccaggaggtcgaggcagcagtgagctgtgatcatgtcactgccctccatcttgggcaacagagagagaccttgtctcgaagagaaaaataaaagaaagaaaatgttaatttctgctcctgtcagattagagggaaattcaatctcagtctttttgctgctctccaaagatcccagagttgtacataggattgaagcataaggaacatccttaaagtcagtagcaactggcctgtactaattattcccaggatacgcatatccctttgtggcagcagttctgccagaggcacaggggctttacccagtcagtctccttcaacttgccacgtagctttctccagaataagtccaccccctcagggtgctaccgtgaaggagagtatggttttggcatttgagagcccagagagatatacatgaagatctggtctctggagagtattgaaggtagaaaagacaaggagaagatgctgcagaacacccataagggaagaaaaaaaaaatgaagcctcaatgaataagggaaatacctttctaaccactcctgggacctgaactacaagatttggtagttgactctcaaaccataatatactcatactcagatgacacttataagttgtcgcacatatctgtgcattccatgcctttggtaaatgcatacagttaatcatacagctaatcctccttttctctttatgaagtccagtgtttaaaggacctcttcaggtgtcatcaaggagtcataccaggtccagctgaacccaacttgcacaagtccagattgaggacaccaggcaagtaagcacacccctctagattgtgcctgaacaggatttatgccttttggggagtgtcacctctcattaaaacgtctgcgaatgcacactctggtccagtcccctgtctttctaaacaagaatgtttggtgaagcaacagtgattcaacactctcccttagcgaggtattgtttgacaccttagaaaacacgtagttatttttcagatctattcaggacctttcttgtgattcatctaaaacaaacccctctcttcagtctctacagattaccatatttattttctttatggagctgacgacaatctgaacttatgcttatttacgtgttaacttatttgttttatgtctgtctccttccactagaatgtcagttccttgagaataggggttttgaggacaatatatgagatagattagatatttaataatcatatgcttcattgagcctctgatgcacatcttccccattggatcgtaatctaaaattgagatgtcggatgggcgtagtggctcacacctgtaaacccagcactttgggaggctgaggcaggtggatcacttgacgtcaggagttggagaccagcctggccaacatagtgaaaccccgtctctactaaaaatacaaaaattagctgggcgctggtggcacacacctgtagtcccagctactcaggaggctgaggcaagagaatcacttgaacctgggaggtggaggttgcagtgagccgagattgcaccactgcactccagcctgggtgacagagtgagatgctgtcttaaaaaaataataataaaaataaaatggagatgtccactggctgcagtggttcaggcctgtaatcccaggacttttggaggacaaggtgggaggattgcccagagctaggagttagagacctgcctgggcaacatcgcaagacactgcctaaaaaaaaaaaccaagaaacgtttaaaaatggaaaagtgtcttacacttgatagcacatcatgaaccagtcagtagcactctttcttccttagtggggcataagtaatgctgcatcttgcattcaacgtcatcttagatgggatgaaatacacattttggaataaacgaataaatgtatgctttcttttggtgctatttcttctgttttggtcttatttgtaaacacaaggaaattaggattcctttttttttttttttgagacagagtctcactctgtcacccaggctggattgcaatggtgtggtctcagctcactgcaacctccgcctcccaggctcaagcaattctcctgcctcagcctcctgagtagctgggactataggcgcgtgccaccacacccggctaatttttgtatttttagtagagacagggtttcactatgatggccaggctgatctcgaactcctgaccttgtgatccacccaccttggcctcccagagtgctgggattacaggtatgagccactgcacctggcctaggattcctttagtaactgtctagtatggtgctgggaattcttttgggaacagaggcagccaaccaacagaagtgaatgacatagttcttaccctcaaggacaagaaaaccagcaattacagtgcaacatgctaagtgctacaataaaggaatgctttcgggcagagtccagagaagggatctcattcagcctgtgcagatcctggaaagcttcccaagggatagggtaactgaccggagacttgtgacatatttgtggggcactttgagctgctgtcacatatgtggattcttttgatcttcacatcacctctgtgaggtaggagaaccatcctgtcttagaaatgcaaagactgaagttcagagaagttaaataaattgtccccaaacctccttaacggtaagtggcagggaggggtggggggtgagggagttaaactcaggtttcctggctccaggattactcactttttatctcatttggactgaatctcaagtgatgaactgttctgcactgtctctacaaaaatcactcacaggtatgaacacttttatccttcagtcttctcttctttaggcttgcaatggcaggctctcggatctttcctccaatctgtattgggttttgagccaagcaagaaaaaccagacacagtccctattcttgaggagcccccagtctgaaaacaagtcgtggatacacagaaaaaacattcttgtgtgtgtgatggatggtagggaacgtgtcatcaattgtgacatttatggcatttatttgcctttactagtgagttctgctttttaagatgtttgcgacttctcaggcctcaccctcaaaagaatttgaaaattgaacacaagcagagatgttttgttttcaactcaggacctcacccagagttttttaggcagcaaccctgaaccaagttggcctcgaggtattcgtgagtttccatacccagaagactttttcagcttctaccttctacccatgaaaggaggtggcatggatgtttcctttttctttttctttttttttttttttagtatttattgatcattcttgggtgtttctcggagagggggatttggcagggtcataggacaatagtggagggaaggtcagcagataaacaagtgaacaagggtctctggttttcctaggcagaggaccccgcggccttccgcagtgtttgtgtccctgggtacttgagattagggagtggtgatgactcttaacgagcatgctgccttcaagcatctgtttaacaaagcacatggtgcaccgcccttaatccatttaaccctgagtggacacagcacatgtttcagagagcacggggttgggggtaaggttatagattaacagcatcccaaggcagaagaatttttcttagtacagaacaaaatggagtctcccctgtctacttccctctacacagacacagcaacaatctgatttctctatcttttccccacatttccccctttctattcgacaaaaccgccatcgtcatcatggccggttctcaatgagctgttgggttcacctcccagacggggtggctgccgggcagaggggctcctcacttcccagtcggggctgccgggcggaggtgcccctcacctcccggacagggcggctggccgggcgggggctgcccccccacctccctccctgacggggcggctgccgggcggagatgctcctcacttcccagacggggcggctgccgggcggaggggctcttcacttctcagacggggcggccgggcagagacgctcctcacctcccagacggggtcgcggctgggcagaggcgctcctcacatcccagacgtggcggcggggcagaggcgctccccacatctcagacgatgggcggcccggcagagatgctcctcacttcctagatgggatggcggccgggaagaggcgctcctcacttcccagactgggcggccaggcagaggggctcctcacatcccagacaatgggcggccaggcagagacgctcctcacttcccagacggggtggcagccgggcagaggctgcaatctcggcactttgggaggccaaggcaggcagctggaaggtggaggttgtagccagccgagatcacgccactgcactccagcctgggcaacattgagcactgagtgattgagactccgtctgcaatcccagcacctcgggaggccgaggctggcagatcactcgcggttaggagctggagaccagcccggccaacacagcgaaaccccgtctccaccaaaaaaataggaaaaccaatcaggcgtggcggcgcgcgcctgcaatcctaggcactgggcaggctgagacaggagaatcaggcagggaggttgcagtgagctgagatggtggcagtacagtccagcttcggctcggcatcagagggagaccgtggagagagagggagagggagagggagagggagacagtggggaaagggagagggagaccgtggggagagggagggggagagggagaccgcggggagagggagagggagagggagggggagagggagaccgtggggagagggagagggagggggagagggagaccgtggggagagggagagggagagggaggagagggagagggaggggagggagagggaggagagggaggagagggagagggaggagagggagagggaggagagggagagggggagggggaggagagggagggggagggggagggagagggagagggaggagactggatgtttcctttgatcatctatcacatctttgcagaggacatataagcctgtgcatggctatgagaacacagtggagagccatgtaaatagcttttgccttcaaggtgcctggcagaagcgaatgaatattgctgtcatgtacatgcaaacgttgtgaaatgcttcaatgttccacatcttctttggagacctttaagaaattcatggaactttcagcagtgatatttaccaccaacaatgtaatcaaatggggcagcaagcaaaatgagctactactaatgcaccatggagcagaggaattttctcttgcgctaacaccacaacagacccattctttcatttggattagtattcactacttgtgcttagttgcttgcagtggatacccaatttgtgaagtgagctgaggtataatgcagtattgtatactggaacacaggggctgcaaaagcagaactcactaacaaagtcaaatgccatgaacgtcacaattgatgaaaactggccatttgaaaaatctagatatgataaaattgttaaattgatgaggatgaagattggattatagtatatattcagcatgcaaaaacagataatcaggggaaatgcagtgacagtcaaagcaactatggaaacaatatccatggcaacaaatggcctggtcggaagagaggcccaaagactgcctgtgtcttcctgatgaaatgtctggtagccccctagtggcaatgaccgggtagtggccctctgcgagatgggcgcctctctggagattgagcgccacttctgagggcctggagaagttgacttgttttgcatcccacggggtcacccccacctccccctttccttgcactcactgacatgagacacaacgtatgtccacaaacaactgctgctcctcattgcatctaaagctccgttgccggaaaacataccattatttcatgcagcactaagaggaaaacacagcgggttaaactatgacacgccattgattgtaagacgcatccctattcaagagatgataaatgggaaaataaatatatgtcttacaacctataaaatataaatgactttcggcatttatattatattacagggtgaggtggctcacacctgtaatcccagcactttgggaggccgaggcgagtggtttgcttgagctcaggagttggagaccagctcggataacatagcaagactctgtatttaaaaaatatatatatatatatgtatatatatacacacacacatatatataaatgactttcagtgattcatttaacattttcagatacttgttccctcacaaactaaacaactaaaccattaattaattaattcactcattctactcacatttattaagtgtggattattggacaagcacactgacgtcaacactgaggatacagcagtgagctggtgtcctgtctttagggggcttttgttacagtgacttggtttctgattatctttgtcacactgaatctgtgagtcagtgagtccgtgaccctaagtgagtttcagagtgaaaacagacaccagataagaagccagaaaacctgggttctagtctagttcttccccttaatagtttatttaatctgtctcaaccttattttatctacttatagtctatcacggttaaattgagaaatagttatatttttctcatagcagagtctttcaaacaatacgcaatgacaatcaaaatagcaaagtagctgtggaaacagtgtccatggcgaccaatggtcccatcttttctttctttctttttttctttctttctttctttctttcttcttctttttctttctttttcaaggtctctgagtttcaagtcaagcctaaaaaaaattttaagtttttttaatttgctggaatgcagtggcatgatcatggctcatagaagccttaatctcactggctcaagtaatcttctcacctcagcttcccaaatagctgggatcataggcatgcaccaccatgccctgctacgttttatttttattttttcaataaagattaggtctcaccatgttgcccaggctggccttgaactcctggactcaaggtatcttccagcctcagcctcccaaagtgctgggattataggcatgagccacagcacatggacctcatctttctttcatgtcactagatcaagaaagctccagagtttttcttgttcccttcaggtgtcaagcaatatcattttatgtatataaacatctaattcagaatagtttcactcttttttcctattgtcctgcataaagcttccccctccccagtggacagactgcaatgggctggcatctgacatttgtctgcagacctcatggtaggagacaggctggttttctgccctgggagtgggagtgtaggaaaggaggaggcactggggacctgtatcccaggttttcagggcaaggctgtgtaagtatttccagcagactagtgtgaggcatgctaggaagcgagctgatgtggagccgagctaatcctgtctgatgtggccacctacaggcatcaacaggcctcagcagagagaagctgaagtgattactgcattcctatgagctgtgggaggaataaatcgtggaaagaaatcctcatttgcaactgtatggcattaggggtgaggggtctcggaagaagcacccaaggaggaggaatcccctgtaagcccctaccagtcccagagaatgcaaagccctcttgcaaaccgtgcctgctccacgccccagaccactccttcccccaacccttccccattctactcaaccttggagggttagaaaccaccattagcaagacaggagaagaaggatagatgcataatgttgaggacctgtttccccatttctcatcttcccatccttgcaaagcccttgctggaggaaaggagacttacctttggaactaaacgttgagtttctgaattggcattgtgtttggtaatataaaataactacaggacctaagagagatcagaacagtcttagtactgtccatattttcatcttggaatggggaaaactggctccactgagcaagttaaggacgtcatagactgatctgtagatgttcaatgaaatctgtaattcaagactaaataacgtattcttggctgggcacagtggctcacgcctgtaatcccagcactttgggaggccgaggaggcgggcggagggcagatcacccgagggcaggagtttgagatcagcctggccaaagtggtgaaaccccatctctattaaaaatacaaaaattagccaggcgtggtggtgtgcacctgtaatctcagccactcgggaggctgaggcaggagaatcacttgaacccacgagacagaggttacagtgagccaagatcatgccactgcactccagcctgggctacaagagcaagactccatctcaaggaaaaaaaactaattaataataataacttattcttgagacacatgcgatgcaagacaagtatttattgctaggatctcctcaggtaagctgtgcagtaagtctgtgctgtcctacatggtagccattagccacatgtagcaactgagcacatgaagtgtggctagtccaaatacaaatgtgctcttaagtgcaagacacacatgagatttcaaagacttagtacaaaaacagtaaaatatctcactaataatttttatgtttattacttgtcaaaatcacaatattttggatatgctgtgttaaataaaatttactattagaattaatttcacctgttgttttttacctttttgatgtgactactagaactttgtaaattacacggagctcgctttctgtggacatgtagtctctctcacagagaaatacatgtatatttctgctggacatgtagtctctctcacaggtcataaggcactgaggtcacaggccataggttgggatgtttctcctccagagagtagctcattctcactttaaatcatcctaaagaacacaggtactggtaggtaggtgggccgcaagctggattgagtggggaaacttcctgctgtctttgaaccagaacaagaacagagttgggagcctgtattttgcatagtgaaggcacactcaagggagccacctatcttggggagttatgctggcccccaaaactcagagcgtgctaaaggtgaggcagagaagcctcctgtagcaagtgcatacagggaggggcgtgggcctctgaaatctgaaagcaccatgtctcatttccagttttaagtgtacctggaattctcttctgttatccctaggtctttagtggagcctgattaaacatgaggctgagggcagctgtgggagctgagggtggattctgtgcccactcgtggcccccccactggccatggcttcctccccagcaggcctcgacagcagtctctggagcctctggcccagcttgctgcgggtcgctgctgttctctttgtgtctcttagcctgtgacttcaatgcagtcatctcatttctgggaatctatccaattctcaattgtgtaaaaagctttataaacaaaaaaagtgcattacagtttactatcttaacaaaatattggaagcagcagaaacatttagcagtaaaaactataaattatagactatgtactttgtgcatcattgggaagccacttaagtgacttttattaaaacttatattaacaaagaagacaatagtgtcataataatttatttaaaaagaattaaaggccaggcacagtggctcatgctgtaatcccagcactttgggaggccgaggctggcggatcacttgaggtcatggcaaaaccccatctctactaaaaatacaaaaattagccaggcgtggttggtgggtgcctgtaattccagctacttgggaggctgaggcacgagaatctcttgaacccggcaggcagaggttgcagtgaacagagatcacgccactttactccatcctgggtgacagaactagactgtctcaaaaataaataaataaataaatataaggaattaaggaacacacaattatatatgcaattggtgacaataaaatacaacccctcaaaaagaacaaaaacaaaaacctaaacaacaacaaccacctaggtataaagaaaagactagaaaaaaatgttttaaaatgaaaccataactgtattagggttctccagagaaacagaactaaaacctctctctctctgtctctctctctctctcatatagatgagaagacacactcaaaggagctcatataggtgagagagagattttaaggaattggctcacacgattgtggagattggcaagtccaaaatttgcagggaaaactggcaggcttggagacaaaagttaatgtcacagttcaggcctaagggcaacctggaggcagaattccctcttccttgggggatgtcagacccactcacatacgggagggtaatttgctttattcaaagtccatccatttaaatgttgatttcatctacaaaataccttagtagaaacatctagaataatgtttgaccaaatatttgggtaccatggcttaagcatactgacacatgaaattaacctttggctgggcacagcagctcatccctgtaatctcagcactttgggaggtttagatgggtggattgcttgagcccaggagttcaagaccagcctggggaatatagtgagactctgtccctacaaaaaacaacgagaaaaaattagctaggcatggtggcgagtgcctgtggtcccagctgctcgggaggctgaggtgggaggatctcttgagcctgagaagttgaggctgcagtgagccgtgattgtgccactgcactccagcccgagtgacagagtaagaccatgcctcaaaaaattaattaattcattaaatttaataaatatttttaaaaattaactttcacaatgatctaaggcttactactttaggatttgcttttgaaatacttttctgtgttttccaaaatacataaaataataaagatgtacttatgatggaaaaggcctgtgtaaacacattttaaaacacagcctccttggggtagccccagagtcccagggctctccatggccccttggacacctttcacagcattcctcacctctgtcttctaccattattatgcatgtctgaatatgtcttcctttgctaaacatcaaacagagttttaggactgggattctagaaagtgagagaaggcaggcgcagaggaggcagtgggagcctgcctgagggcattaacgtcagtcctgggctatgtgctggctcctcaggaccgcccttctgaggggcacagacacgtgagtggagggagctcatgttccagtttctttgcaaaaatcaacttgataaagtttttcctgttttgttaaaattgcctaaaattttttagcaatacttcatttgattttctctaatggtttctgtcatttctttgagttttaatttattgctcatgctttaacatcccagtttatgtcttgcttaatttaatgtccatatagttgacccttgagcaacatggatttgaactgcataggtccacttaggtccacttatgcatgggttattttcaatcaaatgcagatcacaaacacagtaatggtgacatgtgaaacccatgtatacaaaggcccaactttacatatatttgggacccaaagggctgactgtgggacttgaatatgtgtaggttttggtatacacaggagtcttggaaccaatccccctcatataccaagggactactgtatatctgctttgtttatttcttttttttttttttgaggtggagtctcactctgttgtccaggctggagtgcagtggcgccatctcggctcactgcaacctccggctcccgggttcaagtgattctcctgcctcagactctcaagcatctgggactccagtcacccgccacgcccagctaattttttgtatttttagtagagacggggattcaccatgtcggccaggttgatctccaactcctgacctcaagtgatccgccagcctcagcctcccaaagtgctgggattacagtcgtgagccacggtggccagtctcattaccatttgttaagaactcatttgggcgggcaacaggtatacatcgcctcatgaaaactgagtcactcagcctgtgctcccacctggacagaacaccatgcagcctctgcttagagatgctccacaggagccagtgtggaaacaccagggccaggcatcctttagaaaaccattttgggattgctccagctcatgaaccagcagttaactgagtcaccagccatatcataaagcatgactacaactacgcaggcctggtccctaaccccatgttgttacagcaaaatataacccattcttatttcagaaaaagaaaaaaagctagatgtgatggcacatgcctgtagtcctggctacttggggggctgagtcagaggatcagttgagcccaggagttcaaggtcacagtcagctgattgtaccactgcaccccagcctgggcaacagagggagaccatctctaaataaaataagacaaaaacaacaacaaaaaaaaaacagaagaagaaaatataccaaaatgttaacaatgtcttctatctttatttattggggttagaaattacttttgttttcttatattatgtatattttatttcaaacctgataatttttttttcctttttgagacaggatctcgctctgttgcccagggtggagggcagtggtgcgatctcggctcattgcagcctcagcctcccaggctcaggcaatcctcccacctcagctccctgagtagctggggctacaagaacacgccaccatgcctggctaattttgttcgctttttgtagagatggagatctcactacgttgtccaggctggttgcaaactcctggactcaagccctcctgcctcggcctcccaaagtgctgggattacaggcgtgagccaccatgtccagccaatgttatttaatttatttatttttatttatttatttttttgagacagggtctcattctgttgtccagactagagtgcagtggtgcaatcatggcttatcgcaacctcaacttccctgggctgaggtgatcctcctaccttagcctcccaagcagctgggactacaggtgtgagccaccacacctggctaatttttgtattttttgtagagatgggggtcttactatgttgctcaggctggtcttgaactcctggactcaagttatcctcccacctcggtgtcccaaagtgctggtattacagatgtgagccaccatgtccagccttatttttaaaagaaggagaaaattattgagcaagagagtctctctgcagttcttaagattgctgtcagaaccacctcaatactctttctgcagtctgtgctttgagcagcaatataaaaatgcagcattttatgagcattaatagcagggaatgtaaattagcctatttgttttggctctgctttgcttctgatcattagaggccagcaaaaatagaatgagaactgcaaactccctcttgttcccggaagatctctccacagcatggcatatcagtcagatttctgggctgtctcatctccgtctccgtaagaaaggatcttgttggaaatacattgaggcatacactgaagcagagg

SEQ ID NO: 363 - DNA, 66959 bp, Homo sapiens
ttggatttctagatgctggaaatccaagtggtgactagacaaggtccctgcctcgaagaacatgacaaccaatgaaacaaatgaaaacaattctaataccggtgataattgttatggagaaaatatgcttgagctagaaggttgatggtggtgaggatggtaggagatatagtctgttgatcaagatgttcctgggaatttgaacactggacgtctgagcagagacctgaatggtgtgaggggcctttggatccctttggatccctggggagcaggtgcacttggggagttccagtgggaggtgcctgagacaggattgagcagtgttagtggagatgaatgagctgggccgagaggggtgggatgaggccagagtggccagaaggatcctgtgatgagggatgaggggctgtaaaacatagtgagagactggggtttcactgtgctaagaagggaagaggctggcatgtctgtgggacgcggaggcgaggatgagctctaattcccatttgaaatgctcactctgactattgtgtgggtgatggacagcgggtgtgagagtcagcaggcagcccagctggaaggccttctggtttactatcttggagaggatggccctggggaggaggcagtagaggagtgagaagtgattggatttggggttaatacatttttaagatggtgttagcaataactccttggagaaccacacatttatttgcttactttaattctacagcaacattcgaggtggcttactgcaacaaacccagtgtaataaatacatacgaattactttaaaatcaacgctaaggaaaatatacattttaaaagattaaggctggggtaaagctggaacattactaggcaggaaggaacatctgaaacatttgctgaaatggagttgaccctttacctagccatagatttgttgcctcacgatttcattgcatctgagcaccagggagggtggtggcagttcaggtcaccagtcccttgtttcctgattcaggaacagcgtcctgttctacacttacagtcaaagcaaattacatcattataagatgtttaatgatgaagtcaaagtccacagagtcagcaagcaagtgtaaaaacctcaggagtctaaggacagtctacatttctccccagaaatggcctccctatgtactgttgaagggagagggtcctttcaaggggctccaagacgcagaagcaactgggctgcagctcgaaataaagatgtcctttctacctgcaggttccacgaagcctcacaggcaactttggtgatctcacctgagctaggaattcggttttttgatgtgggttctctttgagccattgtgtgagctttaaaatgtgatgtggagattttgctatactggtgtttccttgccggaatttgacatccatggtggctctggcttccctgtctggtcccaggaggaaatggagtgtcctgcactttttttcagcttcgctttgtgtaggaaggatcaggagacctggagtcagggcttcctccaatctcactctcctccataaaacagtgtctcctaagctttctgggggtgagggccttgacaccgtgctgttctgatgaatataactgtcccagctcctgaaataaaagcacaggtgcacaaaataccgactgttgcaagcaatgcctaggtggggatgtttcctaggcgccaggtttagcactttgactttgtatgtacacacacaggggccaggcattgtggtttatgcctgtaatctcagcactttgggaggctgaggcatgagaattgtttgaagccagaagttcaagaccagcatgggtaacaaagcaagacccagtctctacaaaaaaaaaaaaaaaaaaaaagggtatatatatacacaaacacacacacacacacacacacacacacactgggtgtggtggctccagtctgtagtcccagctactcgagaagctgaggtgggaggattgcctgagtccaggagttggagcctgcagtaagctgtgatcaggacactgcagactgtcagagtgagaccctgtctcaaaaacaaacaaacaaaacaaaaatacatacacacacacacagccagagccagcgctgagggagaggctggactcaggggcggggtcacaggcgtttctcaggtccttctcgtggtctttgtctctttttcctggaggtgggggactctgtacttcatgaggagaagttgtctgaagaaggtgggagatactcaggagcagggtccagagagggaaaaggatgaggaagtggagacaaagcagagggggcaggacaagaggagagcacgcaaggaatggggatggggaggaccttccagctgtcagaaaggtcacccgcagaatttggctcttggtttttctgctttatcaggatggatttgggaaaccagccggagtgggagataaggagtctactttgcaaaggacacatgtgagcctcctcctagtttgaactcatgagtagcagctaacagccaggacccttgtgtcgggcacgtgaggcccctttgcaaccagggcgttttctgcaccccaccagccacccctcctgggaccacgctggttccctccaaccctaacagggagagaaggaaggagaggtctggagggtttgggtcctcccttgtgctccttcttcctctgccatttattccctgagtgtcctcgcctttcctccgctacctggaccccactacagtaatgcacactggcctggactccctttgtaaccaccaagtgggttcatcttgccggctacctagacgaagccgatttatcaagacaggagaattgcaacagagaaagagtaattcatgcagagccagctgtgcgggagaccagagttttattactcaaatcagtctccccaaaaactctcatcagtttttaaggataatttggtggataggggggccagtgaatcgggagtgctgactggttggctccggtatgaaatcatagtgagtggaggccattctcttaggctgagtcagttcctgaacgtgggggccacaggactggttggcaggtccagatggggccctccagctgttaaaaatacaaaaacctgaaaagacatctcaaaaggccactctgaggttcacaatagtgatgttaccttcaagagtaactggagaagttgcaaatcttatgacctctggaataatggctggtaatattcagaattccagcccctctcatcctaacttaatggccggtggcctttcttcgttttacaagaacagtttccctttaaactataaactaaattccttcccaaggctagttcagcctacgcctagaaatgaagaagggcagtttagcggttggaagcaagatggggtcagttaggtttgatgtctttcactgtcatcatttccttagttataattttgcaaaggcggtttcaccttggcttcagccccacccatgcagtaacactgtgccctgtccttccaatcactgccactaggtggaagcagagcgtgcatcgcccagatgggctagattctcacaggctcactgctagaacgaatattcttgagactttagatctgaaagtcagcctgatttctgaaagccttggaccgtttccaaaatcaaatcaatactccaggaacaagatctgcctcgactttgcctctacccaaggacgctatggcaacgcagttttcaaacgtgctttgagaataaatggaacagggtcccctgtgtccccactcatttgcgttttcctttttattacagccaaccgcttttgtaaatattgttacacatctctctattccactgaaaacatctctttcaaatgcactttaagaaagattcaatgccatgaaaatatgaaggatcctcttgaaagagagtttctggtggtgggttttaatgaacattttcttttttaaaactctgtaactatttcgttgtggggcttagcttcatattttcaaactgaaatattctcttccttaacctccacataaatccaagtttataatttttattattttaaaattttatttatttttctgttttggggacagggtctcctcctgtcactcaggctggagtgcaatggcacaatcatagctcactgcagcctggaactcctgggcttaagcaatcttcctgccttcgattcccaaagagctgggattatagtcatgaaccactgcaatccacccaaatccaagtttacactaaaagataaaattccaacattgtaggggattggtcaggtggtgggaataattataaagataaagttataggaaatagacacaaaccttcttggaaggtggaaagttttgcaaaagcctcaggatagggttatagctgaaagcagcctaatccccttaccttgagttaatagcttcgagtaagtacaaagacatgtaagagagtttatctaaagagcatgtttacctttgatcatttgtaggactgctctctccgggggactgcgaccagattaattacccacaggtgtgttgactcaaagcctttgtcattaaatctgtgctgaataaaggcccacagggccagatagtcagggcacgcagctgccacaaccctttctgtgagtggcctggccctctggtgcactctttcactgaatatcggtgtctgagtacattattcatccatcgtgcagcctgggtctgccggtcagaccctggcacaacatttaagaggaaatgaaagtcacaaagttatcccagtctctggagtcactgtcaaaactttggtgaggaatcttccaggttttcccctacttcaaatatatattaatattatgtaagtgatattagtggcattttcgcccaggctggaatgcagtggcatgatctcggctcactctaacctctacctcccagattcaagcgattctcctgcctcagcctcccaaacagctggaactacaggcacccaccaccacgcccggctaatttttgcattttcagtagagacagggtttcaccatgttggccaggctgatcttgaacttctgacctcaggttatctgcctgccatagcctcccaaagttctgggattacaggtatgagccactgtgcccagcctccttaaccttttaaaaaaggttaaaagtatgctgggcacatcttttcatagcaatacttaaaattgctcttactctttttaatgacaacatagaattttatcgtgtagctgttctttgggagacgattaaaatcttctttatcttcactgtggtagtggagatgtgggtgtgtacaacagctaaaattcaacaagttgaacattttaaatagatgcagtttattgcatgcaaagtatgtcccaataagatgatttaaaaatattatcctctttgagacttgtactttgcttatgtgaaacaaaacaaaacaaaaaccctgttcttgtgcccaggagacacaccctgacacatctggaggtagagggtcatgctgtctgcaacttaccctcacaggctctgaaataacaataatagcagcatatttacagatttagagagagagaaatttgtggtaaaaatgttcataagtaaaactagataaagggcaaaaataaaagaaataatgaaactacgtcttttaaattttctctctccggccgggtgcggtggctcacgcctgtaatcccagcactttgagaggccaaggcaggcagatcacgaggtcaggagatcgagaccatcctggctaacacagtgaaaccccgtctctactaaaaatacaaaaaattagtcgggcgtggtggcaggagcctgtagtcccagctactccagaggctgaggcagcagaatgccctgaacccgggaggcggagcttgcagtgagccaagatcgcgccactgcactccagcctgggcgacagagcaagactccgtctcaaaaaaaaaaaacaaaaaacaaaaaaactctcctttactttttctctccccttttcttcctatctcttccctcatttcttcaacacgtccccccatccttccctcttttctccattctctgcatttgatccccggtatattccagcctccaggccaacaaacttctccgcgtccgccgggagcaggtcagggaagggacgcgaggcggcgctgtcaccgcattctgagcgccgcagctccctgggccccttgtatcatttcagtgaaggtcactccagtctttcatggaggccaaactaagggtgtaaattaggatcctcactgaagtggcgggaccctaagaggctttttcctggccccttagttgtgggttttcctgcgggcggcgcagccggtttccatcagaaccgcccagaggcggacgctgccttcctggggtgacggagcagcaggaagcgttttcggatcctggaatacgtgggcggcccgtgggaggggctgaggcgcagtttcctactcacccggatccgaatcctccgcggtgctgtttcaagagagccggattccagatcacgctccagcccggactcggaattcctgccctgcgggtctgcattttcataacgggcaggtgtgagtgccctgcagctggagaccagaagcctgaaggcagctcggccctccccagcccacagcgccgttattccgtttctatatcagtaaacacatttcattttccgtagaccagggcggggtgacgggtgatcccagtcctcgcagtgaattccgggcagcaaaattcaaaacacatgcggccaaggccgggcacggtggttcacgcctgtaatcccagcactttgggaggtcgaggcgggcgatcacctgaggtcgggagctcgagaccaacctgaccaacatggggaaatcccgtctctactaaaaatataaaattagacgggcttggtggtgaatgcctgtaatcccagctagtcgggaggctgaggcaggagaatcgcttaaaccttggaggcggaggttgcggtgagccgagatcgcgccattgcacttcagcctgggcaacaagagggaaaactccgtcgcaaaaactttcgggggcggagcggagccccgccctgggttatgtaagcgaccgcgctgggccgtttctctttcttttccggaccctgcagtggcgcctaaagtctgagagagggaagtcgcctctgtgctcgtgagtgcatggggtataaggcaagtgctgagggagaaaacgtagttgatggggtagagcagacggggttggaggtggggtggagggggagggctttggacagaagacctgggaggcttggtgggggaggggcgcccaggcctgggcactaagaaacaagtcccctggagctcaagaccatctcggcctcccctagcccaagagaggactggcttcatgactccctgaaaccatttctaaatgccttagaacaaaccttgcatattcattattgttattgaactattaaaagtcttttttgggggcgagctgaatcagatcctttgctggagctggcacacggaggaagtcctggagggagggtagacaccgtggaggtaagggcttgggacctgtgtcaggagagctaggtccatctccctcccagtctctcactaggcttatgatctttagcagtgaaaataatctctctaaggtggggaaaggaccccggtccctgctgtgctcaataaattatgaggatcaaaataaattatcagtgaatgtgaatgggaaaactaagaaattgttaaaattctcgaatacattacattttcatccacagaaaagtgtaggctagggatcatgggggaatagttagtaatgacagggatagttgaacttaaaaaaaaagtttgtgaggctgacaaagaagaaacggacacatttcctgatcttggagggttcatagggtagaagatggtagatgacagctgggtgtggtggcactcgcctgtagtcccagctactcaagaggctgtggtgggaggattgcttgagcccaggcattcaaggctgcagtgagctataatcatgccactgcattccaactgagtgacacagcaagactcctctcttaaaaaaaaaaaaaaaattcatggcagggcacaatgagtactatcaggaaggttcaaaccacgggctaaatcagtagttctaaaacttgactacacatcggaatcacctagggaactttaaaagatactaagatttaggtccaacctgggtttactgatttaacaacctaggttgtggctgtggcctgggaacatggatattaaaaactctccaggtggttctacgcagtggctaggtttgatgacctctgcctagatgtcccaacgactaagagatgtgcgttggggacaaggcaattctcttagtagaaagaggctttcgggacagcattcttattattgagaattgagaattcatatgccacacaatttatccttttaaagtgtgcagctcagtggcttctagcgtaatcacaaggttgtgccaccgtcaccactgtctaccctggaagattttttttcctttttttcttttttcttttctttttattttaaaggctagtcaagtgaaacagtgggagtgaagaagaaacaaagacatctataactggttgtgatcaattagttgtaaacactgcactcagaccagcctgggaagattttaaggatatggtgtggtctgatgggttccaaggcagaggttacaatagcctggaagagggagactgcttaggcagtggcatcctggtgggatagggtgaggagatcccagagcccacgtttactgcaaccctggggagatgtcaccagagaaatgggggtggtgccagacagcagattgtggcagctgaggttttccacggtagagtagaagcatccatcatgtgtgacattcagcagatggggcgctgtgggtggcttggagcactctggttgtaactgaggcaggcaccgtgtttaggaaggctgtgcagtaatctaggctgaagggaggggaaagcctagactaagattgtggctgtgggattgaaatagcgttgaaggagctgactttgactcccggagatgatggggaaagaggaaatcagaagggaccaaggatggtgatgttcttaagagaaactgaggaggaagagaggatgatatggtggcagacgtatagagagtctttgtagatctctcacattggaggggactatggtcggaggtacagatgtcctaaggcaggctggaaaagggagtctggagagagcttggtgttgtagtgaaccacagggagccgcctccttggccctgtgatcacccagggactgaatagagaggcggccctgggagacttcagacacttagaggatataagggggtgaaaggggggcctggctttgagtcaaagggaggagaaggagattataaagctgaaacgtctaagagagtttgtggtctgagcggttctactgcggcaggtgcttctgagaggcagaggtggctgagatctggaaacaggtctgcaaatctggtcactggtctcattgccagtaacgctgtgcgcggttgagggagtgtgttgggagaatagccacgcgttgtctgtcctggaaggaacaagccagtgagagccggtttaatggggcggccggcgaaaggggcttggtgaggcccgcgctcctcggggtgggggcgcggggatgggtggtcgcgatgccgggagggcaggcagggccctggccgtgcttatgaagttggagctgtactctcagctactcgaagctggtccctgctttaggctgcgctcccgcgtgctccccattttctgggccccaggtcccgccttctaaatctccccaggtctccagcccactggaattttctcttccaagcgtggccccgccctctccgctcgtgattggccctaagttccgggccccagtttcattggatgagcggtcgggggaccgggccaggtgactaagtttccgcggcgccttctccccggccactgcttgagccgctgagagggtggcgacgtcggggccatggggctgggcccggtctttctgcttctggctggcatcttcccttttgcacctccgggagctgctgctggtgagtggcgttcctggcggtcctcggcggagcgggagcagtgggacgtttccgggggtcgggtgggtagcggcgagcgctgtgcggtcagggcggggctcctgtgccctgtcggtggcgcagggagctggacgcggcccgttaccgccacacttcagccctgcttccccgtcacttttcagtcctcctcgggatcgcgcatcacctgcactttctggtctcctcctgctctttctctcctcgcgtctcctccgcttcctctcacttttcggacaaaccagtccttctgaggcccatgggttcccgggctgcctccggggctgctcctgtgaatggcattcgagtgcccttccagcgcggccactgaagcagccacaacccccggtgctcggggcggctctcaggtccctgaagtcctgtcctctcccggagccgacgtgttctcagctcctgggccgcagctcctggagtaggggccctcctttctcgggacccggagctggtgcttcctgctgctgtggggactgtggggggtcctgactctcaagctgaggggttggagtctgcaggctccgggcagaggattcttcctgcgacttctctcatccccagctcattctcccctcgcctctggctccgagggtcctctcctctctctcatcccacccctactaatgaccagtgatctaaggacaccagattccctctcacctcctccctgcccatctcagggcccgctgagtccttttgccctcccagctccctgctaccccttcctgtgtgctgttctctgatccatttctagggtgtcctctgccctcatcccctgtccccgccaccgaaggtccctcctgcaccccttatgggcctttcctacaagcagccttcacccagtgctgcccctatgcctccccgttcccaaatgtccctgactctaactttctggtgctgccttttatccgggggggtcttccctccatcccactcccctccagacccccaaggggaaccctgatgctaatggcagttgggccttaggcagggcgcagggcagcgcagatgccccctcccctccagtgcagatgcctgctctggaccctgcctcatggtggccccttccccactccttcatcctcagcctcaccctcttgaggaccccaccctccagcccacaggtgctggaccatccctccctggtccctccgcccctctccaccttgggaccttgtgctgctcctgtctcttgcccagctgccttgggccctcagcacgttctcatctttcagtgggaaagtgggagtgctggagcatatgacagtgctgagcatctttcccaagccccaccctcccccagagcaccctcccctcctgtcctcaccctaccccaagttctcccacagtcactcctgccccatgctcatgccgccctccagttcttgctctgcccatctcccctccccaacccagacctaaaacaggctgttgggccaactgttccttgaccttccttcttttcttttggttccttgaccccagtgggctctcactccccacaccgcatatctaaaatctgttttgcctgctcttggggtgccactgctccccctccagcattactccttttggcaggtccttcctcaggctgagaatctccccctctaccttggttttctctctctggccagcacccccaccccttgctttgtttttaatttttaacttttgtttgggtacgtagtagatatatatgtatatatttatggggtacatgggatattttgacacaggcctacaatatgtaataatcacatcagggtaaatgggttatatcacaacaagcatttatcctttctttgtgctacaaacaatcccattatgctctttcagttatttttaaatgtacaataaattattgttgactgtactcaccctgctgtgctatctactagatcttattcattctaattatatttttgtacccattattaaccatccctgctcccccactccccactacccttctcagcctctggtaatcatcattctattgtctctccccatgaggtccattgttttaaattttggctgccacaaataagtgagaacatgcaaagtttgtctgtctgggcctggggcttatttcacttcacaggatgacctccagttctttgcaaatgacacgatggctgaatagttctccacatacacatgtacaccacattttctttatccatgcgtctgttgatggacacttagattgcttgcagatcttggctactttgaatagtgctgcaataaacatggaaaagtagatagctctttaatataccgatttcctttctttggagtatatgcctaacagtgggagtgctggagcatatgacagctctattgtatttttagtttttggaagaacctccacattgtttcccatagtggttgtactagtttacgttcccaccaacagtgtacatcctcaccagcattccttatttctacatcctcgccagcattccttattgcctgtcttctggataaaagccagtttatctggggtgggatgttatctcgtaggagttttgatttgccttcatctgttgacgaatgatgttgagcaccttttcatatacctgtttgccatttatatgtcttcttttgagaaatgactattcagatcttttctcatttttaaattggattattatattttttttcctatagttgttcgagctccttatatgtttcagttactgatcctttgtcagatgaatagtttgaaaatattttctcccattcttggatggtctcttcattttgtttattgtttcctttgctgtgcagaagcctttttacttgatatgatcccatttatgcaattttactttggttacctgtgcttgtggggtattactttaaaaatctttgcccagtccaatatcctagagagtttccccaatgttttcttgtatagtttcatagtttgaggtcatagatttacatctttaatccactttgatttgatttttgtatatggtgaaagacagggtctagtttcattcttctgcataaggatatctagtttccccagcaccatttttgaagagactctcctttgccaatgtgtgttcttggtacctttgttggaaatgagtttactgtagatgtatggaattgtttctgggttctctattctgtttcattggtctgtgtgtctgtttttatgccagtatcatgctgttttggttactgtagctctgtagtataatttgaagtcagataatgtgattcctctagttttgttcattttgctcaggatagctttatctattctggtttttttgtggttccatatgcattttaggattatttttattatttctgtgaagaatgtcattagtgttttgatagggattgcattgaatctgtagattactttgggtagtatggatatttcaacaaaactgattcttccaatccatgaacgtggactatcttttccattttttgtgtccttcaattttttgcatcagtgttttttgtttttggtttttgagatggagtttcactcttgttgcccaggctagaatgcaagggtgtgatcttggctcaccgcaacctccgcctcccaggttcaagctattcttctgcctcagcctcccaagtagctgggattacaggcatgtgccactgtgcctggctaattttctatttttattagagatggggtttctctatgttggccaggctagtcttgaactcctgacctcaggtgatccacctgcctcggcctcccaaagtgctgggattacaggcatgagccaccacgcccagccacatcactgttttatagtttttattggagaggtctttcacttcttcagttaggtttattcctcagtattttattttatttgtagctattgtaaatgggattcgtttcttgatttctttttcagattatttgctgttagcactgatttttgcatgttgattttgtatcctgcaactttactgaatttgttcttcagttctaatggttttttggtggagtctttaggtttttccaaatatcagaccacatgatctgcaaacaaggataatttgacttcttcttttccagttttaatgccctttctttctttctcctgtctgattgctctagttaggatctgcagtactgtgttgcataactgtggtaaaattagtcatccttgtcttattccagatcttagagaaaaggctttcagttttcccccattcagtatgttactagctgtgagtttgtcatatatggcttttattatattgaggtctgttccttgtatacttagttttttgagagtttttatcatgaagggatgttgaatttatcaaatgctttttcagtatcaattgaatgatactggcttttgtcctttattctgttgatatgacgtattacattgattgatttgtgtatgttaaatcatccttgcatacctggaatacattccacttgctcataaagaatgatcttttttaatgtattgttgaatgtggtttgctagtatttccttgacgatttttgcatcggtgttcatcagggatataggcctgtagttttcttttttatgatgtgtctttgcctggtttttgtatcaggatattcctggctttgtaaaatgagtttggaagtattccctcctcctctatttttcagaacagtttgaataggactgacatatgttgttctttaaaagtttaattgtggtaaattatacattacataaattttactgttttaaccacttttaagtgtatactcggtggcattagatacattcacatttttgtgcaacccaaaactctgtgcccattaatcggtaactccccattcctccctacctctggcccctggtaaccaccattctactttttgtttctatgaatttgaccactctaggtacctcatttaagcagaatcatgtaatgtttgtctttttgtttctggcttatttcacttataatatttttgaggttcggtgggcacagtggctcacgcctggatttccagcactttgggaggctgaagcaggtggatcacctgagtttcggagttcgaaaccagcctggccaacatggtgaaaccccatctctactaaaaataataaaagttagccgggcgtgatggcgggtgcctgtaatcccaactacttgggaggctgaggcaggagaatcgcttgaatccgggaagtggaggttgcagtgagctgagatcaggccactgcactccagcctgggcaacaagagtgaaattccatctccaaaaaaaaaaataaaacaataataataataatatttttgaggttcatccaagttgtagtatgggtcagaatttcattccttttaaggatggataatactcattatatgtatgtaccacatcttggttatccatccctcagacaatggacacttgggttacttctaccttttggatattggcaaatatttcatttcctttgggtatatatttatttcctttgggtatttcttttgggtatatatccagaaatagaagcagtacacaggggcttcattttctctgtctctttgccaaccttgctctgtgtgtgtgtgtatgtgtgtgtgtaggtgtgtgataacagccatcctgattggtttcaggtggcatctcattgtggtttggatttgcattttcctaatgagtgctgatattgagcatcttttcatgtgtttgttgatcatttgtaattttctttgaagaattggccatttaagtcttttgcccattttttcccccacatagcttctcttatcagatatatgacttgcaatatttatttcatttcggggttgattgctttttcactctgattgtgccctttgatgcatagatgttttgaattttcatcagtctactttgtcagttctttctattctatctgtgctttggtgtcatatccatgaaagcactgtcaaatcctatgtcatgaacattatccccaatgtttgcttctaagaaatttttaggttttagttcttgagtgtagagtttaggtctttgattcattttgagttaatttttgtatatagtgcaaattaagggtccaattttattttaacaccccctgcccccagaactatttgctgaaaagatcaactgactctttgtcacctgctcaccccagtggacactagctgttccatccaattgctgtcctggggccttgtcatgctactcttccactttgaacccaagcccacaccgttcgttgctcccctctgggatactgaccccactataaacttctctggggctacaaccttcctaccctttgtgcctcatgaccaccccctcccttgtccccgccatgcccatgatgagtctcttctcgaggcagctccccttgcctccatctcaccctcagcctatgcaccacagccacactggacatgggtccctctgagcctgagtcccttcccattcccaccatcccctctggcaagaccttccttccaccaccttcatgctcctcccttgcccctgcagggcagcctctccccttggcccctattcccttagggggcttgtggccacccagtccttgcacctggcctacaagtttgccatcttcattcccccttcttctgttcatcagccccctcctctatcctcccaccctcacagttttctttgtatatgaaatcctcgttcttgtccctttgcccgtgtgcatttcctgccccaggaaggttgggacagcagacctgtgtgttaaacatcaatgtgaagttacttccaggaagaagtttcacctgtgatttcctcttccccagagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggtgagagtcggcaggggcaagagtgactggagaggccttttccagaaaagttaggggcagagagcagggacctgtctcttcccactggatctggctcaggctgggggtgaggaatgggggtcagtggaactcagcagggaggtgagccggcactcagcccacacagggaggcatggaggagggccagggaggcataccccctgggctgagttcctcacttgggtggaaaggtgatgggttcgggaatggagaagtcactgctgggtgggggcaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacaggtaccgacgctggccaggggctctcctctccctccaattctgctagagttgcctcacctcccagatgtgtccagggaaaccctccctgtgctatggatgaaggcatttcctgttggcacatcgtgtcctgattttcctctattgttagagccactggataaagacagagggtcagggactggaccatccagtgttgtaatcagggcaagtagaggaccctccgacagaatcctgagcctgtggtgggtgtcaggcaggagaggaagccttcagggccagggctgccccctctgcctcccagcctgcccatcctggagagttccctcctggccccacaacccaggagtccacccctgacatccccctcctcagcatcaatgtggggatcccagagcctgaggccacagtcccaaggcccatcctcctgccagcctggaagaactgggccccagagtgaggacagacttgcaggtcaggggtcccggagggcttcagccagagtgagaacagtgaagagaaacagccctgttcctctcccctccttagaggggagcagggcttcactggctctgccctttcttctccagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctggtgagcctagggtgaccctggagagggtcaggccagggtagggacagcagggatggctgtggctctctgcccagtgtataacaagtccctttttttcagggaaagtgctggtgcttcagagtcattggcagacattccatgtttctgctgttgctgctggctgctgctatttttgttattattattttctatgtccgttgttgtaagaagaaaacatcagctgcagagggtccaggtgagaaaagcgggcagtttctggagatggtaaggcccctgtctgggcagtagggtcccctcattgctcctgcaaagataggcatgttggtgacaaggcttccataacaggggatgaaagttggggaatttgggaagggaatgggggcagcatctccatctacacccataagtgctgcccaagcaagggtcaaacgcccagctgtggcatcctcctgctgcaggtgaggagtgggcagcagggagggctgcggcgcctgctctgtccccatcccggtctctgtgtctcttgaactcactagggcgcatccaggtggggtgagctgggaatcacgtgctgaatgctaagggcctggatgatcacggcctcagagggagcaaatagtaaaggcagctgtgatctggggagggccagaaactggagaggaatctgaggagaggcggtgcccctattcccttcctctctgcatccccctcccctgtttctccagccatcggggcggacaccgagaaaaagacctatgaggcccagcctgggggccctgcctgtgtagccctttggagaccccttgtaacagggagggtcctgagcacacatggccatctctgtccactttgcagctccccatgcacctcctccaggagctttcttggggttgtcgtgtcctctgcaccattcgaggccctactctttccaggttcccacggcctggcctccctgagtttcttgcagatgacatggatgagtagataagcagatgtccctgggccatttgaggagtggggcccagcccctcatcagggcagctgtggtccctgttttcatcctacctccgagtgttttcttctccagtccctgagggacacagtcctcagggcccatgtttttggggatttaatctgtgctctgtggcctcaccttgccctccctgagccaatttccctttctaaaggtggtcactgcctggtaagtttggagtaagggacggtcagaatcatttcccctacagtcaggttgtttgatgggggatgaaaagagacagcaggaagttttgtgtttctgcaaagacagaagcagttcaggcgacagtaagaggctggggtgtccaggaggatgtgtctggcagtagggtcgctggtttctcatccttgaacctaattgcactgtcaatcggcccctcaggcctgagcagatgggaaggtttgtcccctgccctgcagcaagagggccctgtccaggaggcacccacaacaggggcagtgcaggtctgtggtcactcctgctctcacctgtggcgtctcccgtagagggattgtcagttctggttccctgtgggcaggaatggtttcctcataggtcactggagttttggccaggaaaagagtatgaagttcatgtgccagtttctcaaaattcctgctttcaatgttgatgtccagtaaagatattcgtaatttcagctctataatcttaataggatttcctctaatattgtgaagcatattatatgaaacaggaacacaaatttctcaaaattcctgcgatgtccaataaagattttcataatttcagctctgcaatcttaataggatttcctaatactgtaaagcatattaaatgaaacaggaactcaaatttggagccccctctccaggaggttctgtgtggagatggtggctgtggcagtggcagttcccaggtgcagagggtgggcagaggcagcctcaggctaaggggtctcccctactccacatggagaaaatcccttgtaggttgcaagggcagtggccgggtggaatccctgctagggacagagcaggaaggcctcgcagcctcaccaagcagcagccctggggtggagctgcgtttccagggttaagcggaccaggcaggagtagcggttactcaagagcaggtcacaggcttgggttgtgagggtcaggagaggccaggcctcctcgagcaaggtgggggtcccagggtcaggtcaggtgcagatcctgtggcagccacgtctttccatgctgggcctgctgggccccccaggcttcctgatggggtccccagttaggagctgcctgctcagggctgggaggggaggagcactgagctgcagatagagggcagagcccacagtgggcagggcctgccctggtgtgtaggtgcctctgaaggagaggagggcctggggactgagagcaagggtcagggcctctctttggggaggcctctcactgtaacaggactggtcaggcctgagaggagggcactgggttccctcttgggtcttgtcctttagtcttggggccctttccctccctgcacgatgagtggtgggcacagggcacgggctgatgttgatggagtgatgggagggaactggcaggggctgggaaaagcaaggagggaggaagaaaaaagtgggggcctcatcttccctcagagaaagggcaaatctggttttggagcaactgaagagagaaaagtccccagggaataaacacaacactgcacccagtggagcatttacccatttccctcttttctccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaattggtgtcattgtttttgttgttttcgtattattattttttttttttaagacagagtctcaggccaggcacggtggctcacgcctgtaatcccaacactttgggaggccgaggcgggcggatcacaaggtcaagagatcgagaccatcctgatcaacatggtgaaaccctgtctctactaaaaatacaaaaaattagctgggcctggtggcgtgtgcctgtagtcccagctactcaggagctgaggcaggaaaatcacttgaacctgggaggtggaggttgcagtgagctgagatcacaccactgcactccagcctggcgacagagcgagactctgtctcaaaaaaaaaaaaaaaaaaagacagagtctcactctgtcacccaggctgcagttcagtgacatgatctcagctcgttgcagcctccgcctcccgggttcaagcacttctcttgcctcagcctcccgagtagctggggttacagacatgcaccaccatacccggctaatttttgcatttttcatagagacaggattttgccatgttggccaggctggtctcaaactcctgacctcaggtgatctgcctgcctcagcctcccaaagtgctgggattacaagcatgagccaccatacccggcctattttattacattttaatttattttattttattatatcatccaccatgtctggcctattttattatattttaagatattttaatatattacgtgtgttgtaattggattatcatcggtgagctttgtgagtgagtgtcttggagatgactcctcctgaccagcccaggaccagctttcttgtcaccttgaggtcccctcgccccatcacactcttacgcattactctatgtctactgttatgggtgtgtaattttataccatagatgtttactctttaaacagacacttctagtctgttttatttcatgtgtctgggagcggataaagtgtgaggttcagggagaaagagaggtctgtctcaatgccttggcacggcatgaagacaatctcccctccttgtcccctttccctgctagctcctgatgactgacagattcacagcagaacagaaaggactgggaagggatggaggtgggacatctggcactgaccttcaggggctgaccctgtgggggaacatctgccctgaagagttggagccttcatgtgatgacacagagctgaagtgtgatattcgggaggggatagagagtgcttggaggttttctgattttgaagaatcccagtcagtcaggttctggcgtaaagtgactgctggggaggtgtggactgaatgaatgaagaataaatgaaccaggaaagtggacatgcaagaggtgggttattcctcaccctatttcttgatgcctcctgactgctggtgttggggcacacagatgggtgatgcacttcttggtcaaggcaacctcagccccacccacgtaaggtggtcatggcagagagtgtaagggtgacacctgtgaaaaagacccaaggcagggatgggagcccttcttgcagcaggagtggatgcaggacctgcctggaagcaagagaaggacgagggaccctggctgggccctgtttcctcccactgcctggttcacaaagcaaccagtaagggagctggagtagggaattcactcatgtgctacttactgatccagagatgtgttcgttgacattttcttttatgttttcaggttgatgtcatttacacattcatgcatttatgttgtgtatttattagtcttgtttattttagttagcaagtgtcacttgttgaattctgttctcattaggtataaattttcatattcattgaagtttttataatcaaaatttaattgtccatgattttaaaagtcaaatatttgcataggatttctctagagaaatgagtcctctctgcatcttctcaatttctgccttcctagaggcaaccattttcaacatttttagctaagtctttcaacttttacttccatatgtctaaatacaattccttcattaatactgcttgatttttccgttgcagtcattatctgttgcacagcacagtggtgaatgcaatagttaattgtacctgttccctttcactcttcccattctttcatcttcccgatgtatttctgtagtaattatgtttggttcagtcgttccttgtttccttttccatgactaattttctcatatgtcagcttgaccacttttcacttcctgaacatttgttcttcctgtagttaatacttgcctttgtttttgtttattttataaatagcactcattaacgttgatatttcttctatttgtattactcctttttttgggatggagtctcactctgttgtccaggctggagtgcagtggtgtgatcttggctcaccacaacctccgcctcccaggttcaagcaattctcctgcctcagcttcccgagtagctgggattacaggcactcaccaccatgcccagctaatttttgtatttttagtagagacggcgtttcaccatgttgtccacaatgatgtcgatctcttgacctcgtgatccacccacctcagcctctgaaagtgctgggattacaggcgtgagacatcgcgcctggcctttttttttttttttgagatggagtctcgctcttgttgcccaggctggaatgcaatggcacaatcttggctcaccacaacctccacctcccaggttcaagggattctcctgcctcagcctcccgaatagctgggattacaggcatgcaccaccacacccggctaattttgtatttttagtagagacagtttctccgtattggtcaggctggtctcgaactcctgacctcaggtgattcacccgcctcggcttcccaaagtgctgggattacagaggtaagccactgcacccagccgtattactcttttaagaaattacagactttggatattccactttaccttcttggaaatgtccctcctgggcccttctcgctgctcccatctggactggaggcttctccctgtggagcagagtcactgtcctaggatctccctccaccgccatctggggcagtgctttacatgcagtggagccacctggggtccagccaaaatgcagactgattcaagatgtcaaggctgaggcatatgagcctttctgtctagtttcatgagatgctgattctcctggttcgtgtgtgtgtgtgtgtgtagagagagagagagagaaagggaattttgctctgtcagccaggctggagtgcagtggtgccatcatggcttactacaggctcaacctcataggctcaagtgaccctcctacctcatcttcctaggtagtcaggaccacaggccacatcctaatatatttttaattaactgatgcagtttctttctaaattagtaagagggctgagcattttttcattgtggcaaaaaatacacataaaatttactatcataactatttttaagaatacagtaccattggccaggtgtggtggctcatgcctgtaatcccagcaatttgggaggctaaggcaggaggatcactggaggcctacagttcaagtcaggcttggggaaagtagtgagaccctgtctccagccaaaaaaaaaaaattaaattaaaatatactgtactataatagtgttaattgtaagcacagtgtagtgcaaccgatctttagaatatttcaccttgaaagctgaaactctgtgcccctttcacaaaaatccttattacctggaagttttacctggcagccaccattctaccttcacattcatcaagtttgactgttttagacacctcatgtaaatggaattatgcagtacttggagttttttttttttttttgattggcatatttcacttagcaatgactttaaggttcatatacgttgtagcatatagcaagattttcttcttttaaatgttgaataatattccattgtctgtatataatcatattttcttgatctattcatctgttggtaaacatataggttgcttccatatcttgcctgttgtgaataacaccattatgaatacggatatgcaatctttcttttcacttttgtatcccccctcattttggtgcaactaatcttctagtagcttttcctgaaagcacgtgcttaaagtacatttgtgtgtttcaacatatctactatcattttgcctctctccaggaagaggaaagaaatgtattaaggtgctctttggcacagcatttaatggtaaagaaagaaacagtataactggccggtgctgggtttcagcatcctgcaatttcagaactactgtgaatacaaaagaaagaaaggtcctgcccaggatgggagtcactcctatatatggtggccctgggacagcagacctttcctgtcacacctcttccatgagggcccttacttcagtgactgtggtgctttccttctctctatggtccatctatctatctatccagttggttgggtttctctggagaaccctaatataccaatggacagtaagcaaataaaacctagtattaccactaattgccattgagaaaaatatgcctaggccagaagattggtgatggtgggaatagcagggacatagtttagacaaggtcattgagcaagacgtttctgagaacttgaccactggttatctgagaagagacctgaatcgtgtgaggagtgagtcatgtgaatccctggggagcaggtacatgtgggagtcagagcatgggtaggtggcagaaatagggcagagcagtgacaagaggctggtgtgagtggagacaagtgagctgggctgagaggagtgggatgagcccagagttgacagaggggccctgtgttgaggggcttgtaggaaatggtgagacattggggtttcattgcactaagaggggaagaagctagagtggctttgggatgtggtggtgatgatgtgccctaattcccgtttgaaaggtttactctacctgttgtgtgggtgatggacagcggcgtgaatgtctcttcatgtccattacccatttttgaatggcgttgtttttttaatggatgagttgtagtttttttatgtattttgaatattaattcttcatcagatgtatgattggcaaatagctcctcccattctgtgcattttctttccactcttttaataatgtcacttgttgcaaaaaagtttttaaatctgataaagtctaatttatcatttttctttaattgctcatgctttgggtcatccagccaagaaactactaccaaatccaatgttcacaagactttcctcaatgttttcttctaagggttttacaggtttgactcttaagcttcgttgtttgatacattctgagttaattgttgagtatggtgtagggaaggctatgaattgtgtccaacatcattcttttgcatgcggatatccagtttctcagcaccacttgttgcagcaccatctgtggaagtgaggctgacacatttgcaaaatgcattgagcactagtacaccatgcatttatttacttttctttactccacagttgttttgaggaggcttccagtgacaaacacaacagaaatgaaaatacatgaattcttataaaatcaatatcaagtagaattataaactttaaaatgttaagagtgaggcaaggctagatcattactagacaagctgaaacatagactgaaatggagggtttacggttttccttgctacaaattttgttggcccacaatctgtcatgcttactgcataagggagccagccacagggtgggttgatagctcacataaccagtccctggtttcctgcttcagaaacaagttcagattctctccacttacagtaaaaaagtgaattgcaggatgttcaaagtgaagttgacatctacaaagtcaacaaataagtagtaagtgtagacctcagaaatttaacaagattctactttttcccccaaaaaaatgtcctcacaatttcctgctgaaaggagagggttcattcaggggaccacatgatgccgttcttctgctgcagttctaaattaagttgtccttccctctaactacaggtctcacaaacccttgcagccagcttcaatgattttagcttgactaaggttttgggtttttgatattgtttgtatttgagctgcagcctggggcttagaaatgtgacttgggtattttgccaaaatggtatgtttttctatagaatttgacgttgtggagaccctgcttttctgccaggtccccagaggggatacagtgctttgtacctctttttagtacttcattagcagtgatagaagatttggagtgagggcctccctcaatctctaccctctgcctagtgcagaggatcatggactgttgcagttatggcaacaaaaaatttctccagacatagctcctgtcctctggtgggaaaatctcccctggatgagaacactagtttgagaggtagagacactcaggagctgggcttggacaggggaagggaagaggagacagacacaaaacggagtggggctgggaaacaggcaaagggagttcaggcctggagggacctggcctgatgaggcacatgaggaatggggagagtggcaggatctcctattgccagaaaatcgtacttgtacccactgcattcccagccctggtgtatgcatctctaggaaatcagaatgaatttggctattatggtgtcagaaagagccctgaagagcctcgtgtgcctgtcaatgtaatgaaagtgcaggtgacagcccctcctggaaatattgttgccaaatgtttaacccagatctgcctcggtctttaggaaacacagcagagagaagagcaaagtaaaaggcatcaggggaaataatatgataaattcggtgtggagagcatgctaaagttatttggcctgcaataagtaatgctgttctaaaagaaaaaaggattagtggattgttgtagattacaggtaactaaaggacacataatcaaaggcaatgagtggatattttatggaaccaagttataaaaatgtacaaagaatagattgaagaagtgaagatacttgaatatgaaaggactttagataatatggaattattgtttattttctttggtgtgataatgtaggtttttactcttaggagatgcacgatgaggtgtttagtggtgaaatatcatgggtctagcaagttactttagaatggttcagtcaaaaatcttagtctcttcattctgtctctcttcatacatacacacacacatacactcacatatacacactatacaaacacatatagctgaagcagcataaaacctagtttctagtagagggatgcaaaaagggaggagaattggtaagttagagttttttggcaaaggactgacaatgcgccacatggataggacttctattccgctagctggtgctgttgaccttgaaactccatgtgcactccagaccaagggcagagagagatgctcactgtggcgggtaggggggatgtgttcctagaaaatcacaatgacattcccctgagctatatccctggttactacagcatttcctgatcttgcctaacaggattacttccctgaactgtaaaattcctgcagcattgtatacagagaaagaataggagacatggcaatcatggacaagaaaggaggaaatcgtgataggaaagttagagatcctgttgccaacacccagtcaggcattcggaggctggggtcagtctagaagcctttcataatgccacgtggtagctccatccagaaatcctcagttgctccctgacttcttccagccccaggtgatggctagatcctccatgaaaggaaactggttcaaacacggccaatatgcccagcaacccatgggtaatgggggattctccatgttctccccaggaagcctgtctcccgtcttgtaatgctgggagccacactaatcatttttaaatggctgaaggggacccagtatttggtttgatttgattctaaaaatggaggccaagagcctcaaaataaaaaaacagagtggaggtctgctcctgtactcaccattctgatgaatgtaccttgggatcctgaatgagcaccaaaaataaagcagcacctttgtctggggtgatacctgagatgcattgcctcatgccaagaaaattaaggacacagacacacacaaggagtgagtttaggagtagaggtttaataggcaaaagaaaagaaagagaaagaagaatagctctctctcctgtgagagaaggggcacgcaagtgggaattccagcccatggcagagtgcactggattttatacacaggctgaaagaggtgtctgatttgcacagggcccacagattggttggaccaggtgtgatgtttacatagtgcatggggaagctgaccaccccaccctaatcttcttatgcaaataggctttccacttggctgacaccatgttgtctgctccctgctgcacacgtggttggaaaggaaaagagaagatggagccgccatttgaacatgcctagtcccaggtagccttttcctattggcacaactgctggcattcactcaggcaagcttccagcttgcttgtctatgtctgcagctcaattttacaggctgctctttgttagaaaagaaaatgatttgggggctgcttttcattaaaaggaaaaccttaccaaggacttctttactctcactatctgcctaaataatttctttttaactcctctatcagttacaaaatcagttttaaagcacatactgttctgtgatattgggatatctggacattttgttgtcataggagtttatccttgcaggtattaccaaactgcttccttagctatcaacatcctaggaccatgggtcatgacaagcaaggaatgtaccctgctagtttaaagataaacttgatttgcggggagggggtggtttttagttacatgggtaagttcttttgtggtggtttctgagattttggtgcatccatcatctgaggagtgtacatgtacccaatgtgtagtcttttctcccgcaccatcctatgaccctaccctctgagtccccaacgttcattatatcattcttttgcctttgcatgcccatataagtgagaacacatgacatttagatttcaattcctgaattacttctcttagaataatggcctccaacgtcattcaggctgctgcaattgccgttatttcacttctttttgtggctgagtagcattctacggtatatatatatatacaccacattttcttttttttaattacactttttattttgaggtaatcatagatccacatgtaactgtaagaaatagtaaagagggcaggcatggtggctcaggtctgtaatcccagcactttgggaggtggagagagcaggatcacttgagaccaggagctcaagaccaacctgggcaacacagcaagaccctgtgtcttaccaataaaataataataataatatagagaaatgtcatacattctttacccattattcttcaatgacatgttacaaactacagcataatatcacaagggacactgacattgatatggtcaagacacagaacagttctaccaccacaaggagccctcatgttacccttttataatcacactgacctttccccgcttccatgcctaacccctggcaaccactaatatattctctacttctattaaacttgtcatttcaagaaagtgatatgaatggaatcatgcagtatgtgttcttttgatattggctttttttttcactcagcatgattccctaaagattcaaggattcatttacattcttggatgtatctatcaatagattgttggtttttttgtttttttgttgttgttttttttaattatactttaggctctagggtacatgtgcacaacgtgcaggtttgttacatatgtatacatgtgccatgttggtgttctgcacccattaactcttcatttacattaggtatttctcctaatgctttccctcccccctcttccctcccccaaccccacgacaggccccagtgtgtgatgttctccaccccgtgtccaggtgttctcattgttcaattcccacctatgagtgagaatatgcggcgttcagttttctgtccttgtgatagtttgctcagaatgatggtttccagcttcatccatgtccctacaaaggacataaactcatcctttttatggctgcacagtattccacgatatacaccacattttcattttccactcattgattgacggacatttgggctggttccatatttttgcaactgtgaattgtgctgctataaacatgtgtgtgcaagtatctttttcatataatgacttcttttcctctggtacatacccagtagtaggattgctggataaaattgtaaatctacttttagttccctaaggaatctccatactgttttctatagtgattgtactagtttacattcctgccagctgtgtaaaagtgttccctttttaccacatccacaccaacacctattatttttttatttttcaattatggccactattacagaagtaaggtggtattgcattgtggttttcactggcatttccctgataattagggatgctgagcatttttttatgtttgctggccatttgtatatcctcttttgagaattttctattcctgtacttagccttctttttgatgggattattcattttcctcttgctgatttgtttgagttccttgtagattctggacatcagtcctttgtcaaatgcatagtttgtgtatatgttctccctctctatgggtcgtctgttaactctgttgattatttcttttgctatgcggaggcttttttgctgaattaggtcccatgaatttatttttgtttttgttgcatttgcttttgggttcttgctcatgaagtcattgcctaaaccaatgtctagaagggttttgttcagtgttatcttctagaatttttatggtttcaggtcttagatttaagtctttgatccatcttgagttaatttttgtatacggtgagacataggatccagtttcattcttctacatgtgagttgccaattatcccagcaacatttgttgaatagggtgtcatttccccactttatgttttcatttcctttgtcagagatcagttgactgtaagtatttggttttatttctgggttctctattctgtttcattggtctacatgagtctttagggttttctagctgtacaatcatatcatcagcaaacagcaacagtttgactttctctttgccaattcggatgccctttatttctttctcttgtctgattgctctggctagaactttcaatacaatgttgaagacaagtggtgaaagtggacatccttaccttgtttcagttatcgggggaatgatttctaatttccctcattcaatataatgttgcctgtaggtttgtcataaatggcttttactaccttcaggtatgttccttgtatgccaactttgttgaagcttttaatcataaagcaatgctggattttgtaaaatgtttgtcaaatgttttttgtgcatggttaatactaagtgtcaacttgatttggattgaaggatacaaagtattgatcctcggtgtgtctatgagggtgttgccaaaagagattaacatttgagacagtgggctggggaaggcagatccacccttaatctggtgggcacagtctaatcagctgccatttaacataaagcaaacagaaaaacaagaaaaggagagacactggcctagcctcccagcctacatctttctcccatgctggatgcttcctgcccttgaacattggactccaagttcttcccttttgggactcaggctggctctccttgctcctcagcttgcagacagcctattatgtgaccctgtgattgtgtaagttagtactcaataagcatatatatatattatatattatatatgttttatatatattatatattatatatgttttatatataatatatattataatatatattattctattattatattattctgttaatattaaatactaacataatatatattatatataaaataatatatatataacgtactaacttacattttgtgtgtgtgtgtatatatatattctatatatatattctatatatatattctatatatatattctatatatattctatatatatattctatatctattctatatattctatatatctattctatatattctatatatctattctatatatgttctatatattctatatatatattctatatatatattctatatatattctatatatatattctatatatattctatatatatattctatatatattctatatatatattctatatatatattctatatatattctatatatatattctatatatattctatatatattctatatatatattctatatatattctatatatattctatatatatattctatatatattctatatatatattctatatatatattctatatatatattctatatatatattctatatgtattctatatatatattctatatgtattctatatatattctatatgtattctatatattctatatatattctatatatattctatatattctatatatattctatatatattctatatattctatatatattctatatatattctatatatattctatatatattctatatatattctatatatattctatatattctatatatattctatatatattctatatattctatatatattctatatatattctatatatattctatatatattctatatatattctatatattctatatatattatatatatatattctatatatatatattccatatatatattctatatatatattccatatatatattctatatatatattccatatatatattctatatatatattccatatatatattctatatatatattccatatatatattctatatatatattctatatatattctatatatatattctatatatatcctatatatattctatatattctatatatatatcctatatatattctatatattctatatatatatcctatatatattctatatattctatatatatatcctatatatatcctatatatatcctatatatcctatatatatatatcctacatatatatcctacatatatatatcctatatatatatcctatatatatcctatatatatatatcctatatatatcctatatatatcctatatatatatcctatatatatatcctatatatatatcctatatatatcctatatatatatcctatatatatatcctatatatatatcctatatatatatcctatatatatcctatatatatatatcctatgtatatatcctatatatatatatcctatgtatatatcctatatatatatcctatgtatatatcctatatatatatcctatatatatatcctatatatatatcctatatatatatcctatgtatatatcctatatatatatatcctatgtatatatcctatgtatatatcctatatatatatcctatatatatatcctatatatatatatcctatatatatatcctatatatatatcctatatatatatcctatatatatatatcctatatatatatcctatatatatatcctatatatatatcctatatatatatatcctatatatatcctatatatatatatcctatatatatcctatatatatatcctatatatgtatatcctatatgtatatcctatatgtatatcctatatgtatatcctatatgtatatcctatatatatattctatatacattctatatatatattctatatacattctatatatatattctatatatattctatatatatattctatatatatactatatattctatatatatagtatatatattctatatgtatatattctatatatattctatatacatatattctatatatatattctatatatattctatatatatattctgtatatatatattctgtatatatatattctatatatatattctatatatatattctatatacatattctatatatatatattctatatatatatattctatatacatatatattctatatatatattctatatacatatatattctatatatatattctatatacatatatattctatatatatatattctatatacatattctatatatatattctatatacatattctatatatatattctatatacatattctatatatatatattctatatacatattctatatatatattctatatatatattctatatatatattctatatatatattctatatatatattctatatatatatattctatatatatattctatatgtatattctatatatatattctatatgtatatattctatatatatatattctattagttctgtccctctagaaaacctgactaatacagattttggtaacaggagtggttctagaggaacagaatattaaggatggagttcttttgttagtttaggggtttctggagttggttgcttaatatgattagacccaaaaatgctaaggactctacttctaatagtgtggagaatgctgatagtccctggcatgaactgtttagagagtaacgcaaaataaatgcatttcacactattcactgctcctgagaggcaagtttagtgactctaacctaataattttgaccatatgtagagaaccaaggaacataatgaagctggttggttgctcctaagttcagtggacaaagtgataaaagaagataatgaactcagggattctgtctcccagcttcagaagcagatactgagcctcaaatctgctaagattgccccatgagtgacagtcttatctcctgtagagaaagagctgaaattgtggaaaaacagacaaaagctcctatcatgtgagtagctgacctgcgatgaaagatgcatacacagcctcaccaagtgtctactgttaaagtgagggcattgatcagaaaagaatgagaccctgcaacttggaatggggatatgtgggaggatcctaatgaagctggggacactaagtgtgtaaattatgatgaaactttttttgctagaagaatcagcttccccgtccctagtattggcaacatcccctccccagcccatgctgtcatcagcctttccacctttatctgagaagacaaaccctgcactgcctgaggcaacagtgatggcctgccctgaagcagttgccaggcaagataatgttgattctcctcaggagccacccctaacacctctgtttgcttctagacctatgactagactaaagtcccagcggtcccctagaggtgaggttgagagtgtgacccatgaggaggtgcactacactcaaaaagagctgtttcagttttctaatttatatcaatagaaatgtggagaacaggcatgggaatggatattacaggtatgggataatggtgaaaggaacatagagttggataaggctgaatttattgatttgggccattaagtaaggactctgcttttaatgttgcagctcggggagttaaagaaggtcgtaatagtttattttcttggttagctgaaatatggattaaaaggtggcccactgtgagcaagctggaaatgtctgatctcccttggtttaatgtagaggaaggaattaaaaagcttagggagattgggatggtggaatggattagtcagtttagacctactcatcccaactgggaaggtctagaagatttacccttgaccagtgccttgtgaaataggtttgtgagggcagcacctgcatctttgaagagccctgtaattgctcttctctgcatgtcagagctaacagtgggaatcacagtactcaactataaaatttaaatacaatgggaataattggatcccgaggtgtcaggggccaagtggcagcattcaaccatcaaaggcaaggtgagtgtagctaccataatggacagcagaggcaaagtggcagtcataatagtccaactcatgcagagctctggcattggctaattaatcatggtgttcctaggaatgaaattgataggaagcctacttcattcctacttaatttatacaagcagaaaacttctatgtgcaatggacaaaagactaattttaatcataaaaacaaagaatcatggcccctcagtcaatttccagacttgagccagtttacagacccagaaccccttgaatgaaaaggaagctgggtctccttgaagaaggaccccactacattactgacaatttatgcagtgaatcttcttccatccttctgtgaggagacctccagccttttaccagggtaactgtgcactggggagaggaaaatgattagatatttcaggaatacaggacactggctctgagctgacattgattccagggaacccaaaacatcattgtggccctccagttaaagtaggagcttatggagttcaggtaattaatggagttttagctcaggtctgacttacaatgggtacaatgaatccccagactcatcctgtggtcatttccccacttaatgcattttcccaattaattttcccaattaatgcatcatttccccaatgcaatttccccaattaatgcataattggcataggaatagttagcagctggcagaacccccacactggcatgctgactggtagagtgagggatattatggtgggataggccaaatggaagccatcggagctgcctttacctggaaaaatagtaaatcaacaatgtcacatccctggaggtacagaggagattagtgccaccatgaagaacttaaaagacacaggggtggtgattcaaatcacatccccattcaactctcccaaatggcctgtgcagaagacagacagatcttggagaatgacagtggattattgtaagcttaaccaagtggtgacgactccaactgcagctgctgcaccagatgtggtttcattgcttgagcaaattaacacatctcctggtacctggtatgcagccattgacttggcaaatgcctttttctccattcctgtccataaggcccacaagaagcaatttgccttcagctggcaaggccagcaatatgcgtttactgtcctgcctcaggggtatatcaacaatccagctttgtgtcataatctgattcaaagaaaccttgatcactttccgcttctgcaagatatcacactggtccattaccttaatgacattgtgctgattggatccggtgagcaaaaagtagcaaacacactggacttattgatgagacatttgcgtgccagaggataggaaataaatctgactaaaattcagggaccttctacctcagtaaaattctaggggtccaatggtgtgggacctgccaagatattccttctaaggtgaagaataagttgctgcatttggctcctcctacaaccaagaaagaggcacaatgcctagtgggccgatttggattttggaggcaacacattcctcatttgggtatgttactccggcccatttatcaagtgacctgaaaggctgccagttttgggtagggtacagaacaggagaaggctctgcaacatgtccaggctgctgtgcaagctgctctgccctttgggctatatgacccagcaaacccaatgatgtttgaggtgtcagtggtagatagggatgctgttggagcctttggcaggcccacatagttgaatcacagcagaggcctccaggattttggagcaaggccctgccatcttctgcagataactactctccttttgagagacagctcttagcctgttactgggctttggtagaaactgaacatttgactatgggtcatcaagtcaccatgcaacctgaactgcctatcatgaactggatgctttgtgactaatctagccataaagtgggtcatgcacagcagcattccatcatcaaatggaagtggcatgtacatgatcgggctcaagcagatcccgaaggcacaagtaaggtacatgaggaagtggctcagatgcccagggtctccactcctgccaccctgctttctcttcctcagcctgcaccgatggcctcatgaggagttccctatgatcagttgacagaggaacagaagaatagggccttgttcacagattgttctgcacgatatggaggcaccacccaaaagtggacagctgcagcactacagcccctttctaggacatccctgaagggcagcagtgaaaggaaatcttcctagtgagcagttcacctggttgtgcagtttgcatggaatgagaaatagccagatgtgcgattatatactgattcataggctgtagccaatggtttggctggagggtcagggacttggaagaagcatgattggaaaattggtgacaaagaaatttggggaagaggtttgtggatggacctctctggtcaaaacccacaaagatatttgtatcccatgtgagtgcccaccaatgggtgatctaagcagaggaggattttaataatcaaataggatgacccgttctgtggacaccactcagtctgttttcccagccacttctgtcatcgcccaatgggccaatgaacaaagtggctatggcagtagggatggagggtatacataggcttagcaacatagactttcactcaccaaggctgacctggctatggccacttctgagtgcccaatttgccagcagcagagaccaacactgagctctcaatatgacaccattccttgggcgatcagccagctacctggtgacaggttgattattggacctcttccattatggaaagggcagaagtttgtcttcactggaatagacacttactccggatatgggtttgcctatcctgcatgcaatgcttctgccaagactaccatcatggagtcacagaatgccttgtccacccttatggtattccacacagcattgcctctaaccaaggcactcacttcatggctaaagaagtgcagcagtgggctcatgctcatggaattcactggtcttaccatgttctccatcctgaagcagctggattgatagaatggtgtaatgaccttttgaagtcacaataacaatgccaactaggtgacgatactttgcagggctggggcaaagttctccagaagactgtgtatgctctgaatcagcatccaatataggatagtgtttctcccatagccagaattctcgagtacaggaatcaaggattggaagtggcagcactcaccatcacccctagtgacccactagcaaaatttttgcttcctgctcccacaacattatgttctgctggcctagaggtcttagttccagagggaggaatgctgccaccaggagacacaacatcgatttcattaaactagaagttaagattgccacctggatactttgggctcctcctacatttaagtcaacaggctatgaagggagttacagtgttggctggcgtgattgacctggactatcaagatgaaatcagtctactactccacaacagaggtaaggaagagtatgcatggaatacaggcgatccattaggatgcctcttagtattaccatgccctgtgattaaggtcaatgggaaactacaacagcccgatccgggcaggactacaaatggcccagatccctcaggaatgtaggtttgggtcactccaccaggaaaaaaaaacacaacctgctgaggtgcttgctgaaggcaaagggaatacagaatgggtagtagaagaaggtagtcatcaataccagctatgcccacgtgaccacctgcagaaacagggactgcaatggtcatgaatatttcctccttcttttgctaaaagtcatgtttgtgcatgtatacacttggactaagaaaatacctttattttatttccttttcctttatcatgtgacataagatttattgacttcatgtcagcatttaagttttattaactttatgtaatagtacttggggattggtgcgtttctggttgtacgaaggatcattgtattatgttggtgtaattatgaccttattattgtctttgtttgaagattatgtatgatctcaggagatgagtatgggttcaagttgacaaggggtggacttgtgatggttaatactgagtgtcagcttgattaaattgaatgatacaaagtattgatcctgggtgtgtctatgagggtattgccaaaagagattaacatttgagacagtggaccagggaaggcagatccattcttaatctggtgggcacagtctaatcagctgccagcaaatataaagcaagaagaaaaatttgaaaaggagagagactggcctagcctcccagcctacatctttctcccatgctggatgcttcctgccctcgaacatcagattccaagttcttcagttttgagactcgaactggctctcctttctcctcagcttgcagacagcctattgtgtgaacttgtgattgtgtaaattaatacttaataaactcttatatatatatatacacacacacacgtatatgtgctattagttctgttcctctagagaaccgtgactaatacatgtatctatcgagataacaatattatttttgtttttcattctgtttatgtgatgtatcacatttattgacttgcgtatgttaaaccatccctgcatccctggtatgaaacccacttgatcatggtggattatctttttgatatgctgttggatggattaaccagtattttgttgagaatttttgcatctatgtttattagggatattggtgtgtagtttacttttttggttatgtcttttcctgcttttggcttcatagaatgatttagggaggatgccgtctttaccttttgaaatagtttcagtaagattgagaccaattcttctttgaatgtctgatggaattcagctgtgaattcatctggtcctggactttttttggttggcaatttttttttattgctctttcaatcttgctacttgttattggtctgttcagtttctgttttttcctgatttaatctggagggttgtatatttccaggaatttatcaatatcaatctattctagattttctagtttgtgtgtgtaaaggtattcatggtagccttgaatttctgtggtatcagttgtaatatatcctgtttcatttctacttcagctcgtttgggtcttttcttctcttggttaatttcactaatggtctatcaattgcttatcttttcaaagaaccagctttttgtttcatttatcatttttcatgcttcaattttatttagttctgctcagatctttgttattttatttcttatgctgggtttgagtttggtttgttcttgtttctctagttccttgaggtttgaccttagattgtctttttgtgctctttcagacattttcatgtaggcatttaatgctatgaactttcgtcttagtacttcttttgctgtattccagggttttaataggttgtgtcactattatcattcagttcaaagaatttttaaatttccatcttgattttaatgttgactcaaagatcattgaagagcaagttatttaatttccatgtattcacacagttttgagggttcctttggagttaatttccagtttcagtccactgtggtctgagagagtacttgatataattttgattttcttaaatgtattgagacttactttgtgacctatcatatggtctaccttggagaatgttccatgtgataatgacaaaaatgtatattctgcagttgttgggtagaatgttctgtaaatatctgttaagtccatttgttctagggtatagtttaagtccattttgtctttgttgactttcttgatgacctgtctagtgctgtcagtgaagtattgaagtcccccactattattgtgttgccacctatctcatttattagatccagtaataattgttttataaatttggaacccctagtgttaggtgcatatatattaaggattgtgatactttcctgttagactaatccttttgtcattatatagtgttcctctttgtctttttttttttaaactgttgttgctttaaaggctgttttgtctgatataacaatagctactcctgctcacttttggcttccatttgcatgaaatatttccacccctttaccttcagtttatgtgagtccttatgtgttaggcattctcttgaagacagcagatactcgattggtggatttttacccattctgccaatctgtatcttttaagtggagcatttagattattgacattcaacattagcattgagatgtgaggtactattttattcatcatgcaggttgttgccttaataccttgttttttccatttcatagtgttgttgaagagtgatggctaaatgtatccagcataattcacctacacttagttttctagataattgagttgggtggccccattttaataatgacaaacatgaaattctaaatgcaatatcatcttggagagattatttgattttttcctataggaattgtctccaaactgctttctagacagcctcacaaagcatctagaatgtataaatttgactttcataatgcattaatgatatggtttggctgtgttcccacccaaatctcatcttgaattgtagttcccataattcccatgtgtcatgggagaaatgtagtgggagttaattgaatcatgggggcagatcccccatgctgttctcatgatagagtgactctcatgaaatctgatgcttttataagcatctgacatttcccctgattacactaattctctcttctgctgccatgtgacaaggtgccttctgccatgattataagtttcctaaggcctccccagcaatgcggaactgtaagtcaattaaacctctgttgtttataaattacccagcctcaggtatttcttcatagcagtgtgagaatggactaatacagtaaattagtaccaggagtggggtgctactataaagatacccaggaatgtggaagtgactttggaactgggtaacaagcagaggttgggacaggttagagggctcagaagaagacatgaacatgtgggaaagtttggaacttcctagagactcagagggctccgaagacaggaagatatgggaaagcttgaaacttcctagagacttgttgaatggttttgaccaaaatgctgatagtaatatggacaatgaagtccaggctgaggtggcctcagatggagatgagaaacttgttgggagctggaataaaggtgattcttgctacgctttagcaatgagactggcagcatttttcccctgccctagagatatgtggaactttgaacttgagagagatgatttagtgtatctgccagaagaaatttctaagcagcaaagtgttcaagaggaagcagagcataaaagtttgaaaaattcgcatcctgatgatgcaatagaaaataaaaacccattttctggagagaaattcaagcccactgcagaaatttgcatcagtaagggggagctcaatgtcaatcaccatgacaatggggaaaatatctccagggaatgtcagagactttcacagcaacctctcccatcacaagcccagaggtcatccttaagtgaaaaaatcaaccacaggagatgacatgataataggcttattacagtagaggaaggtacaaagtgtttctcatcattggtgtgtttgttaaaatggggaggggttactgagtgagtgggcagtgggtggtggtggtgacaaccacattctctcactgtggcccaacacttttgaagcagtttcccatttctccattagatgtgtcttctccacatgcagaaaatgtagtctcatagcttccctattgggtgctggactgttggcatttcattattttttttaaatcaaagacatggatatcttttttcttagttgatttctaggacttcaaggttatttgggggaagaagttgcttgaggaggctcctgggtggaccatggagtccctcctagggatttatttggtgctcctggtgtgggtgactatctccctgagtcccaaaagacagcacattctgccgggtacccagaggtggggacagatgctaacaggtccatcttataagtgcaacatgaaatttaaggtcagggaatctcttaacttttcttgaaggacctcatatttagcttcttgactcaaaatcatttgtggatttgaacaggtttcctctgcaatgtactctctggaggggaatacattgaaaatacagttcattttcagatactcaatgggattgaaaagttgaattgtgtgctttcttgcagtgagcacagaggaatttgctgtcccatgccactgggacatttttaggagcaccattctcttccagagggcttgagtaaggtcagtgaggaattaacatgtagcatattggcaactccagggttgagcagggagacacacatgtttttctgatgtgtgaagttctgagggcattttccaaagtacttgttcactgagcaggtgtttccactacttgcattaagtcaggggatatggaagccacttttccagcaatcaaactcaatgagaagatgaacaagaagtgttctgaaagtaagcagaaaaggccctttccatgaattttcctaatttttagatttctcttaaacaacatgcctgaagttacaaccgcatccttctctagcagcttctaaatgagaaaatcatcaaaagggtatttagtactcaagtggtggacacaggataaatgctgaaaatcagtgctcgattcgaagatagtgatgttccaggatgttggagtctctcaggtgtcagtagggaggcgggccgggaacttctcccagtaaccagaaagaagagcctcagggagatgaggatgtctcacagccagggacgggacagtaaagggccccatgtgagtgcatcacagggatctgttcctgtttagactccaatgctcagtacccagtgcagaacatggcaagacttcagcaaatacatcagtcagctggatgaaggaggcaggtgtgagccagcaaaaaaaagcttgtgattttattggagcatgaatttaaaagtgttgatgtggctgggcgcggtggctcatgcctgtaatcccagcactttgggaggccgaggtgggtggatcacgaggtcaggagtacgagaccagcttgaccaacatggtaaaaccccatctctactaaaaatacaaaaattagccgggcatggtggcagacgcctgtaatcccagctacttgggaagctgaggcagagaattgcttgaacccaggaggcggagattgcagtgagctgagatcatgccactgcactccagcctgggtgacagagcgagactccatctcaaaaaaaaaaaagtgttgatgtacctaccttgcaaggaggtagataggtagacagaagcatggatagatggatggatattctttttctgtgtttttctatttctgttctttctctgtgttttgtctctttctcttgctctgtctgtatcttccactgttccttcataatcatgtcttagccatcatcagtgacatcttttatctggtcttataagatcttgtctgtctgttgtattagtagccacaggacagaaaaaggaaaggagtcgtgaaaaacaagataaggaaaaagatgctcctgacatggggcatcgggaggatgtgtggccctgaggctcccgggagacaggggctgcgcctcactgcagagtccatcctgctgaacacagaggggaaaagcgccctgacagccccgtccgtgctgctcagaaaagacggctccgtctccagatccttctctctatgtccttcagtcttggctctctaggtacaatttactgctatgaaaagggatttgagaattcccagaggaggctttcagcctctttgcatggctctttctggcctttcaaaagcgccagagacatcagaaatgaaatcgtacacacttattcggagttttccacaatcattgaaatttctgtgagtgccaaagttaagtttttggcaaccccgtcaaagccgggtgtgcccaggacagtcaactcaggcgctggactctcattctggttggattttatgacagccgtattcgccataagaattctagagccagaccttgttacttcacaattgcctcacgttgcaggacaagcaaatctagcctgagtcctgtggattccagggctgctcaggagacgcctccatcctggcgtggatgacctcaggatcagccccgtctgccccactcagcccgcagcctggtccccgaaagcgctcagtcagaatccgagagcactgtggcggcgcccccgtgtggccacaggactgaagacagaggaccccgctcccctttctccccagccaggacgtcccaggctctccccctgttccccgcacctggacgggactctgcacagaagagagtctcccggtctcgtgtcaggctctgagttcatccagcttcccaaaatccatgttgatatgaacgttttctcccacaactgattgactggacttttgtctcagggcagagggaggcctccagaccaaaacagcaggatcaggtctggagctgactcaaccccaaacccttgctaatgcacgacccagtcccccagcctccaggatgggaccttggcctcctgtcccctcccttgttcctgccactgctcctgcaggtggaggctgctcatcccaggaatcagtctgtgagctccaaccttggggcctcggtccaggaaggagggaggctccagagagcagaagggagatgaaatggatcataagagaagaaggaatcataccaaacactggaactgtaggtcaattaaacctttttctttataagggggggggaggaagaggaggaggaaaaaggaggagggtgaaaggagtcagggaggagagaaaagtgggaagtgtttctttagaaggggtgtgtgtgtgtgtgtgtgtgtgtgtgtgtgtgtgtaggtgtgtgtaaagcaggagggagttcctaggatcctgaagaaaagagagtgaaggacaggggctaaggggcccagccctggtaggttgagggccccactttctgtgctcgggccttactgtcctagcagagtccagccccgggaagcctggggtcacagcactcggcttgctggatggctgcctcttcattgtctttgacagcaggagctaccttgccaggcccagtggccacagggtcacaggcagagagcaggtccctctgctggcagccaaggagatgctcttggaggatacgtgcacaacttagctgggagtctgaagatggtggtgggttacaaagagctcagcgatgagcctggcccaagattctgaccccttgccctggatcctgagggttccacccttccctattcccaacaggtctcaagaattcttctgttagtctcctgccctcttgggacagccccgcacttccctcactttgataccctggtacccaggcatctgcctccttcattctcctccagctacccaagcacccccaggccctgctctctgccaaccctgatccctgaactccagcactttccaaacccacccccgaattgctggataatatagtggttctatttttagattttttaaaactctccatactgtcttctatagtggctgtactaatttaaattcctatcaacagcgtacaagagttcccttttctccacatcaccagcatctgttattttattttattttatttattttatttttgtcttttcagttgtggctattctatctggggtaagatgacatctcattgtggttttgatttgcatttccctaatgattagtgatgttgaacatttttttatgtatctgttggccatttatattcttcttctgaaaaatatttattcatgccctttgcccactttttaataagattgtttggttttttaattcttgagttgtttgagtttcttatagtattctggatattagtcccttgtcagataaattgtttgaaaatgttttctcctgttcagcagattgtctcttcactctgtcaattgttttatttgctatgcagaagcttttttagttattatagtcctatttgtctggttttatttgtgttttctatatttttgaagtcttagccataaaacctttgcccggaccactggcctagaatgtttcccctgttttcttccagttgttttatagtttcaggtctttcattttatttaagtcaacttgagttgatttttaatagggtgagagataagaatctaatttcattcttctgcatacgggatatccattttcccagcccttttactgaagagggtgtccttttcccaaatgtgtgttcttggcacctttgttaaaagtcagttggctgtaaatatatggatttatttctgcattctctattatgttccattgattggcatgtctgtttttatatcaataccattctgttttggatactatagccttgtaatgtattttaaagtcaagtagtgtgatggccctagctttgttctttttgctcaggatttctttggctatttggactttttaaaaatgttttgggtccatagaaatattagaattattttttctaattctgtggaaaaataaccttggtatttttgttggaattcccttgaatctttagattgctttgggaactatggtcattttactaatattaattcttctgattcatgagcatggaatatctttccatttgtttgtgtcctcttctttctttcatcagtgttgtatagatttatttttaagagatctttgacttccttgcataaacttattcctaggcatttttttctagttatcgtaaatggaattgcttttttgatttctttctcagctacttcattaataatgtatagacattatactgatttttgtatgttgattttgcatcccacaactctactgaatttacttatcatatctaatagttctttgatggagtcttcagatttttctagaaataggatcatttcattggcagggaggggagagaggctgaaggttaagctgatggccaatgatttaatgaatcatgcctaagaaatatgacttccatcaaaacccaaaagggcagggtttggagagcttctggatagctgaacacagggaagctaacaggagggtgaacaagaactcagccatgtgccagagagggtggcgcatcccaaccccatgggacagaagctcctgcactggaaacccttctgaccttgccctatgtgtctgttcatggggctctttatttgtgtcttttaaaatatctttttaaataaactggtaaatatatgtaagtgttttcctgagttctgtgagccattctagcaaattaatcaaacctgagaaacgggttatgggaacactgatttaaagcaagttagttagaaacacgggcaaaatggcttgagactggcatcaggagtgggaggcttgagactggcatcaggagtgggagggggacagtcatggggactgagctctcaacccatgggatgcgatgctatctccagggaaagagtggcagaattcagttagaggacacccagctggtgtccatcacagaactgattgcttgtttgttggagaaattccctacatttggtcagagaagtcttctgtgttgatagttgttgtggtgtgagagtagtggaaaacaatgtgagattttccacactcagagtggatctaaatgttgagttgcttttaaatttgacttagtcgtggcctgactaaacaggattagatgtgagaaattttttggtataatgtataggaaggaactaaaggctgatgaggatgggagtgttggaatagatgttctgtgcatgagtacccccttcatcctctctgtctcccaagaaccaaaaaatactctctctgcagctttaacaaatactggtttggaagagagtgactgcgtttttcaaagttctaaatggctatgattgcaggacctttgtgatgctcaggaatgtcctgatgtcagcggagatgaaggaaaaccagagattcaaaagtcaaaggaaagggccatttaccataattcatatcatacatatttcctggaaaaaaaaagaaaaattccttggggaaaaagcatcaaaatcatcaggaagtcttccacacagaaatgacttcattaatttgatctctgtcattctttcttttcattcatgtattattatccatagagatttctatcctgtgggttttttatttaatttttgtttgtttggttttttcagacacagtgagaccctgtctcaaacaaacaaacgtcacaggctgcagtgcagtggcacaatcattgctcactgcagcctcgacctccctgtctgaagcaatcctccagcctcagcctcatgagtagctgaaactacaggaacatgccaccatgcccaactaattttttaaaaaatttttttgtagagatgaggtatcactatgttgccgaggctggtctcaaactcctgggttcaaacaattcacccaccttggctccccagaatgctgggattacaggcctgagccacgtacccagcctctatcccatgttttgattcatcatcatctcctaagccctttcccagcatcgatagtctactaaacatgccatgattaaattatatctctataccttgatataaacaaaaaattatatgagcagtaaagacaaatatgaaaaagtaaaattactgccaaagttattaggaggataacctaaattatttgggtaggaaaatctttcttttttattttatttttttttccagccagggtctcattctgtcactcaggctaaattacagtggcccgatcatggctcactgcagccttgacctcccaagattcaggtgatcctcttgcctcagccccctgagtagctgagacaacaggcatgtgagacaatgcctggctcctttttatatttttagtagagatggggttttgccatgttacccaggctggtctcaaacttctaggctcaaacgatccacccacctcagcctcccaaagtgctggtattacaggcatgaggcactgtgccagccttttttttttttcacatctgctggaatggaaaatatttcttaaatgagacacaaatgtatcaaattgaaaatgtttaaacttcaaaggacttacatacatatacagtcattcttcgctcaatggtgagatagcttctgagaaatgagtccttaggtgattttgtcatgtgtggacatcatagagtgtccttacatgaacctagatggtataacctacttcacacttaggctacgtgataagcccattgcttctaggctacaaattatatagcatgttaccgtatggaacattgcagccaattctaacacaatggtaagtatttgtggatctaagcatgtgtaaacagagaaaaggtacagtaaaaatgtgattaacaaaaagatctttaaaatggcgtatctgtctaggacacttaccatgaatggagcttgcaggactagaagtgccctgggtgagtgagtgagtggtgagtgaatgtgaaggctagggcattactgtacactacttagactttataaacttaggctacactaaattgattttaacattgtctttctttaataataaattaacttattaataattaactaataattttattatttatttattaacaattaataactaattaataattagttaccatagctttctgtaaccttttgaacttttttgttttattattatactttaagttttagggtacatatgcacattgtgcaggttagttacatatgtatacatgtgccatgctggtgtgctgcacccattaactcgtcatttagcattaggtatatctcctaatgctatccctcccctttcctgccaccccacaacagtccccagagtgtgatgttccccttcctgtgtccatgtgttctcattgttcaattcccacttatgagtgagaacatgcggtgtttggtgttttgtccttgcgatagtttactaagaatgatgatttccaatttcatccgtgtccctacaaaggacatgaactcatccttttttatggttgcatagtattccatggtgtatatgtgccacattttcttaatccagtctatcattgttggacatttgggttggttccaagtctttactattgtgaatagtgccgcaataaacatacgtgtgcatgtgtctttacagcagcatgatttatagtcctttgggtatatacccagtaatgggatggctgggtcaaatggtatttctagttctagacccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgggttttgatttgcatttctctgatggccagtgatggtgagcattttctcatgtgttttttggctgcataaatgtcttcttttgagaagtgtctgttcatgtccttcgcccacttttttatggggttgtttgtttttttcttgtaaatttgtttgagttcattgtacattctggatattagccctttgtcagatgagtaggttgcgaaaattttctcccattttgtaggttgcctgttcactctggtggtagtttcttttgttgtgcagaagctctttagtttaattagatcccatttgtcaattttggcttttgttgccattgcttggtgttttagacatgaagtcctttataaactttttaaacttttctactcttttgtaatagcacttagcttaaaacgtcaacacattatacagctctacaaaaatatttttctttatattcccattctagaagcttattcctatttaattatctttaccttttaatcttttttggtaaaaataaagacatacattagcataggctgacacagggtcaagaccaacaatatcaaccatcttcagccttcacatcttgtcccactggaagattttcaggtgtaataacacgcatggagctgcatctcctatgataacaatgccttcttctggaatacctcctaaaggacctggctgaggctgttttaatttttttatatatatagaaggagcacactctaaaataacaataaaaagtatagtaaatacataaaacatagcatagtcatttattatcattatgaagtattatgtactgtgcatagctgtatatgctagactttttataggactggcagtgcagtaggtttgttgacagcagcatcaccacaaacacatgattaatgcatcatactatgaggttatgatggcttcaatgtcactaggtgataggaatttttcaggtccattaaactctcatgggacgacagtcatatatgcaattcatcattgacccaaacatcattatacaatgcatgactctataacacagtggggtgtgtgtgtgtgtgtttgtattttgtgtgtaagattaacactgaaattgaggtatcaactaggcaccaaggtaaaaacatattaacttttcctgtgaggtgtcaaattaccccatgcagaatttgaaatgcaaacgaccattggaggcttagaggtcttcgggttcaaaccgtcagagaatagctcattttaaactcatcctcccacagtaaacaagtataaaagtcacaaaaaacatacaatgcagttgtgcagccacaaaacagcaaccagcacaggactatcaccttttggagaatggaagttcctgaaagggagattcacatccttatcagctttctttccagaagcatttgccaaaatacaatgaagagaaatggaacccaagcagagaaaatcagtctcatcggcaaaggaaacagagatcagagttcaggcttggcacattgactgggatttaggggtagggtgctgagggagggagttacagacaagaaacccccaaaatctgcactcctgagctgcatatgctccagatgacactctaagaagcccactggagaacagcttcttggagattgcatgctaagtagaaatgtcacaggctccatagtgtgaggagatgttggaatttcagccctgcaaaacctgtgttgagacatcaggatggggaagccgtgtaagtgaggaccgtgaccttggagtaagaaccacactgaaatagactcaccctagcaaaggctaaaatcaagaggaagcagaatcaaagtgggtctgatttttactaaaggtgattctttgataattacctaactgtcaaactattaccagtctttggaggaagataacaaaacccagagcctctaaaatccatcatgtagaatatgtgccatgccaagcagcagagagaatgcagcaactaaagaagaaataatcaacagaagccaactcaaagatgatctgaatattgaagtcagcaaacaaggacattcttcaaaatatttatgattaatatgttaaggaaaatagaggaaaagatgggcaaactatttcaaaattcccagaaagattaatcataagaagagagaaaacacaaatgaacactatgagaagggacattataaaactgtagattttattaaaacaaaaataagagaaagttagacacaacttcatggaaagagcttttaaaatttaggtatagtgacatgagttcttgaaaaagacggttgaacaaagccaacagaaaactaagtagaaaatataaataatcctatatccattaagaaattgagttctaaatacattccttcccaccagagaaactccatgcccagacttcttcacctgtcaattctttcaaaaactttttaaaaggcatgtcagccttatacagtcttcctctggtaccttttgggatgggttctagggcacctgtggataccaaaatccatggatgctcaggtcccatatataaaatagcctagtatttgcctattagctatgcacatcctcccatatactttaaatcatctctagattacttataattcctaatgcaatgtaaatgatttgtaaatagttgttacactgtattgcttaggaaataatgacaagaaaaatgtctatacatcttcagtacagacataaccactgtaggtactcctaactacagagtatacatcagcaacaacataacattttcaatcctaaggttgttgaattcacagatgtggaactcacagacatgaaaggcagactgtgtgctatggtttgtctgtttgcccacccaaatctcatcttgaattgtagttatcataatccccacgcgttgttggagggactcgatgggagacaatttaatcatgggggtggttcccctcatgctgttctcatgatagtgtgttctcacaatacttcatggttttataaggggctttttctgcttcggtttggcacttctccttgttgctgccatgtgaggaaggatgtgtttgcttcctcttctgccatgattataagtttcctgaggcctccccagtcatgctgaactctgagtcaattaaacctctttccttttaaattgcccagtcttgagtatgtctttattagcagtatgataacagattaatacactgtcttatattttttagataataaagagtaaacaccttccaactaattttatgaggcaacataagtcagacaaggacctaaacatgacaattatattacaagaaaaataaactcatcatcaaaatgatctgatgaacatagccaccaaaattccaattaaaatattagtaaatagaaccaaataatatatgaaatggataacacataatgaccaaatgggatttataagagaaatacatggtagatttaacttcaaaatgtcagaataatctaccccaagaatagagaaaagtaggacaacatgtggttatatcaatagatgcaggaaaaccatttgataaagttcagtaggcattcataataaaaactaaataaactagacataaaagggaacttccctaacagaatacagttatttacaacaaagaaatacaaagaaatacctaaatctaaagtcataattaatgaagaaatattaaacactcctctgaggtggggacaagagaaggatgtccactatcatcacttttatttaacattgtactgtgtgtccaacagcaaaaatagattacataagatatatgactgtcttcttcaaggaaaacattatcgtgtatgaagaaaatttaagaagctctatgaacagactattaaaaataagtgaatttggcaaggccagtataaagcaaaaagtaacatttctatacgtgagtaataaacagtgagaagaactgacattctttaaatagctctatgtacaataccacaaagaaacataaattgtagaaataaatataaaagttatacaaaatctcatcattcagaattacaaaacattgctgagacaaattaagtggatagttatttcatatatatgaagaagacaatattgctaagataccgtttatccacaaagtgatccatggagtcaatgcaattgtaataaaactcccaacagttttttttgtgggaattgacatgctccttctaaaatgtatacaaaaatgtgaggagcttaaaatagccagaacaatattggaagagaacacaattggaggacttaaactatcagatatcaacagatatttgaaagccatagtgattagaaaagtgaagtatttgttcagggataaacaaacaggaaaaaattattaaaatagagccctctctattttcttctatgagttttataatttagcccttacatgtaggtctctgatccattttgtgttgatttatacatatgctgtgaggtagggtttcaacttctttgttttttttcttttgcagagacagtgtctgtgtcacccaggctagagtgcagtggtgcaatcagagctcatggtaaccttgaactcctgggtccaagcaattctcctgtctcagcccctcaaaatgctgagattgcaggtggagtcaccacttccagcccctcaacttcatcctttagaatgtgggcatccaggtgcccagctccattagatgaagagtgtatactttaacacattgagttgtcttaacacctttactgaggttctttgcatatatctctttatgtgtctctgagctgttgtctagtgccctttcattttaatctgaatgactcacattagtatttcttataggaaaaatctactggcaatggaatctgtcagttagttgttaattaactggaaacatctcaatttctccttcatttattttaatttattaattgtgataaaatgcacataacataaaatttaccatcttaaccatttgtagtggtagtgttcagtagtgctaagaacactcacactgttttgcaaaccaatctccagaactcctttcatattgcaaaactgcatattttcatttttgaagaataagttttctagatatagaacttttggttgacagctttatttttgtagcactttaaacatgtcataccactctgactttcctcagtgttttctggtatgaaattggctgttaatctcaatgaggatcccttgtacatgatgcattatttgtttcttgctgctgtccaagttctctctgcttctatttcaacagtttggttataatgtttcttggtttggatgtctttgagtttattctgcttggtagattcacagatttttatcaactttggcaaggtttcacctgttaccctatatttttactctctctttctatctctcctctactttgggaactcccattatgcatctgtcagtccacttgatgctgtacagaggtgtcatagcctctgatcatttccctttatttttttttcttcctgctcttcagattgcataatcgtaattggcctatcttcaatttgctggttcttctgcctgctaaactctgcatatattagtcagcatggcagtgtcccacaagtcccttaggctctgttcactattttttgttccttttttcatttctattcctcaaagtctatgatttaagatgacttggcttcgagtttgctgattctttcttctacctgttcaagtctgctattgaacatctctaatgaattttttttcagtaattatattttcccttctagaattgctgtttccttattatatatatatatatttttttttattttaatttttattttttttattgatcattcttgggtgtttctcgcagagggggatttggcagggtcataggacaatagtggagggaaggttggcagataaacaagtgaacaaaggtctctggttttcctaggcagaggaccctgcggccttccgcagtgtttgtgtccctgggtacttgagattagggagtggtgatgattcttaacgagcatgctgcctttcaagcatctgtttaacaaagcacatcttgcaccgcccttaatccatttaaccctgagtggacacagcacatgtttcagagagcacagggttgggggtaaggtcaccgatcaacaggatcccaaggcagaagaatttatcttagtacagaacaaaatgaaaagtctcccatgtctacttctttctacacagacacggcaaccatccgatttctcaatcttttccccaccttttccccctttctattccacaaaaccgccattgtcatcccggcccgttctcaatgagctgttgggtacacctcccagacgaggtggtggctgggcagaggggctcctcacttcctagtaggggtggccgggcagaggcgcccctcacctcccggacggggcagctggccgggcggggggctgacccccccacctccctcccggacgtggggctgacccccccacctccctcccggatggggcggctggccgggcggggggctgaccctgccacctccctcccggacggggcgtctggccgggcggggggctgacccccccacctccctcccggagggggcggctggccgggcggggtgctgatccccccacctccctcccggacgggtcggctggccgggcggggggctgagccccccacctccctcccggacggggtggctggcctggcagaggggctcctcacttcccagtaggggcggctgggcagaggcgcccctcacctcccggacggggcagctggctgggcggggagctgaccccacctccctcccagacggggcggctggccgggcggggggctgaccccccccacctccctcccggacgtggggctgacccccccacctccctcccggatggggcggctggccaggcagaggggctcctcacttcccagtaggggcggctgggcagaggcgcccctcacctcccggacggggcggctggccgggcggggggctgacccccccacctccctcccggatggggcggctgccgggcagggggctgaccacccccacctccctcctggacggggtggctggccaggcagaggggctcctcacttcccagtaggggcggctgggcagaggcgcccctcacctcccggacggggcgtctggccgggcggggggctaacccccccacctccctcccggacggggcggctggccgggcggggtgctgatccccccacctccctcccggacgggtcggctggccgggcggggggctgagccccccacctccctcccggacggggtggctggcctggcagaggggctcctcacttcccagtaggggcggctgggcagaggcgcccctcacctcccggacggggcggctggctgggcggggagctgaccccacctccctcccagacggggcagctggccgggcggggggctgacccccccacctccctcccggacgtggggctgacccccccacctccttcccggacggggcggctggccgggcggggggctgacccccccacctccctcccggatggggcggctggccaggcagaggggctcctcacttcccagtaggggcggctgggcagaggcgcccctcacctcccggacggggcagctggccgggtggggggctgacccccccacctccctcccggatggggcggctgctgggcggggggctgacccccccacctccctcccggacggggcggctgccgggcggagatgctcctcacttcccagacggggtggctgccgggcagagggactcctcacttctcagatggggcggatgctgggcggagggtctcctcacttctcagacggggcagctgggcagagacgctcctcacctcccagacggggtcgcggccgggcagaggcgctcctcacatcccagacggggcggcggggcagaggcgctccccacatctcagacgatgggcggccgggcagagacgctcctcacttcccagatgggatggctgccgggaagaggcgctcctcacttcctagatgggatggcggccgggcagagacgctcctcactttccagactgggcagccaggcagaggggctcctcacgtcccagacgatgggcggccaggcagagacgctcctcacttcccagacggggtggtggctgggcagaggctgcaatctcggcactttgggaggccaaggcaggcggctgggagatggaggttgtagcgagctgagatcacaccactgcactccagcctgggcaccattgagcactgagtgaaccagactccgtctgcaatcccggcacctcgggaggccaaggctggcggatcactcgcggttaggagctggagaccagcctggccaacacagcgaaaccccgtctccaccaaaaaagtacgaaaaccagtcaggcgtggtggcgcgcgcctgcaatcgcaggcactcggccggctgaggcaggagaatcaggcagggaggttgcagtgagccgagatggcagcagtacagtccagcttcggctcggcatcagagggagaccatggaaagagagggagagggagaccgagagggagaggggagaggggagaggggagaggggagaggggagaggcagaggcagaggcagaggcagagcaggaattcagatttttttttttccttatatttttaatgagtctttatttggtgagatattgttcttctggttcctttacatatatacatatatatatacacacacatacacatatatgtgtatatatatacatatatatatacacacacatacacatatatgtgtatatatatacatatatatatacacacacatacacatatatgtgtatatatatacatatatatatatatttacatatatagagagagagtccacggtcttttttatctatttgagcatatttaaactattggtttaaagtcttggtctagtaagtccaatgacttggcttccttagggacaggttctgctgatgtatttttttctgcaaatgggccactttcttaaacttctaaatacctcaagaattttcgctgaaaactgaacactttgaatacaacaatctagtaactctggataccatattctttccactccccagagtttcttgttgccacttgaggatggagttgtttcttagtgacttttctaaactattgttaagctgttctatgtcatgtgtggtcactaaaatctattctgttagcttcatggtcagctagtgatttgacagaggtttccttaaacagctggagccaaaaaaataaataattaatgccctcccaggttttgcagatggactctgagttgggacacttcttcaacacttaaccaggcagtttagacgtccaccttaaccttcactggctgcttacttggaggctaaagatcacccagaggtaaaagcctaaggtcatctcaggtctttttaaagagtgtgggcatccagggctaaatatccagtgtttagccctggccatgtatgtgacattctgatttcctcagtatatgcgggatattttgaaagccatattgccttatgtatctccatctccagcctctacctccctaggcttttcagtctgtctgctgttaacccatccatcattccatgccccaggcatctgtgactagtatttgcctttaaatgcttttgacaaacattgctatggagacctctccaatcttaataaagttccaagaggagtgaagcaaagaccagcctctaagctgatctttttgggggctatcatacatgtcaaaggacacaaacacaattctttgaaaagaaagttcattttgccttttctggcatcaggaaactacaccaggaatgtgggacaccgtccccatggctgcctcatagctgagggtgtgggggtgggagtgagtaggtggctaaggaatagtggcacatgctctcctaccaaaatctagagctcctttttcattaagcactactttggttgttgtaaaaaaaaaaaaaaaattcatagactccagagtacagaaaaacttaattttgatagtttttttccaggttaatagttgctttagttggggaatgtgttgttggagttctctaccatttttggtgaaggcattacagttgtcttttaataagattttaaaattatgaaaaaatcttatgtatctacccatgtgcttaccatttctggtgctcttcattacatatttgcttttggtataattttctttttgcctgaaggactgaaacacttattacagttcgtgtctgctggttatgtattttttcactccctataagtctaaaatccctttttttatagatatctttagagtctgttaagtagcttgatgcaatcattacacatggtatacatatatcagtacatcacacagtacctcatgaatgtattattatatgtcaattaaaattatacatatatatatgtttttaaaaggttttttttctggaaatagaatctagtttgacagcagttgtctttcagaactttagcgatgttggtcatctgtccctcatttgcattgtttccaatgaaataactgctgtcatctttattattcttcttatgtgttgtgttttgtgtttttcatttttgctttctgctttttcaattttctctccttctctggttttgaacaaatacatgttactctcactcacaactataaagcgaacttaggaaacaatctatagggagagtttgttgatgattggttatacattttcagaaacagttgtttattccttcctttacaaaggctaatttccttagaatattattgtattgaagaatgtcataaataattttatttgtcacctggacctggtgccaagatacgtggtcaagcattattctggatgatctttttaggatgtttcttggatatgattaacatataaattgctatactttgagtaaagtagattgacctctataatgtggacaggcttcattcaattcattgaaggtgtaaattgaatgaaacactgaccttccccaagcaagatggaattctgtcctgggatttgaactgcagtatcagtcacctgacccataaagagctggttggtttgtgtacagcatttgcaagatgaatggacaacaccctgtttggaagtctacccctttgatcaaagaagataaaaacagaacagctcttgtgggctgaattgcagggtgttttcttagcagtgatggaagaattgaacaatgataaaagctcctatgttttagttttactgacttatgggcagtgactgatggcctggccatataattaattaagaaagcagtggaaaactggcctatgaaaagaatgcccatatgagacacagtcctatggaaatcactatggtaatttgaggggtgcattaacgtaagacatgttgatgcctgatatagattggatgttgtccccacccaaatctcatgtcgagatgtaattcccagtgttggagttggggtctggtgggaggtgactcaatcatggggtggtttctcatgaatggtttagtaccatcccctcagtgctgttcaatacccatcagaataactcccttccaggtttggaaggtgattgaaatcaacaagcatttatctctaagtgcttgccaggtgcacctgtagtcccagctatgagagtgtctgaggcagaaggatatcttgagtacaggcatttgggtttagcctgagaaatatttgagtctagcctgggaaacatatcaagaccacatctcaaaaaaatttacatttgcttgtgaagatcaccggggtctacgaaataagtagacactgaggctgtagcaatgcagagatgggctgaatcaagacatactccccttgcatcccccacctctaataagcacaaaatactcagtaaaactgttctttttaacaagactgggcacagtggctcacacctgtaatcccagcactttggcaggccaaggtgggtagatcacttgagatcaggagtttgagaccagcctggccaacatggcgaaaccctgtctcaactaaaactacatcaattagccaggcatggtggtgcacgcctgtaattccagctactcaggaaactgaggcaggacaatggcttgaacctgggaggcagaggctgcagtgagccgagatggcgccactatactgcacccagggcaacagagcaagactgtgtctcaaaagaagaaaaaaaaagaagtattctctttaacaagaaaagagacagagacagagaccaaaaaaaaaaaaaaaaaacgtgaatgggaggtattgccaccatgtggaccactgagccacattacactaggaaacacacttgcccagaatgtccaacaatggtcagagaaatttgttcctcagaagaagagtttcagagagaattaaaatagtcatttgaaacattgagtgtataaatcaggagcggggagacataagcatgaagggcgggcctatacaccttcatgagtgtgctcgctcttgacatgagtgtggacaaaggaatgtccccactagagagtgtcctctttttccctgctggatcagggaaaggtgctggtgtgattctacataca

SEQ ID NO: 364 - DNA, 83072 bp, Homo sapiens
ctggtaaagtaacattagaaatgtcctaagaattgccagcatacattttgtttgcatttattaatcaagcaatttcatacttatccctgacaaatactataaggtgtcaaaatttggcaaagggtttataaaaccataaacccagcccaagacagaatgacctttgctctgtaatctttaataaataagacattaatattggcttaatgaaaatagctcatcttgaattatttagtaagattaccataacttctaaacctgtggctttaggcattctagtccacaggcaataaggaggtttgttttgggaaagaactgttatcatctttgtttcaaagctaaactataaactaagtacctcccaaagttacttttgcctgtgcccaggaatgaacaaggacagcttggaggttagaagcaagatggagtcagttaggtcatatctttttcactgtctcagttataattttgcaatggcggtttcataactttaaatcatgactactgcagttttcataggtcatataggtaaacaattaaaataattaggtaaatgtaatggaataaatacttgtagacaaacttgtcataatttagaatctaaggttatattaaattcaataattgatatttcattatttattttccaaaaagtttatattgtagaaaaacattcttggtaaaaataacaaagagtgtatcattttaaaaaaacggtgaacaagttttgtctaattcaaagtttatttaaaggttatatataaaacaaggtaaaaggaaccaggaaataacagaaatgtaaagaaagttataaaaataaacaggtttttgtgtggtaagaaagcttaaagagaataattttatatgagaaaaaaaatctttggtcaagcacagtggctcacgtctgtaatccaacactttgggaggctgaggtgggcaggtcacctgaggccaggagtttgagaccagtctggccaacatggcgaagccccatctctactaaaaatacaaaaattagctaggtgtggtggtgtgcacctataatccatctacctgggagactgagaaaggagaattgcttaaacccaggaggtggagaatgggcaacagagcaagactctgtctaaaaaaaaaaaaaaaaaaagaatcccatatggtaaatttagtcctaaaataaaatgactggttgtttaagaaggagggatgttcaggacaaaccagaaagttcaagcatatcatgaataatcagtgtaaatcacaaaagaggatttattttaaaaaaaacttttatatgatcaagttgtcatattgttttgctttgcttacaaataaagaaattgagattaaattttttttaaattaaggttattacatccatgtatctttctgtatctactcctaaagtacttgtgacattaagttacagggttttgactcctgggtctaaaaggacaagtcctgctaaatcttaacactgacagcaattaaagccttatctccaggccccatagaagatgctaatcaaaataaacggcatccctgagacacagggccaataattaaagccattcaactcttcaaggtcccgtgactgttgtgaaagaggttggaatgtgggattttaagggctgcttttaagagataaaataagttcagtttctctataatcattactgtcaaaggcacactgatgcaagaccagtatatgggcccctgtgtcagattaacagggttttcttgaagcattaaccaactccttaataaaggttataaaaggcatttggaagctgtattgctttatgttatggtcaaaattaaaattttatagtttataaaattttgaaaaataaatttaattggcttcatgctgttttaattagggcttgttcagaaaattatgtctcctttctcaaagaatgaagatttttgccttttttttttaattccttatcactttggttaaatgaatgacttattttacaatgacctatgatcctatttcatggtatcaagtcttttaaacctttgatattttacaaactttccaaaatcaatttataaattgtcttttcctgacctaattaatcctttaagatattaggtcccctaaagtccaaaaatgacataatttggcttatttggtataaaaattagacagggagcattgtcaaatatgaaatgatgtttggttttctttgggctatatttgtataaatgttattggtatgtgttccaaaatgatgggaaactcctgtaattctgatttaacttagtgaacgttatcagtaattgtaattgttgttaaattattgtgtgccacagaggtaacacatttgtcaattgtgtctttgattatggctgccctaaaatttttgtcatccatggacaattgttgtcttgttttggtcctttttaggtggttctataatcaactatggaactcaaacaggtgttcttaaatgcaagtttctgataactttgcagattgtgacattagaatagagggggaaaaaaacttgcaggattctcatggagagctgaagtgttcatgactatcaagcagaacaggagttaactccataaactgaactgacaagagactaaagcaatctttttaactcttgctttaaatgttgcttatcctttgttttttagtcttcaaacttttcttttgagctattgacagcttttaagagtttagtatactcctatgaacaaaattttgagcatatttgtttttcactacctgatttctccagaatttggaaatatttgtgagtattcttaacttatggtaatacagtcatttgcacaagtgcaataagaatctgttttaattcgtaacaggatacaattggagaaattggttattttaccaaggctttgactgaaatagtgtgctttcctttaaggaatcaaacgtgacttatggaaccaataaagcccttggaaaaactggcctcatattttgtgtacatagtccctgtacagggtttctgacctgtgttaagtgaagaatgtcactttctgacaggcccagaagcctcaggtttatcttggaacctcaagaggagaggaaattcacccaactcataggtatttgattgcataaatccatggctgggcttggctttaaaagagtcttatttgagatttctcctatgaaagtccaaaaaagccagtttaaaagcctatgtaaaaattttcttgttgcattgtatagaaataattaggccaagtataataaagcaaaccagtcgtaccatgatttgtctttagtaaaaatgggaaactggagagaaaaattatgtttcaaaactatagtagacctgttgttagattctagtctttcctaatgttttctcaatgtttattattttctacagtttggaccaaattctaatttttcttggccacaagtcttcaaaataatgttttcaattttcttccttcttttttgccccatttttcctaagttggagtcactgaaaactaagctgtgctttcttaaagccctgtgaactgaagccagacaacttaaacttcagaagaaaataaacagcaacctatttacatacataagccactttcatacctacttactgatgtatggacttcagagtaatatagcctatatcaatttttccagggttgttcttttgttgtttttctcccttcctcccgtttcctcttcacaggacatgagacttcacaatctgctaaaaatgagctttgggacctaacccatctaggaacaaactgtcctagccatgagagatcagataaaacctgagaccagagactcattttcttctaaaatgttttctccaaaagatttttttaaaaagaaatgggggaaatgtaaaaggaaaatattttgggccccaaaattactaagctaagggagaattcaagctgggaactgctcaagacaaacctgcctcccattctattaaatgtcatccctctgctcactgatatagatgcatattctgattgcttcctttggaaaggcttatcagaaactcaaaagaatgcaaccatttgtctctcacctacctgtgacctggaagccccctccctgcttcaagttgtccctgcctttctggatggaaccaatgtacttcttacatatattgattgatgtctcatgcctccctaaaatgtataaaacaaagacatgccctgaccaccttaggcacatgttgccagtacttcctggggctgtatcacgggtacacatcctgaaccttggcacaataaactttctaaattaactgagacctgtctcaaattctcaggttcacatactcatgtgaataattgactactagatagctctagtctaacagccatctcaaagtgaatatatgcacaataaaataatctcacattaactcataaaacagttcttcctctatttaaggagaacaaacacctaccttggaaattggagacaagttgaaaacagagaatcacaacctactgggagcagaaaatgccactgaagccagcaacttaaaagacaactagctaactactgaagacttgagtgtagactagcttgagagagaaaatattctggggatcccatggggggcccctacactttcatgagctttacctccatgtgcccacaaagttctcaggataaagattaaagaaaaatttcctcatggttctagcaggtggataggaagtaatctttctaaaatatacctagaatgttatgttctccttaacaaacacctgccctcaaggacaactactttaccagagcctaactagagttttatcagggcctgactgacatgtgggaatggaaatacccaactctggcccccaacagccatcttttcaccccaaagaaaaaatgtactgaaaagcacttgtcaagtctcatcccagggacaagggcccattaaaacactaagagctaatcataggattgtccaacccttcccctccccctacatcttcccactgataggaataggaagcagggaaattctgggcagaagaaggcaggtccctggcgagggccccaccctcaagcctggaatcatggcccaaagtgagaacatacatctgtgttttcctgcttgaatgctgccttttcaaaaccacccatggcccgccctgtcccactatcctgcacccataaaaaccccaggctcagccagcagaaagagaagcagctggacgttggaagtcagagagaagtggcttgacttcagagggacagcttgatggtgtagctttgaagaggaatctggctggggacggctgaacttcaggggaagattaccttcccgttctgtccccttttcagctcctcttcccactgagaaccactttcacacaataaaatcccctgcatttaccagcttcaactctcatgcgacctcattcctcctggacactggacaagaactcaggtgccacgagtgtgggtgcaaaaggctgtcatgctgaccctccactgagctgttaacacttacgctgtctgtagatggcaaagctaaaagggcactataacacctcctctggggttttgggcatcgtggataccctcccctagatactgttggggagtgagtatgtagtttgctcttgaaggtgcccaaaagcactcaccctggctcctgcacccactcacctgtgctccacctccctcaaggggtggagcagcgagtgagtggagttcacccctgccagcgcctgcacactccagttcccacctgtgaaggagtcactatcctgcttcaccaccatatctacagggctcctgtataataattagattacaatggaaagaactgcaaggctgaatctatttaaggagtccctagggaaactgtaaaagacagaaacaaggacagtagaggaaactgatgccttacacatttacaactaaacagtaaacacagcctaattcctagccacacaaacataaaacacactatcagcctatttaatctcagttcatattatctatacaatatgttcagctttcaacaaaaaattgtaaggcatatcaaaaggtacaaaaacagtgtgaagagacaaagcaagtatcagaaccacacttggatatgacagatattttgtaactgtaagactatgaatttaaaataattgtgattaatatgctaagggttctaatggaaaaaatggataacattcaagaacaggtgagtaatgtaagcagagataaaaacattaaataagaatcaaaaggaaacaagaacatgtaaggaatataaaggcactggacagagaaataggatgaagaggtgaacaatcagcagttatttttattgcaatgggagacttgtccagtattgtaaagctaaaggcaagaatctaacacaggaaaagagaaagtggaaaactgacaaatatttgcttcatgagatcctttccaaggtcaggattaagtcctaaaagaaggaagatgagaaataacaaattaggccaaaccaaaaggttgtaaacttgtctgtgaaacttcgttttaattaggtaacatggctactgcaaaaagtgaaggttatactacttcccgtctcccaccccattctttccttaatagatgttatgaaattgtcaacatttaagaaactcccaaaggaatttttcttagacatcatactatgagagttggacagtttttgtatttttcaatttaataaactcaatttaattttacattaaaatttctataccttaaggtgaaaacaaaaaccatacaagataagcagtaaccaatgttactgaagtaaacactcattcattcagcaaatatttattcagcaccttcttcaatctaggcaatggatacagtagtgaacaaaacaaaaatctctgcctttttggagtactatccttaggtgaagatggatgaataagcaggtacacaataaacttgtagaaatttttttttttttttttttgaggtggaatctcactctgtcgaccaggctggagtacaatggcagtgatcacggatcactacaacatcaccttcccggtctcaagtaatcttcccacctcagcctccaaagtagctaggactacaggcacatgccaccacgcctggctcaatgttttgtagaaatgggggtttgccatgttgcccaggctggttgtggactcccaagctcaagtaatttgcccactggttgtgaactcccaagctcaagcaatttgcccacttcagcctcataaagtggtggaattacaggcatgagccactgtgcctggcaggaataaattttatggaaaaattcaagcaaaggtgagggactgaagagctccaaaggtgaagtattattactttatatggggtggtaaaggactctttgacacagttacctaaaggaggtgagtcatgaggttatctgggggcacaatattccaaaaaactgcatatgcacaggctccaaagggggaatatagtgtgtctgatgtgttgtgggacaacgtgggatgtaattaggcaagaggaagagtctatagtgagatcctgtggggccctgtaaagagttttactgagtgaaatggaaaaaacttgagaaatgttttgagcagaaccacattgattactacctggagggtgttggcaaggagactatttaggtgggtatcacaatgtaacacagtgatttacatgggagtggtagtctggatttatttggcaggtagaaatggtaaaatttgcttatagagtgaggtataagatagaagtcaagggtaatcccaaggtttttcccctgagtaagtgaaagagtggaatttgccatttactaaaatgagaaagattgcagttaattagaaaagacagaaaatattatatatttggtttgagatgtttattaacttataagtgcaggtgttttttcttaaaatctgttttcttgggagaggtcttagccagagattaacatttgtgaatcatcattataggtgatattaaagacatcagagtgaagaggtttatggactaacccagcaataccaatacagtcctggatcatcaacaatgaatcacatatacaatggtgatctggtagcagagctgaaaaattcctattgtctaacaacgttgtagttgtcacaacattcaagcacaagacattaccttttctatgtttacatacacaaatacttagcattgtgttacaattgcctacagtattcagtacagtaacatgctatgcaggttggtagcctagaagcaacaaatgcattttcatcattatgcaaacaccatttagtgtacttacacaaacctagatgtatagcctactatagcttaggtgtacagtctactatacaattgtagcctaggtgtatagtagcccatacatctacgtttgtgtaagtacactagaagatatttgcaaaatgctgaaattggctaacaaggtatttctcagaaggtatcaccatcgatgcatgactgtatttagttatggtagtgaggaacagataccagcaaaggatctgggaaaggtgaaaccatgaaccaagacaagaactaggaagagtggtttctcagaacccaaataaagcttttcaaagatcgagaagcgataaacccgaccgacactgcttcattcaaaaagaatgaaactgtggatcagccattgtatttggttgcatggctattgctggctttcatagaagctgttttgatggagtggtaggatggacaaaagcgtgagtaccatattcaagagagaatgcaaggttctctcccaagaactctcaacaagttccgctgaagaaagattagctgaggtggaggagattggagaggggaagagaaaacaaattacttagggaattttgggggaacttagtgggcagcattacgggcagcgctaaggaaccatttaaagtaagacaagtccacacagctgtgtgcttttctacagtcttgttcaactgctgcataacaacagaatgttggaagcaggaattagttttaaagtaagatggtattgacgagacgacaataaaatacctctactacagagcacagcaatgttcggcctggtggctcacagaagctgaggctcttgaacgtctgggcacagcatgaaagcatcaagcttgagagactgcaggccttaacaaactagaagtgctagaacgatggttctaaaccaggtcttttctcacacagcaagcacagcaatagagatttattttatcttattttttagacagagtctcgctctgttgctcaggctcgagtgcaacggcacgatctcggcttactgcaacctccgccttccgggttcaagggattctcctgcctcagcctcccaagtagctgggattacaggcatgtgccaccacgtccggctaactttttgtatttttagtacagacggggtttcaccatgttggccagcctggacgctaacttctgacctcaggtgatccaccccactcggcctcccaaagtgccgggattacaggtgtgagccaccgcgcccagcccagtagagattcttttaaagactgcggtaggtcgataaaggagacattgtggcctaggagcttcaaggtctacagactgaacccagttagggtagggcccctttccaaatccagaaatggtatctattaatagaagggctccctccgggtcccagggggatggactacggtttttagcgccggaacttacaacccgaagttctgctgcttgtgactgcctgccggagagactggcatggtggcgaccagctggggagtggtgcaccacccctttttttggccgcctctgaagtccctgtacccccaagctcctccgttagcggctcgggccgaggctccggaatgtttgccgggcgtcatggcgacggtggagccctggctcaacaagcggccgcgcggttggctggcggcacgaggccgaggaggagggcggaggcggaggggagggcagagggttggtggagctggaggaagctccggacgacgactggaagaaggaggcgggcggcccgggcctcaggcccctcccaggctctgagtctcccggctgcaggcggatggatggggcttcttcaggcggtggcggcagcagcgaaggtggcggcggcagcagcggcagcggctgtaagtgcagcctccacaagccatctctccccttctattccagtttgggatgaggggctcctgaggtgtcctcagtcccctttctctccttcccctcccccacggcagtgtaccgcccggaagacccttaacttccggggaggggctgccgcagaacgcgcctggcttgctctccgccggctgccaaaggcgcatgcgcagcttcctccctctggccatcgactgcctcccagcgccgcctttttgccttcgcggtggtggcgccgcgctgggaatccgctgcggagtgagttcgcctcgccccgttcgcttcggtccctgatcccagtcggggtggggctaagctgaccaccctgctgtggctccgcctctttctcctgtatttccctcacttgtgtcccatccccgggaggctctcgcttgcactgcagcctttatggtgagcagcgccctgggccaacttgcccttttcggatggagtcagggagggaggagagactcgaatagggtattactgtaaggaaacgaggtcctcctagcgcgtgggaggatcccttgggacagatgcccgccgctctttactcttgttctttcagcttgtagtggctaggtccctggcctggagcctatctgtggtccctgcatgctgtgtaaccttgagcgagtcactatccctctctgggcttcagttttccctatttaaagcttcctccaacgctagaattctgcatttctgcagaagaacttatgtaattacaagattgacttggctattgaggccgcttcaccaagatgacccggagttgactgaaccttcttcacttatgggtggaatgaggcgacctatttattgggtcgcttttattcctttatcattagttacaaattgcatgacttaaggctcattaaatgtttttctaaaattgtcatgggatccttgtcctgattcccgaccatctttttaaaaatgcgaaacagggtggatggtgagcttgtatcatcgtttctgtctccttgctactgaggctctctttcctttgatccagatggtgtggtcgctcgattctcccagtgcctggctgagtttcggacgtggttaagaaccaactggttgaggttcaatgcagacaagacggatgtgatgctggtaggcaggggtacacttggagattaagggagggaaaatccaaactccctcaagtaatataagattatattactcttcttatatgttccagtgtttgagaactgatgggccaaaaatttccagaatttgggtgagataaaaataacatgtcatcaatgtaaaaaccataatcatagtttgtaatattctgataaaatggggccactggataaaactgtaaaaattatgaaaagaaaatccaaaactgttatttgaagaaccaaaagcctatataagtgttttagagtggcattaataacaaaaaatgaaactaacgaaagatgatgctgattgtcactatagatgtggggcttccaaatgtaataggctaagttttttagatgtaggtattttcaaccaaattagtaattatccataaaattttaccaccacatcataaagacatggtgtaggctgttgcttttaaataaaaatttcaggaaatagtttataaactaatctcaaaagagactcatggacgctgaaaattgttagatatagaattttttagttttggatgtgttgtattaatctatttcagtcagctaaccccagagtctaaattgttataagtacagtattttcttggtgcattttgagaggtacctttttggattgcataacagataggtttatatagtatatatatatatgttacttgtatttgaatcaggtgttggtactgaataaaaggttatatttcttaggtatatgtaaattgccaaagaagtttgttcattggttcgtttaaggtactggttgaagtaagattgtgctcctaaatgcttttgttaaaagcataataataactgaggggtttgtgtgtgcgtgcgccttatagcctctatagaattgttcaataacttttgaatggaagattcagtaaattgcttacaaatgatttatcaatataatagcagttttgagtagcttaatgtcataaaaattaatgttactttgcctgaaaataaggaggcttttaggtggggaataggagctgaagaggcatttattcaggctttgtatagtggttttttgttttgggacattaatcacaaacctcacataaaattggaattcagcacacttttttagtttaaaaattttatacacaattccaacagaactactgttttggatatcacattaataaataacaaagtgtaataattttaagcagacacaattaatggtgcattttcttatgcctttagctctctcatgtcctattttcaactcttctagtatgaataggctttaaaaataaatttttttttgttaacccaagtataaatattaactgtttgcatttggatacaaagaagatatctgttgaattaatccaaagtgctgaagaactaagggtaatggatggaaacaacaaggaggtagattctggcataataaaagaaagaatgttttaaacatttgaactttttttgaaaagagcagcctttttatgagatatagtgagtcactggaggggtttaaacataggcagaaagcctggtagtagaagcatgatgagagattactatcttgacagggtagagaattgactaaaagatctctaaggtcccatccaacactaaaattctataactagtgaatagttaatttttatatatttaatactgaagagggtaagtaagcgttttgagaaagacttttcattccgtaaggtggctcctgaaaattttacagttaggtgtatcactaaaataaaataatagtggaaggatactgaattcagtggtaatgtgttacctatgaattgcagtattagagctgtttcttttttataatatctgaacctaaaaaacccactgaatccacatttataaaaaggggaaggggaaaaatgtagagagtttttttccctcaataataataataccatttaaaactagtaatattgatacacaatattaataaacttaaagagttatttaacagtaagatagatacccattcagaaatgtttcagacttccattttcctgacaagtttaggattcattcagtaggttaatagactatgatcccctgctctttatcatagttgggatttctgttggtagtttaactgaagaatcaaagattcagtgtacttaagcaagttatttctgtaccttgtattgtaacacttttaattttcctttggtagccaaatttcataaattagctttcatatgttaatggaaaaccctccttcatctccatggtataaagcctgagtttgtacctctaggcccctaattgtgtctgtacccacctcaggtccatgtatatccattgttctttgccttcagctcttttcattaagtgtattgattgaaaactatttggatatgaactgacacttttaaaaagtcatttttatttcaagtccagaggattgacataattcaacagggtaactattagaaactatatacctctgctaaaatatttattcccccaaggaatcctgaaaaacacttttatataagttttctaaaaaataaaatgaaaatactgtacagtacagttaatggtaaaaattgtttgtagatttgggaaccttaaagttttcctttctcttctttcccttgcttttctttcagtagaaaatgtgcatcagatgtttatgtttaattggtttacagactgtctgtggactcttttcctgtcaaattaccaggtaatgtcctttcacttagcagctacttcatatatctgtaaatgcagtttattcatgcacagattattattggacataacagtttcaaattaacattgaatctttggaaataggaaaatgcttgatagagtctagaattttaagggaatataaataatttaatagcctcccctatattgcattataagttaagtattaactttaagaaaaattgtatatgtacacatttatgcaatgtagtattggttcacattatttggaaggaatgaataattctcgtatttaaatggttgattttggtagccacttttgaaactgcattaagaggaacccttgaagattaggaaaaaaatcccagtcttttgaaataaagactttcaaactggtttagtaaaatatgttagtgactgttttaatgtcacctttgtgttattcagtatgtgccttagtataatggaagtgaaacatgttagttactttgaaatcattggttctggccatcatcagcattggcatcacggccaattggcagctgtaggccaatacattaaaataaactttcaagttacaggcatttcaggcattgcaaataagtaggttctccctccatgctactaaatagatgatatccataaaacagtcaattttcagtattttaaattttgtctagttgtgcaaaattcagtacataactgtgttgctaccggcatgacagaagtgtgtgagaaaacgcaaatgacatgaggatggcggactgcctatcataaccccttccattaatttttgctctgacctctctagagatttggggatatagaattttacatttcctgtcgggaatctactgatggagaaatatttgtcaaggcataaccgctttcaaagcacagttcttgccgccgttgcatcacagcaacatccgtttttcagcaaatgcatttcaaaaacgacctacatgtaaaatattacgtatttttcctctgctgtgtcaatgctggatgtgactcctttggcactgttccttgacctctctgatccgtagacaaccccctccgcctggagtggcggatcagctggagccagcgaagcgccccgcgcggttgcccacctcctcccacacccaccttgactccgccccctccgctcttcccggggagggctggccgcggggccgcgcgcgcgcccctgctccggcgcgtgctcgctggtcttttccctccagtccagcccagccggggcgccgcgagggggcggagtggggtgtggtgggcgcgctcgggcggctcctgcgcgttcccgccgaggcagtggcggcgggagcggcagagacggcagcggccggagtcccgttgctgagtctcacatccgggttctggccgtgacccagctgcggccgccgcggagatgtgacccggcagtacggcaaatatggcggaggtaagggagcgagctccccctccctgtcccggagccgggcgcccccggccctgggccggggaggagtggagtgggcctggccaggagaggcccggccctgctggcgccgctgcccacctgttgtccggaacaggccattctctgggcgggagcttcgcctggaacttagttgggatgggtccgggggtaggaggaagcggaggcgtacttggacttcgggggcagtttgaagggtagtgcagcgtagtagtgcggtgcgagggggagggggcgcccgccggggaaggggtgcctgtggcgcaacttcgccggccggtgctaggggccaggagagaagctgctgcttcctcttgcgaagttttttcccttcctaaccgagatgctgttgcgcccttccgcgtcacccccatccatttgcgactgacatccagtctgtgttagtggggaaaacgtaaggctgacggcctttgattaactctgtaattttcatgatcgtggtaaaatgagagtggataaattaatctggccagccgcaatccagccctccaggttggggggagtctgcccatttatccagacagttccatctcccgctccccaaggtacaacctctgagctgcttttccacctccccccaccaccttcactttccaggcttccccccaccccctttccaaatcaaggctacctattcttgtcttctttctcttctaatttttctttcattggagaagctttttcttgtttctttttgctcgttttatagtaaacaagttcctaaagcccctttttttgattttacatatttgggccgcagttggcgggcatacaactgctgttgatttattaatcggaactaagtatacgctactggaactttaaataactggaagtttaaaaaatgtttaaaatatctgaagttttgtgggatttgttttgtttccgtttttccttacccgtggaagaatttcagtattctttattcctgagagttcgagatgatgtatttggattttttttatgactcctttgaaataagccactgtaaattttgattgataaggcatttctcttgtttgaattgccattttcatggtttcacaggcaccccaaaacagatttaggaaggagggtgagattttgctgtagcagacaggactgtttgctgcgagtattctttttaaaacattcaatatctctaatttacaactaaatttagatcttagatttattttcatttcttttgctcttggtggttaaagaattgtatttccaggcacatgaattggagaacgtagtactttctgtttccccaaaatgtgactgcgtttgttccagtagactgagaatcggtacctggattttagtcctggtgaggttcttattcttaagtgtttgtttccttcatgtttaaggagttgtgtgtagctggatttatacattttgtcagttagtgtcttcagtggacccctttcagtgaatatcgggtaagcagcaatgtgctacataggtaatgtggtttcttctttcatggtgttgctcaggatggtttgagctttgaggtgtgtagtcatatactaaggcaagatattactgaaggaaaatagcttatacagagaaatttaagttaaaaaacttaaatttaaaatttctgtgtttttaaaaaataaattttattgccgagggaactaaaaaatctaatatgtaaaagaaattatgttaacttttttgttttaaaaattaaagatggttgcgttattgtaagataaaggaaaaaaatattttgattcactaatcatttcctaatattttctaatgtatgttttagttttcttaaatattttatcagttggagaatggaatgttttgtgggaacgcatggattgttcaactgcaagaaggaaagaactggaattttgtttttatttggtttttagtgtttatttaatgacctggtatctttaaacaatttatcttctatattcttcagttacttgtagatagtttcatgtatagtgaattggggaagagttagaggaactttcgtgatctgtgtcctacaaaaaaatctaagacaggtgaagaagtgaaaagtacaattgatttatagttttcctggcctcaatacttgaataattatgacgatttttgagaccagtggttttaaacaattagacaaaggagaaatgcttggttggcttttactttgagctctcagtagattcattctttatgaagccaatataaaagcatgtgattaaataatccagatgctgaattattgtgcttttgatcaaataaatctgaggatttaaggatagcttgtgaagtaacagtaagtgcaaagcaacagtatatatctatttgttaaatctgagggggaaaacaggttattgaagaagtatgtctccagagaaaaatgtaggtattatgcttctgggcttttaaaaaaaaaaattgatgcttcctacaagagcatgaccctgaccatgtttttccagaaaaatatttaattcttgaatagaaagtgctttagatgagaataggatatactaattttttatatttgatctgattatcttagtccataataggaagtatatattggttcttcagttgtgataacattaaagccgtatttaatgtacttagaataaatagcatatgctcccttgcttaatactttttggcaatatttctcattgcttattatcccttaaaattatttaccaaccttctaaaaggacgctctcctagtcacacttgaaggaaattacaggatagttgcagttttactaactgcaaaaataagaggaaaatgagagaaaaaatgagaggaagaaatagttaatcctttgggttttataaggaatgtactagggacctttgggaacgaacaatttgtcttgtattttagcgtttgtaaacacgtaagggactttcttctcaaggaaaaaaatccatggacaattcaagacctgtcttttcacctaggccacatttctgtgatataaagagaaaattaatggatttgcttctttctatttaagtattttagtactttcaaagagggtatataatctgtttattcactttcacacctatccatttctctttaaaatggactccttgcttagtattttttgagtgtatttggatttttttaacgaaggattatgttaaatgttacttatgaaaacattaatttctactctaagcaaaatgtgtttcactgcagtgaatttaagcttcaaataattctcgacactaataatgaattttttttcatgtttatacttcagagctattaagattttaaaagtagtcaagatcaccagtgcgtgagagtcctaaaaatcttaattcattggcagttaagagttagggtactttaataggtgggaaaggtttggtgggagaaacaagtgaattactttaagataattctggtaagtgagactaaccagttttctaaataattcagaaataaaacactgccattgaagcttaagcatgtctttatgaaaagtaatcagctatctagaaatgcctgcctggcttgatgttcattcaaaattcattgcagtgattaaattgttcaagtaccagtcattgcttggggcttgttctgtttgtcttattctgtggcttagaacaataacttattatgtaggtatgaaattcatgaagtagcaccccaaaaaattgtttttgcaaattgagatttttttaacagtcctagatttaaaaaaataaatttaaacatatcccatgcatttagctgcatactccttagtagtgttaggtttctagagcaatttataataaaagtaaagttaggtcttgaagaaatctaaatcttttgatcatagagaaaatgaaagtgagcagagagtttacgtagtttgtcctaggtcgtgcaattcatctatggcacagtttagactggaacccagccttctgtattcctagattcctagtgcttattttctttttctttctttcttttttttttttttttgagacagggtctctctctgttgcccaggctggagtgcagtggcgcaaatcatagctcactacaacctcaaactcctgggctcaggtgatcaatccttccctcagagcctctcaagtagctgggactataggcatgtgccatcatgcccggcttttttttttttttgtggagacagggtctcgatatgttgatcagactggtctcgagcttctggccttaagtgatcctcctgtcttgtgctgggattataggcgtgtgccactgttcccagtccttattttctatgatatcattttacttctgaattattaatactgtagtaaattgctaattttaatttcagtacattcttaacctttttataccccagaattcctgagagtaataacaaagttaagtaacttaattttattggaggagagggatggtgagccagcccttggcacggtaaccatctttcaccctaaagtaggacccctctttccaggcttctatccccatctccattgctgtgagaatctctgacttagagtctacataactaagtagatgacggcaatacttaaaagaaatggtggtagaattgttttgaggggaaaaatttgttcagacggtaatactcattgcaaataagcttttgattgcctggaataaaaaaatctagtaattacttcatgtttttactatgttgttgttagggtttttttggtgaaaataatggtaatgttgtagttagttatttctttactctctctcaaattatagtcttctgttgtatgggacatttcccaccatgttctagaaaaatataaaagagaattatttcagcaaatctgaggcattgaatattcgttacaactattagcaattttatcaactaaatcatacaaatatgtgggtgagggtcaacttgctataaaagttgctagagtttgtttttaatttgttttagcccattcatactctgtgtacagtctttctgtctctctagtgttgttttccatctcagataagataaatatgtaccccctaaaacactgaatttttcaaaattacagcttaaaaaatagtaacaagtactaggttttcttaaaaatcaaaatttagaggaagaaaatgaaaatgtctcataattccacaagataatcagttcccagtgactttcattttaagaaagaatgcatagtacatgaaagtggttagaaaatttcaacagtacagaaaggtattaaatgaaaaaagcctcttctccctgaccccattccctagaggtaactattgttaacaggttcttgtatgtccttttgaggaaaaaaaatttattccatattatttcatattccagcccagtttacgccctgttctacagttttctttatactcctaattttttttggcatttatttctctatcaacacaaacagatatctctatttttaatggagtcatagtgttctattgtttggaagaactatgtatggaagaactatgtatcatttctaatcagctaatgcatggactttaaatgtttttctacctttttgttatgaacaactttgtggtagtgaatgttttatatatatatgtcttggtgtcttttttaaaatatatcagtaggataagttcaggttagcaaaatgatctccagtgtggttgacataacttttttctactgataaggttatgagtacatgttaaatatattttaatgcccaattttaaatcatctttcctaaaaaaggtattttttctaaaaataggtattgttataaataagcacttacttagctttagtttagttttgttttgtttttgttttttttgagacggagtctctgttgcccaggctggagtgcggtggcgctttctgggctcactgcaacctccgcctcctgggttcaagcatttctgcttcagcctcccaagtagctgggattacaggcgcccgccaccaaattttttattaaaaaaaaaaaaagtttttgtattttagtagagacagcgttttgccatgttggccaggctggtctcgaacccctgacctagggtgatctgcctgcctcggcctcccaaagtgctaggattacaggcgtgagccaccgtgcccaccttagttttgtttttctctctcctttctagtttatggtagtaattaatggtagatgttgtgggttctccaggaaggtattgttaagataacagtttctgaagactgataagtctgacatgacagatgactacttgcagtcacattttaaacatactttgaactgatgaaaatcatttcaaaaaagagaggccgggtgcggtggctcacatctgtaatcccagcactttgggaggctgaggcggacggatcacgaggtcaggagatcgagaccatcctggccaacatgtgtgaaacccatctctactaaaatacaaaaaattagccagacgtggtggtgtgcacctgtagtcccagctactcgggaggctgaggcaggggaattgcttgaacccagaaggccgagattgcagtgagctgagattgtgccactacactccagcctgggtgacagagcgagactccatctcaaaaaaaaaaaaaaaaaaaaaagagaaaaagaaaaaagtgagggtgaaggaggagagaagtgaagagtggaaaattttagcagttatttctctagaaggtacaaaaggacactataaaaggtatagaaggaagagtcagggtctagacttcaggcctgccttcaccacctaccatggaaccttgatctagtcagtgtgtctccttgggtttactaatttataaaagaggtgggcagggcaggtattattcctatatttatgattatgatcagctaactagatgcttttgaaaatgtgtagcactgggttgggcatggtggctcatgcctgtaatcccggcacttttgggaggccaaagcagggagatcacttgaggtcaggagttcgagaccagcctggccagcatggtgaaaccgtctctattaaaaacacaaaagttagcgagccatggtggcgcacgcttgtaatcccagctacttggtaggctgaggcaggagaatcgattgaatctgagagatggaggctgcagtgagccaagatcatgccactgcacttctgcctgggtgacacagcaagactccatctcaaaaaaaagaaaagaaaagaaaatgtgtagcactatatgaatgtaagctggatgtactattttatttcatatctaaataaaaattacccttattccacacccaaacttcctatattaagatgctaaactcacttgttattttgaaagatcatcatttttgataattagctatacaaagtaatgttttacagtatgaaatgttttcaaataccaattttttagaaactcatctttgatttaatgggatgtatttaactttaaagaatctaatctcaatcctacccccaaacatatagaacagaattttattttggaagtaaaatactaaaatatgtatggatactaaatgtatctgtaggcagaccactcctagttctccacttgtgctaatctagatatgcctttaaatcagtcattgaaacattctagtatgtctgacataatcactaatgttacctttgaacactgggtgttctactctgtatcagctatgcttacaaatgctactagtcctcaagcgtttggtatcttaatcattgggaagtgtttgcagcctttttcagaactttaactatttaccaatgaagcaacaatcagtaagatatttattggcattcagtgctcctgaggccttttacaaactgaaatatatggacaccatttacaattcaaaatctctattgttaatatctaacatcaataaaaatgtaacttttattcttcagtaacttgtaattagaaagcctttttttaaatcagagaactgttaaatggaataattattccagtgttcataagtcttattttgtgtggatagtgagctaggattagatgaagatgatcattaacattgcttgtagccttacagagaagattgtgcctacagttgggaagtataactgcgtgaaacacaagtggattaatattttaaaatattgatttactatgtaataatttgtgtggtggttaactccattttgaaccagaaatgtgtagctctgcccaaaagatgttaagcaagctagaaaccctttttgtggttgcattactcttgtcatgtcaccctactctccaagcttcccattagaggaatgagatttaaaagtagcactgtattgactgtgttctggcagagtaactttaaaataatggtagtggtgtaccattggaaatatgcaatactggttattgtcagatttttgctagacaatgctataggaaggaattattctaagaatttaacagaaaaagtaggacctttgaaaaagtgtgccacaaaagaatgagtcaccatatggaatctagaatcccatacttactacaattacataatatgtacagttttaaaaacaaattttaatactttataggaatttgtcttagacacattgtttttgaaaaatagagaatttccctcttttctgttttcttcttgcctctcttccccattacttagcagaaagaaaatactgcaagatccctatctttcctttgctagtgcttttggcctcccaccatctgtattttctaatgggcatgaaatagatacttctgaatgaattggtgaagttttagttcatgttatttgaagcatcttttgagtttttaatatttgttttgtgggagtcttatgtttgtagattatttgtttataattgtgaattaactgaactaagataaaacacaactgcgcattgtcaagcagtaacattactaaaataaattgctaccaattttatctttaaattttcaagttgtttgtggttaaatttatgacaggtagaatggtggagtggaaggagcattataattggaaatctgtgcagtcttgcatcagataacctaaactttctaggcattagcttgaatgcttgctaattctgttataacttaaaaatatattgtttatctgtaaagttaacctaatatagtatttggtgcttaaacagaattttaatttttccttttgctttgttacaacttaatttttatttgagatagtgtcctaaattgtttctgtctcccatcttacactcactttttttaagtcggagaccagcttgatagcaaactttgttcatagttctgtgttgataggagaaaatctatttcagaaaattccaagatctaaaatcatactacttaaaccacatatgttatgaagcccacatgtacctttaaaatctgaattctatactattgtctttatttctggattcaggagtgtttggaatttttctttatgcttaaatataatgaaagggaagggattatatgggaagttttagtttgtcttggaaaatgcagacattaaaactaaaatgcagacattaaaacttactgtagtttttggcatcatagtagtcattgaataatttcggtaatgtttgtgaagatacattatacagaaatactaatttttcctcttttctccccttctcagccatctgttgaatcttcaagtccaggtaagtattttccatattttttataatctcgatttgagtaacatttgtcctactagttgcataaagactagaggagttagactattatctgacttgcttttcttctgaatgcttcttttctctggggaaaaagaaatggatgaaaggtttgactgcccatgaaagtacaggtgaggctactgtgatttcatcctaaaaatgactatttttgggttttctttttttttttttttttttttggtgagttgccatatgtatttctcacagttttgtattattgtttgacttgtagtatatatataaattgtgctttttaaaaaggaatcattagcttagaaatatttgcttgtgtagggatttcaaagtatttttatttgagaaaaaattgttagtgcattacagagggaggggaaaaataaagtaagcaaacgattcaacaagtgaatatttaatgtaaataaggaatattctaaataaggaaatcattcttagatttgaataggatcaagttttaggttctgagcacacatctaggatttttgtattctttctcaaatacagtacatattcattttttcctaacttagagattgcaaacctgtgatctttgaatcagatctgtgccacaaatttttgtttggccactgtagtgatctttaagaatattttatatatgaaatctggatttagggttcccatggtctggcaccactgggtacagtagttctacatggcagtaattcattggagttgaagcagtgaggaaagagtcaagtactagtcttttatcctcagtgtccagtgactgtcaagagaaatgggactgccttctgcatgggatatgtgggttaaagagtagtccaatatagaagagtgagaaagtgaaccctctgaggcatagtaatgttttatttgaaaacatctcacatgtattgaatacttagataggatgtattctgtattactgaattttccagattattgaagcaatcacctttctgtgtttaaagttttagaaagaaagcttttaaaaatgcttaacataagataagcctgttttcatggtgcaaggtcctttctatgaacatgaatcactggactctgagggttggactagatcacatctacatcccttttaaatgactagtgtgctcagctgacgttgattttgtccttttgatttcagctgaaagcatcttactctttttaatatgcttgagagtaaagtacattaggctttgtgcatttctgaaactcaattttttttgaactttgttttataagtatatcctggatggttaagattgggagtaatctggtcttagataagtgttagatcaccatattcatttttaggacatggaattatttccgattttttttttcaaacgcagaaattgttttcatagaaaaaatagatcctacttgtttcttatagtattgtgatattgcaaataaaactgaggagatttagatatttctgatgaatttttgaggcattcatctgatagtacatagatacataaaataattactcagaaagcgatattagtaagtggctttctcagtttccattacatttgaatcagcctaggctgaactggaagaataatggagtttgaagaatacaaatgttggccaggtgcagtggctcatgcctgtaatcccaacactttgggaggccaagacggatggatcacttgaggtcaggagtttgagactagcctggccaacatggtgaaatctcgtctcttctaaaaatacgaaaattagccaggatggtggcacatgcttgtaatcccagctactcggaaggctgaggtgggagaatcctttaacctgggaggtgaaggttgcagtgagctgagatcatgccactgcactccagcctgagctatagagcgagactccttctctcaaaaaaaaaaaaaaaaacagtctttgatagctttgctacttgttgaatacttaacagatagaatgtttatatttcttcagcttgttttcagactgaaatagatcttttgagttagacagtatttgtcatttgaggcttctgcccagggcagtgtttattgttcttataaataatgttaattacagccagttataaaagttagtagagaaaattagaaatactcatgtaaaaaatttttcagtcccctgatgaaaaggctatatcctttgtagcatctgtactttgcaatcaatgctagtaataatagtcacatgaccacattaattgctttgtctgtagtctccaccagtgtaagacaaagtagaggcacaatgtaaggctttttacctgtaagactagtagccattagaggtggggaattaatggaggtgaagataatttaaaaagtgattaaatgagtagacatgatacaaactgaatttacctttgaaaagatgtaaggtaccttttctgcagtaggataggatttcatgacaaagcagtcacatttgcctaactctgatgcaaaatacttaatttatacaaagcaccagagccattacctctaatgatttattattgggaattttttttttttcctaggagacagcctaatggtgggtctagctattgacaagaataagatggttagtttgttctaaggaacaaggcaaaaagaagtcagatagaacaggtcagattaaggaaagagaaaaactgaaaattgaaagtttatagaaaaaagcgtagtgtgcatgtagggaaagaaattggagtgagacaggaagtagttcacctacactttgttgtttgatgtaataagggagtgaaatggcaagtcttcatatataattggctttgcaaataacaaaaaatggacttcaggtgagttacaacacatgctttgatgctatatacctatgaacttgaatttttttaaaagtcaatagagtgtaacaagtataacaaagaattaagcataattatttttgataatacctgtgtctaattacaattatattctgattggataatagtatacaaagggatggtgtggggattttttagggtctttctgcctacaagggagaaaagtatagcattatttgtagggatacatgattactgactgactactcagtatcccagaagattgctgggtgaactaaaaagtttgaggagagttttctcttgaaaactcagaagagaaaaggattgggacagaaaactacacctatattaatgtttctcaaattgtgctcctatggaacccttgtgtccattgcctcaagcagtactaagatgcactgctaaaattgtactaagcttttcttaatttctggaagaaaattaagataatatgcttttctaaatgtttttatttaaattattctaaaactttgataagtgttaataactcatttttactataatctggtataaggtatctgatttggcatgtaattatgtttttagttattttctatttaatatcagttcctttcctttccttactatcttttcctttcctttcgtttagttttgtttcctttcgtttcctttcctcctttcctcttttcttcctttcttttttgagatgaggtctcactgtgttgcccaggcttgtcctgaacccctgagctcaagcagtcctcctgccttggcctcctaaagtgctgggattacagacatgagccactgcgcctggcctaataccaatattttctggtgcttctgaaagggcacaatgatgttaagtgctttgccatgtgacctggcttgcattcactcgtcttagtacatagactctccttaagtattctttgaggcagtatactaaaataatttacaggaggcttggagtccagtaaaagcataggtgttaggattagtatacccaggattcaaattccgtctttgccatctactggctttgtaagtttagacttgctacttgaaatctctaagccttgagtttttattttttttttttcctctttaaatgggatgataatacctacttcgtaggattatttgaagattaattgagataatgtatatgacatgcttgaacatagtatctggcatatggtaagcactcaaaaaaatgattcttttgaaaattattgtgagtaactgaagaaccctaagctttgggcattcccttattcataatagtcggattttcaagaagtcagctctatctctttgctttacttattgtttatctttctggagtgaaatgaaagaataggtacatctattaatgtctaaccatcaacagttaaaactttaaaaattgttaattttttcaatgttcagtaactcatttgtttatcagtaaacaatgcttttgcaaatctaggtccacattggcagtagtaaaacttggggatattttacatagtctgtaaaatatccccaagttttactactgccaatgtagtacaatattttacagacaatattttacagactatgtatgcccagcctttgcattctactattacaaagcttgaccctatagggtccagcaatattccccaaccacatgtcagttagacatgtttattagactagattatttttaatgcctttgataggagttctctatgcagttttaataaattttgctcttctactcagtctttggcgttatttctgatcaaaatccactaagttaaggacagctactcaaatattagatttttttttatttattttttattttttaaagtcagggccttgctctgtctcccaggctggaatgcagtagtgtgatcatgactcactgtggccttgacctccctggctcaggcacttctcctgccttagcctcctgagtagctgggatgacaggcacacagcaccacacccagctaatttttaaattttttgtagagacggtgtctcattatgttgcccaggctggtctcaaactcttaggctcaggtgatcctcccttcttggcctcgtgaagtgctggtattaaagcatgagcaactacatccagccactagaatgtattttcaaggaagtacttatagaataataatatttgagtgcagctgtgtcttcactagactgtgtattcagatgactgtatatttcacatgactatacagtcatccttcgatacctgtaaacctccctcggataccaaaatcgtggatgctcaaatccctgacacaaaatgcatagtatttgcgtgtaacctatgcacatttctcttatatgctttaaataatctggtgtgtgtatatatatatatatatatatatatatatatatatatatatatatatataaaatacctaatataggtaaatgctatgtaaatagttatactgtgttgtttggggaataatgacaaggaaaaacgcctgtacgtgttgaagacagaggtttttttgtttttgtttttttctctgaatgttttcaatctgctgttggttgaatccacatacacagaagccatggacatggagggctgactcacagtctcctcatgggccagaggagttcatactcattggttctatcaaacattaatcaaatggttaagaattgtgatttttagggccaggtacacctgtaatcccaggactttgggacgccaaggcaggatgattgcttgagcctgggagttcaagaccagccagggcaacatagcaagaccctgcctttaccaaaaaaatattaaaaaattagctgtgtgttgtggtcatagtcccagctactttggaggctgaggtagaaggatcgcttggccctaggaggtcgaggctgcagtgagctgcaccccagcctgggacagagcgagaccctgtctcaaagaagaagaagaaaaaaaagaattgagacttttttccacacgaaaagcctgttcttatttgatatgaccatttattatttacaattttttcatatttataacattataaacacttttaaagctataaacattttccttccatttttctgttgtaactattaaaaagcaatacataatagttgctgtgcgtagctttttcttggtacttttgacttacatccagcatcaaataaaaatatatacattaatattaataagatccacttaatttggtttaccaaactttttgaaatattccttaccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggtaaataacatgtagagctagggtatgaattggttatgacttttttgtggaaagggaagatctgaaattttgattctctgattaggagagaaattgtgttatatattaatgactgaaaaattttgtgtgatcataggtgggatatttaaagtttgaaatgaaaggatttaaaaacaataactttattatgtgcaataacagaattcacatagttactttggtaaaacatagactgttaaatgattctgctataaaggtctggtcaaaaatggactataaaaggattctacacggcctcatatatcctttgtccttccccagttaccatatcttttacttattctccttcagagccaaaaattcttgaagtatcattttccattcactacataaagtgctctagattatctccactacataaagtgctctagattatctccacctcttcctatcaaggtgaccagtgaactttccttgttacatccatttttatattcacttttctctcactaccttactttttctcagcagtattcaatatagtttaacattcccttcttttacttgaattctggagtacaccactgtctggttttctttatctttttgtttctattcagtatcttttgcagactcttcttccgttactcaaggtttacatgttggcagtttgtgattctcagtttggaccttctttttttctctcctgtctctgtctggatcagtgctcctcaaaatgtagtatgagggtcagttgcatcagaatcaaccctgtacttattttaaaaagcagattttttggacctctcccccggcatactgaatcagaatctctggaggtggtgttcagatccacatcttcattaagtaagttggcattatatgtacaccaaatttgaaaatcactaagctgtgtgatttaatttattcccttggtgtgtatatccttagtattctttagtttatatttctagcattaacctatttcctgtctccagttttgtttgtccaccttgacatttctgcttgcttaactaaatggacatctctaaattataaatgtccaaaacagaactattgactgttgtttttttctctgcttgttctttccctgtcctatcagtaaaaagtggtactactatttaccctgttgcctaagtcagaaaccagtgagtcattttccttctctttcaatatcttatttctaaataaacctatcatttgtatccacaagaatatcccttagccgactcttgatccattgctgcctagattaccattctttctagcctaggctattgcagtagcttcctgactggtttccccatttcctcttttaccatctttctcctgatacatttccacccagcagctgtgatcttcttttcaaaatgtaaatcaattaatatcaacctcccagcttcctgttatatccaaagaaaacccaaactcctcaaccaggccagcaaggccacctgcatgataatggcctcttacccatgtatcacactacctctgttatagccacactagctgcttttgttgttaaataggctagtttcttctgcttcaagggttttcagctcattctcactctctggtatatgcatcccaaggccggctccttatcctctgggttcggtgttgcctcctcagaatagcagcctttcctgtcccctaattaggttttaattagttttttgttttatttttatttttttttaaccactgtcccctattcaatgctttctttagtgttaggacacaatttgtaattgtttgtttaatttattgtctgtacctccactggttttgagaagatgaaataaaatgactgttattcaccagtgtatttcatggtaccttgcaagagtgctcactcaaaagtattgtatgaatgaatggatatatcagtctggtatgttctaataaaatatatcatgcatatgatttcctgtactccatgataaaaagaacataagaaataagacatagtgccagtctttaaggatttggaatacataatatcatgaaaaatgaatgcttatacttttatggtaataaagacctatgtctcataattttagtttgtaactttttaaagtatacatttaaagagctcaaaaaggagttctattactgtttattgaaatcttgtcaggtgttcccattgtgggattagagctggctttgggattagatcatttagtgattacagctgacttaatccacaatgtctgaataatttaatgtgtcaaaggtgtatattggctatcacaaaagtctttcaagaatgggttaaaaagcatatgaagggctgggcatagtggtttatacctgtaatctcagtacttcagaaggccaaggcaggaggattacttgaggcctggaggtcaagaccagcctgggcaacatagtgagaccaccatctctgcaaaaaattttttaaaaaggttaattaggcatggtggcatgcacctgtaggcccaacacttcatgaggctcaggtgggaggattgctggggtccaggaatccaaggctgcagtgagctatgatagcactgctgctctccagcctgggtgacagaataaaaatgttactactatttaccctgttttatttttcagagactgtgtgtctgaaaacagggcacttgaagaacttgaagtcagaactattgtttaaaagtaggaggctgggaagcgattcaaaaacagttataagggaaacagttgatttaacaatcatagtcacttcatgtatttgtgaagtgagaagacaattattttcagtttgcctatattcagagaagatctatcactttatattttttgcttctgaatagccatctgtgggataaaaggtacagtaataaaatcttgtattttctgtcttatattctatattagctaaaatactaattagcaagaggaaataagtagttttcataatgggttatgagttagttattttttttctatttcagaaaatgagatatttattacatttaattagtagaaaattactaatgggctgtgctaaaattttggttatatcattgccttttcctgtttttctctcctattcctttccccagccccatatagtgccttaaaacttgctttcaagtgaccctgccttaggaaatagaagttaaaatagaattatttatagagatagggaaaaaaagacagttgaaccaatcctttatcatcctttcaactagacagccttataccttctcagattcttctctgacttctcccagaaacaattaaagctttaagtagcatagaatgcttttcatctgtaacctgaagctaagcaatattttggggccaatttgttggatttcctagagttattaactctttaggtttgaaccaaacaaaattcttgttgtgtttattgaaaaagtgaataagattttgttgtgttgattattgatttgcttttatagaagcaaaacattagttatgtcagggattgatagtgtttttcaccttacaccttggttgcatgaaatgaatttttgatgtattgtggcagaactctgacattcattcaggaaatatcaataactgtatagcatgtggttttaagttcattcaatttgaattctagaatttttcagtgaaaactaactcgaaagaagttttgatgtgtattgttacatttgtatgcatggattatgacaatataaaagataagtgttttaataaaattgggtgtataggttattatttattgtagtgattagtgatcttagagggaatgtcagaatcattctcatagtaaataaatagacttttgttttgttttgtttttttgagacagagtctcactctgttgcccaggctggagtgcagtggcacgatctcggctcactgcaacctccacctcctgggttcaagcaattcgcctgcctcagcctcttgagtagctaggattataggcatgtgccaccaagcccagctaatttttgtatttttaatagagatgaggtttcaccatgttgcccaggctggtctcgaactcctggcctcaagtgatctgcccatctcagcctcccaaagtgctggggttacaggcgtgagctattgcacctggccatagatacatttttgtttgctacaaatagaaacactctagtttaactctgttttccaaatgaactctttaaactcagagactctaaatgggcacaattgtggcagtccatttgggaaaagaaagatcaagattgcaatatatttatgtatttagatatattttataaaaatcacactataacagtatcagtatttaatacatacttttaaagtgctagatgtgttccatccagagctagagaataattaaaatgtgtgattaaaatgtgagagattgcagtattttgacgtatacacacaaattaattatatagatagaaaagaaatctcagtgtgaggattataaagaagagttcagtgccttcattcctatatagttttatcttctagtcaagccccagccccaagagattggttaccttaggaaccatctctctagttcagtctggatgtggtcccttaggcctttttggctggaaatctgcctctttccttcttcctatcttcattagcattttattggtaagtcagttttggtacaacaggtgtaagagtactatctacatccaccaaatggccttgacttgaaagtcagcatctgccatttcttaatgactaacctcctgatgtgagggagaaggagctaggaactagcacctcttctgcagctaggagttggatgccactccaacctataatatgttagtgtttgataactttaccctattgtcttgaaattagggcagacttaacttgagatatagtatatagtgtttatcctttttgatacagggtcttactctgtcaccttcccaggctcatgtgatccacctgcctcacctcccacgtagctgggactgtaggcgtgcaccactatgcccggctaattttttatttttttgtagagatggggtcttgctctgttgcccaggctggtcttgaactcctgtgtgcaagcagtcctcccacttcggcctcccaaagtgctgggatgataggcgtgagccactgagtctggtcggtttatgtttttaaaaagtccatttctcccaccttcagccagccttcctttagcttatgcagacatgattgcccttccttttgttacagtgtaagacaactcatttcttaaaatacagtctgcaaatatagtgtgtattcctgttttttttttttaagttaattttttagagacagggtctcgttctgtcgctctggctggagtgcagtggtgcagtcatagctcaagcatccttaacttcctgcgttcatgcctttctctcgcctcagcctcttgagtagctaggactgcaagtgcatgccaccgtgcctggctacattcctgtatttttattcatcatgtactatgcccactttccttatttctcacagtttatcagccctcttatttcacattgtaacaggatgctgtatacttaacctgacgttagattttgaagaaggcagtatatatgcatatgtacagaagggcagtgtaaagcagtgagttagactgcctgggttcgtaatccagttctactacttatttcagtgtgggacttaggataggttacttaacattgttaaacttcagatgttattacaagaataatatatctaaagcgcttaacataatatttggcacataataaacacaaaataaatcttagttaatgtcattcataagattctcaaaaaagtctctgacctataactgaaaatgtacaacttgccacataattttttctttcactctgttctcgcctttttatactcttttaacacttacgtgaatgggaataaaacactgtgccactttattgtgatgtttcaatttaagttgaagtaagcccttgagtaactggtagaatgcagactttggtaatataaactaattagaaattctctggaacaggtgactgacaggccctggtacaatagtatactacttttggccaagttttattcatccttaaatcttttttcagagggaaataacggaatatttgcgttacacgatatcattactgtttatagcatcagaatttgggggtgcagagacagaaatctgtctgtaactagattacagacagtctaacctcaaactaggttagacaaaatgaagaatttcatgtaagtctcatggaatttcattaaaggagggatatatctgctcccagggactcaagtgccaccagaatttattttctctatttctgcttttctacatggtttacctctttttgtttttgagacagggtctcactttgtcactcaggctggagtgcagcagtgcgatcttggctcactgcagcctcagcctccctggatgaagccatcctcctgcctcagcccccctagtagctgggactacgggcatgcgctgccacacccagctaattctttttgtattttttacatggacggtgtttcgccatgttgcccaggctggtctcgaactcctgagctcaagtgatctgcctaccttggcctcccaaagtgctaagattacaggcgtgagccgtgtcccacctgacttgtcttttcagaccaactttcttcatattatgctgtcagtttgtaggtctcccacatttactacttgagatagtctatgcttctttcttaagttgctgttgataaaactccagaaacaaagtatggacaagcttgggtcatgtgtccactccaaatctacggccagggaatacagttattccaattatgtcagctactatggtcaaggaggtgaactttcaagaaaaataagtgcttggaatggaagaaagaacatttcatgtgagaagacaagtacagaagtagagagtaggagaggcttggaggggaaataataaataatccttacatgatgcttgtttatgcttgctaaatctttacttcagttagcacaaagcaggaacacaaatacatgctattgcaatttgaaacaggattcctcagcaaaattgattctgatttttattatagttgtagcccggagtttgctgcaagattttcacttttaccttagattaaataagagactttttatactgtcgtgcttcaacttgtatttttggtggtgatgattttttctttgttgcttactaagctgatattactcacttgatattgggtgacagcttgagttacaagtttaatactagtaagtaagcattttcttttccttttttttttttttttaatattcttgagacagggtctcactctgttgcccaggctggagtgcagtgacacaatctcagctcactgcagcccctgcctcctgggttcaagcagttctcctgcctcagcctcctgagtagctgggattacatgcccacaccaccatgcctggctaacttttgtatttttagtagagttggggttccaccatgttggccaggccggtcttgaactcctgatctcaagtgatctgtccccctcagtctcccaaagtactgggattacaggtgtgagccactgcacccagcataagtaagcattttcttgattgaataagtaagggtattttttttccatgtgataaagcccatctaaaaataacgttgtgtaaaaataaactattagaaggtatatgaaagtgtagttgggtacaaggaatatatggaaccagggattcagcatcaccaggacctccatctctcctaatccctggttgaatcctgttgcatctcttcaattttttcttttccacaaccactaatttaatttaggttctgatcataatacaggtgaatgtgtagtgaatgatagcagtggattcccacatggcaagcaaactaaatcttcccctgcctaagttcacgttgagtgttttgttgtgtgtgtaatttcccctaaatacttccagagtgtcagtaactattcagtacgctcaaattgagtcaggagtataacagaagcctttaaaaattacgtaaaactagagaaagtaggtaaaaatagtaatcctgactttcattaatctataactgatctttcagtaatgtatggccttctgaaatgatactttgtttttagttactgtaaatggtatgtctgctctaatcagggtgactggcttattcatttttgtttctgtaccatacatttgtcatttgctctgacttgaatgacttttctccatctgtgccagttctattacgattgtaattcaagcatttcccctctaaatgcactgtgatcaggctacttttgactctctctgttctctgcttagtcaatattggaggtgttggagaatttttctttgagaaatgaatttttttctttttccttttttttttttcttgagacagagtctcaactctgtcacccaggctggagtgcagtggcatgatctcagctcactgcaacctctgcttcctgcgttcaagcaattctcctgcctcagcctcctcagtagctgggactacaggtgtgcaccaccatgcctggctaattgttttgtaattttagtggagatggggttttgccttgttggccaggctggtctcgaactcctgacctcaagtgttctgccagcctcagcctcccaaagtgctgggattacaggcgtgagccactgcgcttggcctgagaaatgaatttttacaaagtgagtcacacttcttatctgtatatccaggagggaaaaaccttaatctatgattgtcagacattctacattcttgataatggttaaaaaagaaaaattctttttccatgtagttagtatgtcacctatccttttgacaaatatttgagctggatatcatatgtcatacgataagctttattaaagttaatgttcaagctttattacctcccattggaaagggtgatttgcaggtatcttatcccagacctgtgagatcagtggttttcaaggtagtctcataccagcagcattagcatcacctgagttttttttttttttttttttttttttttaattgcaggtactcgggcctcactggagacttactaggtcagaaagttgggtgaggctcagcagcccattttagtaagccctcaaggtaattctgatacccttaataagacagaccaatcgtagagagcctgagggcatttgtttggttgctaatacacctttttttggagtgaacgaagtaccatgatcttgtcagaagatgagttcaaaatagagcatggctatgtaattagctgtgtggtttcaaaggattagttataacacagttataaaaattaaaggtagtggttaacaggatagttttgaggatcaaataaataatgaaacaagcttttcatgaactcttaaggcctatgtaaatttcagttgcaaactgttaacgcttatgtttttttccttttggggcccttattcatactagtgacttcagtggcttttattcacaatagtgatcagttgctaaacttgcttctgattttggggtgcaggatatgagcttaagaaacgttacatgacctgagattaggaggtctgggtattataataaagtatcagtgcctgacgtttctctgcctggtttccttatttgcaaataaaggtagcaagcactccatttggtacttctaaagatctaatgaaattgtgtgtgttgacactgctttcatggttgcaagagaaaaagacagtgaaatcaaagcatctatcataaatgcctgacacatagaagatactttatgacagctatttgttattcttgtatataaaactagctttaggctgggcacggtggctcatgtttccaatcctacattttgggaagccaaggtgggcagatcgcttgcatccaggtgtttgagaccagcctgggcaacatggtgaaacccttctctatgaaaaatacaaaaattagccaggcatggtggtgcacatgtatagtcccagatacttgggaggctgaggtgggaggatcatttgaaggttgaggctgcagtgagcagtgatcatgccactgcactccagcctgggtgacagagcaagatcctgtctcaaaaaataaatctagccttttcattatatttctcttactacacttctatctcttattttgaagttttgttttagttcctgagtattgactctccagattcccaaataccaatgtcctgtaccagattcttggtacatggaccagatacttgaacacttaaagcactgttggtgttgtactttgagagacacagtgtaagagctgtcatttgtttgccagctggttatttagctagagtggcaataccttgccttgataaagttaccgcttttcaggttgtagcttctgcaaatcattaggggtcttggaattgatttatctttcagaaatagattcacaaactcattcataaccagaatatccatttgtaatgggaaatagaagttttggatgacagtttcttcctagttcttcctaagaaaatcttttcaaatgataatcattaatttcttcccacacatggattttgagtgatgcaggttaattgtatcatctaatccagtctgatttacccatatccattgtagcaatgtgtttaacacatgagctagacttacttctttccatgactgctggagaaacataaaccatgtcttatttcatgattacccttttttttctagcttctaaactgattgttttctgactgttttgcttcagaccatgtgcattgtatgtgggtgtgcatgagtgtataatatgttcacatgatttggattaaattttctttttataatcagaattctgttatgtttccctgatgctgtgcatttcttgtttactggttagagtgagtagtttgtatagaaagctgatttcatttcattgtgtatggacatttctttttcatccacggagggtctgatttttgtggggattgagggaagtccctgcccaaggcaccatggtgtattgatatgaatatgggcttttggagttagactgtttaaatctggctctactacttgtaacttgtgtgatttgtgaagaaatgcttaacctgtcagcctctgttttcgcatctatgaaatggaaataatataacaagtccgtatgatagatggtaaggatttcatgagatgattttatatgtaaatggagataaccatagagaagaatatatggttaatgtagtccattatcatttctgtatattactactggtttgtttgtgttttttttttttttttttttcatgtgttcgggctgagctctgaattttcgtctgcctttctgggtttgttaacttatagtctatttctcattgttctatttctccaccctcaagttaagtatggtactcttattaagagtgggcatccatgcatagcgttaactgtcattgtgcatatactgaattgattgcaaaaagaatagtccatgttagaccaaggccactttttaattatacttaaagatcttgttgtcagcaattataactggttcattttatagaaatacttaaaagattgggatattcctaggtttcagaaatattttcagttttactttttatgatccgagaattcgtaacacagcttttattcttcactatagaatgaatactccacagatttgtggattatagcctgggaatcagaaatatcactgattcagagattaccttttattttgatttatttaggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagtaagtctatatacatatatttaagattgtagtctttattcttgttgaagttaaaattgcttaatatattttgattacttgtctttataatcttttcctgattttaaaagtgttaaaaattaagatattacagaaatacataatataaaaattggaaatcccctgtaatttactcctgaggtaacagtttggtcttgtcatttcaggtttctttttttccagtgcttattctaattaatttataccaactttctaaaaaaatgctattgcttttaaataataaaggctaattggcagtttgtgtttatttttcttactttattttgaaataattttagatttataaaaggtttaaagttagtatagaacgttcctgtatactcttacctcaacttctgctaaggttaacatcttggtacagtgctattaactaaactgcagattgaattataccagtttttctgctaatgtactttttcctgttgcaggaaccaacccagaggatgatactacatctagtatattcattttagtcttctgcatatattagaacaaaatttatatgctatggtctttcatctgcaactgttttccttacatcttagagaaatttaatttattattccacaggaggagaatataaaggattcatcaggtcaggaggatgaaactcagtcttccaatgatgatccatcacaatctgttgcttctcaagatgcccaggaaataatccgcccacgtcgatgtaaatattttgatacaagtaagtgttactggttgataatatttgaatataatttttactattttaggtattacctaaaatcctcttttttaaactggtctttgaattcatttagtctgaaattcttttcaacagtaaatggattttgttgtaagttattagtttagcaatgcagggtccctgttgttagtgaatatactatggtaattgtgtcatgtactacttgactttgggtgtatttgttttttctttgccctgtttttaaatgtttgtttcatggtcatctttttgtttctcatagtctttcccttagtttccattttttactttctttgcctcttagccttttttaggtatattcataaatacacctaaatttctctactttaaaaggaagaaaaacacttgaagaaaaataaactgtcatgaaatatgtagtaagataatattatctttattctaaatcagttttttcccctaagtttttataggaaatcatttcatgagaatacaattatgtagaaagtttatggtttttttggttttgtttttttaagtgatagggtgttaattatttggttagaaatatcttggcttaattcattagatatctttgagcatatccaaatatttgatggtagatgtaaaaataatatgtagatttagacaggataagcagtcattttatagtattggtgtcttatttattctagatagtgaagtagaagaagaatctgaagaagatgaagattatattccatcagaagactggaaaaaggtagttagaacaatattttcccaaaatttagataaattaatatttttttaaaaagcctcgtgtaattatttttttttttactaactatgtatattgataaaatcgatgtaagcccttttatgacatttaaatgtttggtaaatgttcagattccttcttaacacatctaggttagattagaaatctacatttctggcggggtgtggtggctcacgcctgttatcccagcacttgggaggctgaggcaggcggatcgcttgagcccaggagttcgagaccagcctgggcagcgttgcgggaccctgtctcattttataaaacaaaacaaaaaataaataaaacagaaatccacatttctgatttagtcctgaactagtgccaaattaggcatttgttgccctgtaaaaagtatcacgtatatgtttttcaatattatggaaagcatttgtggaggctttgatatttgttaagtaaattttgtttagtagttcatattgcaagtttttcattctgtattactttataaaagaaaaactctccaaatgattgaatttaatgttgacatttacaactgataagcttattatatgaagaaacagatttggcttcttcgtaactatatacaattaatttctgaaatgaatctaaagataatatattgagattagtttttaattataaaattatatagcatataattaatcatacagttaagttaaagaattgtaagttattgtaaaagaactgagctcttaggaaaaatctatctaaacattatgtagaattagctggttgcagtgatgtttcccctgttgtcccagctacttgggaggctgaggtagggagaatcacttcagcccaggagtttgagaccaggctgggcaacatagtgagaccccatgtcttcaaaaaaattttttatgtagaactggttaaaacaaagaaataatgttatttttgttgagagacaaggttagcccagtttacggtatgtgttaatttgagcaaatgatgggactcgacagaaaacaagaatcacaaaagttaatttgtgtggcctatttgggcaagggttctttcatcctgtttttaatctgattcctacagtgtgcagaaattaagatgaaaaaagctagaaaccttgggagtccttataaattgctgtcccacttcatattcaagtttatgtatcttcaacatgtgttgttttttaatctggagtgttcagtagagtatttgattaagcattcagtgttttttttttaaatgaaagaacaaaagctcagaggtagaacacctctcattgctggagggtattaattacccacaccttactcagaaagggtattaattaaccacacctttctcagaaaaaaattatgtaataaagcaggccagagtaaatgcagattgttttctttcagtatgattttgttgttttaaataattgtcaaggttcagagattcatttttttttaagacttataagatgaaattgagtttttatagaaacttaaggtaggggaaacagttttgaagtcaaacctgaattttagttgtagctctagaacttagtaattgtgtgctcctgagaaaatcaaatttttgagcttcatcttcttacatatagtatgggaataacaatgtcagccttatggggcttgctgaaagattaaaggaaaattgcatatatgatatgttaacacataatgatcttcaaagctatttcccttcccttccctgtactaccgaacaaattaacagatgaaaagaaatgttcagaactgaacaggaaaaaggaagtacctatctttaaactaatccagatgttctcaaccctgtttttatgttagaatcatttggataacttagatgtactgactaccagggccttcattcatagattctaatttaattgtcctgcagtggatccaggcattgatggtttagaagcaccccagccagggttagtaacttgacaatgttctttggtaggcctaggtgagttaagttaaaagaggcacaagatgtgacaataaaggactctttttatagtagaagacataaagagaattccattgtaagggtagagaaaatttgttgtaagtttgattctttttagaaaactgatcatgagaaagattggtttttcttatgggtatagaaataactttattacataaagcacgtctttgaagttgtactggataaaatgagctcctcacatcagtgaggtaacaatagcaggagagagactttccaaatcctaagagttaccaaaacttctagaccatgattttgtacctttcatgcccaattttgaaaatgtcagtaaatgtgttcttaacatttagccatcacacaaaagagggttcatgtaatcttggtctccttgcattgtgaaatttcaccagtggtagtttgcagttgcttttgagaacatccagtttcacctaatctgtgatttgactgtatagatatgattactggatttcctatttaattatatttgtgggaggaggttactttttcattttgtattgttttaatgaaagtcaagccataacctgcttatctatttcatttagagtttctttcatttggcccctactgagctttatacaaaccctttttgttatttttcctactttgaagctctgtttttcagacttcagtctatgtcagaatcacctagagagcttgttaaaataccaatgactgagtcctgtccccagagtttcagtaggtttggggtgggacctgagcatttgcatttctaacagtttcccattagctgtgtgtggtggcatgtgcctgtagtcccagctactcagagactgaggtgagagaattgcttgagcctgggaggtcgaggctgcagtgagccatgatcactccagcctaggtgacagagcaagaccctgtctcaaaaaaacaaaaatttcatagatgacactgatgctgctcatatagggatcatatttaagaccactgtcttaagtgtagatactctgaaaatatctgaatttgactttgtgttttacatgttttgcagttgtcttactaatggaattatcagaattcacttctttgtctctatattttgaaataaagtttgtatttattgtttacgttgcatttcacctcagtattattactaatattttcatccagtcattatttgtcattcatcttcacaaaggtacctctgaggtagttaattggttgtttttgtattttatgacagagaaaccaggaacagtttactaagatggtaaggctagaaaatggatataaaatctgttactagatcttactaatgttttatgttatttttaaaataggagattatggtgggctccatgtttcaagcagaaattccagttggcatttgtagatacaaagaaaatgaaaaaggtgggttattagtaaagttacgtagctgaatttatgctttcagtgtaatgaactgttactttatatgtaaaatgtgataagaacatgacagcctactaagtaaccccattgtaaccccattggtttgtgaaagaggacccttcattatttctgtgagaagaatgtgtgtactcaattttttcagtttggtctatagaagcctagccaaaaaaggaaaaagtgaatgctttttttcattttaaagtgacttacaatgtctcaacagttttttttacttttttccccgtattttcagtgctctaaactttaacccttctctaatctttataatttagtttttagaagtccattttatatcaatgaaaggcataaaaacaaacgagagtaaataactgatataaacagcttatttgctcctgaaactttcactaagcaaaatggagtgcttattaaaatggagtactttggaccaggtgccgtggctcacgcctgtaatcccagcactttgggaggctgaggcaggcggatcatgaggtcaggagttcgagaccagcctgaccaacatggtgaaaccccgtctctactaaaaatacaaaaattagcctggcgtcgtggcgcgcacctgtaatcccagctactcaggaggctgagtcaggagaatcacttgaacccaggaggcagaggttgcagtgagccagtatcgcaccactgcactccagcctgggtgacagagcaagactccgtctgaggaaaaaaataaagaaaatggattactttgatgcttgtgttttaaaaataatttgggaaaacaacttttgtatacttaaattttacatgtttttttttttccatttcatttcatttgaaagtcctgaagtaagtcatacttccaataacatacaatacttgaagatttttttttttttttgagacagagtcttgctcttgttgcccagactggagtgcaatggcatgatctcggctcactgcaacctccacctcctgggttcaagtgattctcctgcctcagcctcctgagtagctgggattacaggtgcccaccaccacgcccagctaatttttttgtgttttttagtagagatagggtttcgccatgttggccaggctggtcttaaactcctcacctcgtgatccgcctgcctcggccgcccatagtgctgggattacaggtgtgagccaccatgcctggctgaagattttttttaaagagtctgtttcagattattcacctcatttgagttccagaaaaaatgctgtgtatgtttcctttttttttttttttttttttgagatagagttttgctcttgttgcccaggctggagtgcaatggctcaatctcggctcactgcaactttcgcctctcaggttcaagcagttctcctgcctcagcctcccaagtagctaggattacaggcatgcgccaccacgcccagctaattttgtatttttagtagagatgaggtttctccatgtcggtcaggctggtcttgaactcctgacctcaggtgattcgcctgcctcagcctcctaaagtgctgggattataggcatgagccactgcacctggccgtatgtgtgcttttaatgagttcatgtgcagtgtgacatcactcaggactagaaatctttatttcttttatttcagttttcttcacatttcaacttaatatacacaaaggcctttggagttgtattaatagaagttttttgttgtttatttctttttagcattctctccaaaaacttactttatattctaagtatgcacctactctcagggcaagcagcaggtcagaggcagtcaagggaacatcacaggccagtacggtttttgtgatagcaatatgttttaatacatcatttaaatgtttaatagctaccacttatttctcaaggtaattcctgcaagatataggaacattgaagctagcagtatggagtgactttattacatatagaaattctgtacatatggtatgttctgtgaacgtataattgtgtgccaaaataaatgatctgttggcttttgtatttatttttgtaattgaaatgtcagttttgtgctttactcgtatagtagttagcaatgttcaccattgaggtttttctttctgcaaataaatgaactgaaagacatttgtttttattaaatttcttttaaattttgacaatgaaagataatagagcctattttatattttagtatttatattataaatttatattatagttgaaaatagttttattgcagtatactttgttttttattttaatatgttcgtattatatatcaacagtgaataatgatcacattctcttatttatgcttagttttaatttttaatttttgtgggtacatagtaggtgtatatagttccggggtacgtgagatgtcttgatacaggcatgcagtgtgtaacaaccacatcatggcaaatggtgtatgcatcctctcaagcatattatcttttgtgttacaaacaatccatttatactcttatagttctttaaaaatgtacaattaagttattgattatggtcaccctgttgtgctgtcaactattaggggttactcattctatttttttgtacccattaaccatccctacctctctcttactcctttcccggactgaccttcccagcctctagtagccatccttctgctgtatctccatgggttcaattgttttgattttagatcccacacataattgagaacatgggatacttgtcttttccgtgcctgactttttgcttaacataatgaccttcagttccatccatgttattgcaaatgactggatctcattctttttttatggctgaatagcactctattgtgtataagtaccacatttttttttttatactttaagttctagggtacatgtgcacaacatgcaggtttcttacatatgtgtacatgtgccatgttggtgtgctgcacccattaacttgtcatgtacattaggtatatctcctaatcctatcccttgcccttctccccaccccacgacaggccccggtgtgtgatgttccctttcctgtgtccaagtgttctcattgttcacttcccacctatgagtgagaacatgcagtgtttggttttttgtccttgcgatagtttgctgagaatgatggtttccagcttcatccatatccctacaaaggacataaactcctcctttttgatggctgcatagtattccatggtgtatatgtgccacattttcttaatccagtctatcactgatggacatttgggttggttccaagtctttgctattgtgagtagtgccacaataaacatacgtgtgcatgtgtctttatagcagcgtgatttataatcctttgggtatatgcccaataatgggatggctgggtcaaatggtatttctagttctaggtccttgaggaatcgccacactgtcttccacaatggttgaactagttcacagtcccaccaacagtgtaaaagtgttcctatttctccacatcctctccagcacctgttgtttcctgactttttaatgattgccattctaacggttgtgagatggtatctcattgtggttttgatgcattcatctgttgatggacactttttttgccatctgtatgtattcttttgagaaatgtctcttcagatcttttgcccatttttaaatcagattattagacttttttcaatagagttgtttgagctccttatatattctagttattagtgccttctaagatgggtagtttgcaaatattttctcccattctgtaggttgtctctttgttgattgtttcctttgctgtgcaaaagcttgttaacttaatatgatcctatttgtctatttttgctttggttgcctgtgcttgtggggtattattcaggaagtctttgccctcagtccagtgtcctgcagaatttccccaatattttattgtagtagtttcatagtttgaggtcttagatgtaagtctttaatctattttggtttttgtgtgtgacaagatataggggtctagttccattcttctgcatatggatatccagtttcccagcaccatttattgaagagactatcttttcccagtgtacattcttggcatctttgtcaaaaatgagttcactgtaggtatgtgacttgtttctgggtcctgtgttctgttctgtatgtcttatttttatgccagtacatgctgttttagttactgtagctctgtagtataatttgaagttaggtaatgtgattcctccagttttgttctttctgcttaggatagctttggctattctgagtcttttgtggttccatataaattttaggaactttttttctatttctgtgaagaatgtcattggtaatttgataaggatttcattgaatctgtagattgcttttggtagcatggacattttaacaacactgattctttgaatccatgaatgtggaatatcattccattttttttttttttggtgtcctctttaatttcttttgtcaatattttatagttgtcattatggagatctttcacttcttcggttaatttctaggtatttgattttatttgtggctatcttaaatgggattagtcttttgatttccttttcagaatgttgacttggtggcatatagaaatgctactgatttttgtatgttgattttgtatcctgcaactttactgaatttgtcagttctaatagttttttgtggcgtctttaggtttttccaaatacaagatcatatcatcagtaaacagggataatttgacttcttcctttctaatttggattgcctttatatctttctcttgtctaattgttctgattttttcatggtttaaattctaacttaatattttccattttaacatgattttagaaagtaattatgcatatgtaatttttttcagggacgagtgatttatgaagctttctcattttgagaatttaagtatattagtttgtgtaaggaggatcagactaaacttagcagaatgagattgctttggagggatcgctgtggtaaaggggcattcctcagctttgtagttctagaaattcagacttttgtcaggatacccagaatttgtctcctcttaagataccctataccataaaccaaattcttgaaactattaggtaaactatgctgttagaaataaaacttgtcaaagggacagtgctgattagtgcattcttatggaaaacatttcacaggatatttttcatcagttttgtgaacacagacttttttttttaagtgccacaaaactaagatatcctgatatctttattgtagggattacttaatggatggatcagaattctccttttcattgatacgtggaaacctccttacctagtatcttggagagacattgacaaattttttctctctgccatccgactttttttattaggcaccatgcagattatatattcttcattggttagcactcctaattcaaacagttaaataaacatgatttgttagttataataacattccaggcatgctcctttggacttgtatctgttttgattacaaaatctcctgagctacccttaactttttcctaaattcatgtaagttatcatttatactaaccacagtgtattttaaccttttgtttactcatctttgtagcattactggtaagtaggtcgatccttgccccataggcacttagtaaacatttggtgcctaagtgaataggtgggtgaattatttccgaattagggtttccttatatggccttgtctaccccaaagatcccaaaaatataagaactttcgtctgcagagaacagaggctgagcagagaatagaaatcaatagcagtatatccagattcattttatcatggtagttttattgtatttataatttaggatataactaggattgtaccagcagattagaaaaggaatgatgtttattaaggaagattttctaaatattttcctttgggctgtactttaaacaaaagtatctattttgggaaacaagggaagatagaagaaggttttgaagtgtgtgtgggtgaggggacaagataattcatgtgaaaataatacggccgggcgcggtggctcacacctgtaatcccagcactttgggaggccgaggcgggtggatcatgaggtcaggagatcgagaaccatcctggctaacacggtgaaactctgtctactaaaaaatacaaaaacctagccaggtatggtggcacatgcctgtagtcccagctactctggaggctgaggcaggagaattgcttgaacctgggaggcggaggttgcagtgagccaagatcgcgccactgcactccagcctgggcaacagagcaagacttcgtctccaaaaaaaaaaaaaaaaaaaaaaaaaaaaaatcattgcctggtacataggatatgcttaattagctgttaatttcttttcataataaaagaaattttgacgctgttagttattctttgtctcttaaaatgtttctcaggctggctccttcctgttgtcatttacatatttgcctcatctttgaaaacaaacaaaccaaaacaacataaaaactttcttcacctctactctctagctactcccctatctccaccatcataactaaacttttcaagagtcttatttcttcactttccatttattcttcagtcttatccaatgtggcttctgcttccatctctctacagaaagttctcacaacattcacctccttgttagtaaagctggcataacctttttcaattttcatcctcatcactcaacagaatttaaccagtctttgaagctattctttgaaacactctcttcccttagcatctgtgatgttacattcttggtatttcttctgtttgtgacttttgaattttatccatgttttcttcttatcatttggaattccacaggctttgtcttaggtcatcctcctttcattactttttgagttttaattagatttaggctttcatcttcttataatggaaattatgatgaaacttaaatacctttaaaaaagtaatgacttgtttttgtgaaagtgatttatatacattatacaactcaagcatcacagaaaacataaagtaaaatttacttcaaatcccaccaccaggaattaagcagtgttaacatttggtgagcattcttctagacatattttcaaaaataatagttacagttacaattacaggattttagtatgtgccagaatgattgtaaagtgctttaaatccttaaaactatgtggtagagttattgttacctcctttcacagatgagacagaagggaaataatttgcccaaggtcatcatacatgtaataagtggtagagatggtattcaaccaagagagcttggaatttggtaaactcaagataaagtcagactggatctgcagggggcataaagtggtacctcctctctgtttaaattgtttaatttacttaaactatagtttttgcccaagaacgaagtcaggcaagtagtagaaccacactgtacctcagttctcaacatttggctctgagttgtttatttagtaatatgttttaacacaaactctatcagtttttagaaatttgtttaacattgtcttttactaatttagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggtctgtgaaagaaacaactgttagaactttgccatacacatttatacatgtaaatgctgtcacttgcattgttgttattctgtccaccaaactttttataacattattgacagggaatctgaggttataatccctgtaagatatccgttgttaccacagtgacttcattggtgtgaagctcaaaaacgaaacaaaaacctgttttattttgcctgtatatacttttcattaggctttttaaaattcctttggctatccctaagaatctgtgtatatcaagttggaattctcacctcggattatcttatgtacatggtaagaccagtgcctaccatgaacctatcttttttacctttttaatcattgtttttttctgatttgtttaaaattataggaatctcaagaagccacaaagaagggattttcattgatataaaatgaattctttttagtcctagggatactatggccaccaagtttatgcatatcctactttgtacatatttaaaggtagttgatttatcaggatcgaattcatatttgtttttctttggagttctctatatataacattcactaaagttatttgccctcaaaaaggatgaaaacactggatgtttgaaaaacttttaagaaattgtagcattgaactgtttatagtccttgtcacatattcaagccttttatttttctaggctttatatgaattggttaaatgcaattttgatacagaagaagcattgagaagattaagatttaatgtaaaagcagctagaggtaagtatagtttttattcattttcatgatttggcagaaattttaaaattaagcttttcagtttacctaggtatagcctaaacttaataatactgatttttctgagtttgataaatatttacaaaataccaagtattactaaacaaatcgttacggggagtgggattaagattgtcccttcctcctttgtgggaaaatacagtcatgtaagtaaaaatgtaaaaatttatactgccttatgcattcaaggcatatttataaatattttcttatttgatcttgataattgccctatgaactaggtagtatgacagataatacctttacttaaaggtaaaaattgatgagcctgagatctctgaactaaagtaacttggcgaaagcaaacataattcatcagtaatgaagccatgactaaaatttggatttttcttttttatactatatctggctcctaccccccttcactaagagtactacatatatatatatacactacatatatatatatatatatatatatatagatatgtaacaaatgagagatatttatttaacaaaaatttgagtgccttctgaattctgaggatgtaactataaacaaagtcccttcccctcgtggtgcttagagcttaggtagggaaactggaaaatagctgatgaattcttcaaggaaaattagagggtgctattgaaacctgtagtaatgggacttaacctatttgcagagagggtagtgcttttagggaaagcattcagaatgaagtaatatttttgttgggatgcaaaagaattatctcagtgaaaggggatgaggcaggaaataattctaagcaaaggagagacaccatgcacaaagtctgaagtaagaaagaacatggcaaatttaaggaattgaaaggtggctgagatagtttgatcagtaagaattaagaagaaagtggcacaagttgaagctggagaggtagggaccaaatcattcaaaatcttattaaataaggaattgttgtcactttatcttttgcaacaattagtaatagagctcaggagtaaaatgcttccctcatttttacgagaaggttaagttttcatttgtaattttgttatatgcaataattgggggaatattgcttaacagtttgttcctcccatcttgtcagaggaattatctgtttggacagaggaagagtgtagaaattttgaacaagggctgaaggcctatggaaaggattttcatttgattcaggctaataaagtaagtaatgataatctcttttttgcaaaaagaaatttagttgaacaactcaaatggtcatgtatcgtaatttgttatattgtctagtgttaaaggtttcataattaatatgacaatattttggtatttagtgagtaattatagtaaggctgcctatacttcctaacctataattacctgttggtgactgttttcagtgcatcatattgcaggtgtttaagaattgtactcatttacaagcatgttaatcaacttctagttggggtgtgtatgtgcaatgcaattctttatagctgttttccacagtctgtgactgttttatggagggcctttgaaatgatttggaaactttaaagcactttcaatatgacattatttgcagttaaaatatttattacatttgcttaagtcctgagtggtctaaaatcaaatacttaatatttaacttagttttagtcaacatttaattttctaggagcttctgtgtcgataaatcagctttatattcttatagttataatttgaggattttatttaacataatcatttatcatttcatgttgataatatcagtcatgtaatttatactccaaatagctttataattacttacagatttgttttggggcttaattcttataactgaaattaggtatgatttttaatagtaaccatataattatatagaatagaaaaatgtgttgtttccatgagcaacacattaggacaacagattaggacaggcagaattaaagtcttggagattaaatgtaggaaattaattcccaggcttatgattatcacattatttttagttagtagaaatgacaagggtattggtttatgtaattccttaaagatagcttctaagttttgtgtcgtagcttgtccaggaccttgttgaaagtacctgggcttatgtctgaggctctgaatagtcttctgccacagctctctttttatacatttggatgtgattggattgtatccagttgatttttttgacacatatttaatattttttgttattaataaaatatttacaaatcctgtgggttcatttcttaaattttgtcgtgcattaactagtttattcttatttttattattttttttttaagtgggaactgggcagtgaagagccccactcccaattagttcattcttaattattttgttgaatgttggcagtttaccgcagataacactaatagagaaatgtttagttttagcatttaggataacttagaagacaatgtaattagtttcaaaaatgtatacccctaatgttgtgttcatatcatctgataacctcaaatatagttaacattcaagaaaaggagtgcattatgtgactggccgtgtatgtttttgattaaaaaagaaaaaagttcgttgtttcatggttgaaagggacaacatttttggatgaggttttttttttgttgttgttgttgttgttttttaacacttctgcttgaattaaaacactcttaaccaaaccatgctgaattacctaaggaagggacccctggaatgatagcttatgtaacaagcagcagcaacaaccctgaccaatatgatttttttaaaggagttaagaaattataggtgacttgaaacttagagccaagtaacataagtattaaaagtataaccttgatttctcataaatatttgggacagtggcatttaaatgttacaaggtagaagtcagctgacctctacataatacactaaattactctagtgcacaaaaagaggacagtaattctttaaaagggagacgagtactctagtgagaatatcgagtttgtttttatgtctggaattaaagttcagatcttaatcataagttctattttgagggcttttgttgaagatttttcataatcttaactttgcatgccccaaaatgactttatctttttgctttcagtaaagtacagttgacttagttcgaatctatctagaaataagatcctagaggagacaaaaaacagcttgagaggatgattttttttaaagtcctgattgctgtcagtctcagagcaatatggatcagagctgtacagtgcaaacgggaagaaagcaaaatatatgttgggtaagggagggtatcatcaacatttgtcctttaggtgcaatcagtgctacagaatatttacttcaagagcagaaatttatgggataaagaagtatattgcatccagaacacatacagacactggatttccttttaaatggtcagtattgccggtgcagtggctcatgcctgttatctcagtactttgggaggttgaagcatgcagattgcttgagcctgggagttcaagaacagcctaggcaacatggcaaaaccccatctctacaaaaaatagaaaaattacctgagtttggtggcatgcaattgtggtcccagttattgagggtgctgaggcaggaggattgcttgagcctgggagggcaaggctgcagttagcggtttggtgccactgtactccagcctgggcaacagagcatgacactatctcaaaaaaaaaagaaaaagaaaggaaaaaagttatcagtattttatttatatacatcagccctaaatcctcagtattttatatatatacatcaaccctaccaccagttctcccggctaagtaacaaaaaggaattctgtcagcatcatttaattccgtaggcatttaacattatgtgaggggagccattcagttgcacaaataggtacagcacagtaagccgcaagagtaacttagtaaacaaagcattagcattattatgatacttttaactcactgtggcatcttcccagactttctagagagtaaattaactgagtctgggttgctgttgggactagtaagagaatctttcaaaagggaatttaaagatacgctccctaggtacccgtactctgtgagtaaaagtattagcaaactgtttataacatttattttaacatgaatgccacttccaggccttttttttgtgtgtgtgtgtgtgagactgagtctcattctgtcacccaggtgggagtgcagtggtgtgatctcagcttaatgcagcctctgcccccacccccaccccctgctggggttcaagtgattctcctgcctcagcctcccgagtagctgggattacaggcacctgccaccatgcccggctaatttttgtatttttagtagagatggggtttcaccatcttggccaggctggtcttgaactcctgacctcgtgatccaccccccttggcctcccaaagtgctgggattacaggcgtgagccaccgtgcccggccaacttccaagcatttttaatacaggaatatatttttctagtaaattaggatgatggtagcattttaaaaagcacagtgctgtatatctgaagacctgttgccaatatattatttctcttaatagatgtttagaaagaatagctttcaacatagctgctacactgttgtatgttatatataggattatatttcagttaaggactagccaaatttattttcaaacttcagatgtttatcatgaagtaactttgttaaaaaggagattcttaaaagcaagcatttgtttcttacaggtccgaacaaggtcagttggtgaatgtgtagcattctattacatgtggaaaaaatctgaacgttatgatttctttgctcagcaaacacgatttggaaagaagaaatataatcttcatcctggtgtaacgtgagttaattttttccttaagagctatatatacatttttgctaagcttttctagatttttcttgagttaattattattttgataatcttgcttttatatacttgatcttaaccagaaggccgagagtgataaaatcttgcttttataatacacattaaactttaccatctattatatcttcataaataaggcatttagacttttcagtgtcttatgaaatattgtaaactacagttcatattatgtatgagacaagcatatcattaaagcaagatttagaatgtatatttttaatacactgttgagaagaaatggatcagaacagctgtgaaagcatgtttttcttaaattcagttccattcagtataagcacatacagttttaatcttctttttttttttttgagatgtagtctcaaatctgttgcccaggctggaatgcagtggtgcaatctcagctccctgcagcctccgtctcccggcttcaagcgattgtcctgcctcagcctcccgagtagctgggattacaggtgcctgccatgacgcctggctaatttttgaatttttattagagacggggtttcactgtgttgaccaggctggtcttgaactcctgacctcaaatgatccacctgcctcagcctcctaaagtgctgggattacaggagtgagccactgtacccagcatacagtttttttatagaggaaaaaaaacatgtatatggtgactttccttttcctagctttcctgaatctttcctctaacaagtaatatttaagaattagtaatgtaactctagtgtagtcccattgacacagatatgggttgttgtatccattctttatgtaaaatgtctgatatgcctaatttattcccatgttaagagaatttattgtctacacctcattcagtctagctttggagtgaaacattccactaccactggcaatttgttacttaaacagaaaagagtattgaaccccttgtctttcatgaattgctttaaaatggtgattaattgttatgatggaattaactttacagtgctatccttaattattccctaatgtttacagaataaaaaaataatgcaaaataaaaaataaaaataaaaaaaaattgactttgtcaatgtactccagtaaagatgttcttaaagctgaccaaataattaccttcgaaagatgtgcttgggccaggtgcggtggctcactcctgtaatcccagcactttgggaggctgaggcgggtggatcacaaggtcaggagtttgagaccagcctgacaaacatggtgaaaccccatatctactaaaaatacaaaaattagctgatgtggtggtgcacgcctatagtctcagctactcgggagactgaggcagaagaattgcttgaacccaggaggcggaggttgcagtgagccgagatcaaaccactgcactccagcctgggcaacagagcgaaactccatctccaaaaaaaaaaaaaaaagatgtgcttgtatgtttatttgatcttgctcttcagactcctaaactgcactgtttcttgatcaagttcatttataggtaggtatctctgctggtcacttccttagaaggtcaaatgctctaaagcccacagtaaaacaatctgaaagagaataaatgggtatgattcacccttggaaatcatgggacaatggagtgtgtacatcatcccccattattcaaagctggtgattgctaaagtggaatttcataaatagcagtattgcaaattttatctaattgcttaatgttaaatttatagttaattttttttccattggtagtattcaagcataataatatagaattagatacagcatctagtctgcagatatatcttaaaatagtcatgattttcaaggtattatatagggaaaagcaatagtaacatcttttatttttttcaaccatttcagaaataatgttcacacgtgagctacattcagtctgtaatcatcagcagtaacaacataagaatggccatgctgggtcagacccatggttcatccagttttctctttcagaaagcatcaccaaagtgtgggctggcttagttggtcctctgtgatgtcaagatcaacaggttaggtagggatgtgccaccaaatgttctaatttctctattgatctccccatagcttctgaaaactttttgaagatacttttatctgtaactttaatgactcttaaggttaaatattctttaggtagagtggccacagttaaaaataaacaatatcttaatagtggtcacctggtataatggtatgacgtgaactaatgtgttttttcccttaggcaggaataccatggttttgtaggcttcagttgtagccccactgggttgttttttttttataaagtttatttaactgaaagaatcatacttttttactgagactcttcccttttagctgtgttatgtcttctgtaagaagcagtgaccaaactacatttctttccagatggggataaatttttctggtttgcttccattaccatctctttctgttaatagctgcactttaagtgacttcataaaacattaagctaatgtgtttagagagaaatttgagtgaattttctcatccttctttttaggtcaaaatccataattcagagcacattatcctgaaagtcatttgttcaccaggatgaaacacattttccccttttctgcctacaaacagcctttgaaagattctgctacacattgtccctatttactacctggaagaattgggaaccttattggagatttcattgtagaatactcagctttccaaataatttttccaaaaactaaacattaactcagcataactttgattacctgaatgctgcttcaactttctggatggtttgtctgattctgccctttcctgaatattctggatgctattaatctttaggaaacaatgataataataattactatcctttcacagaattatgactatatccagaaattaaaaataattttgatatcaactcttgtttcctttgccttggctttttttttttttttaaagacggagtctcaacctgttgcccaggctgctggagtacagtggcgcaatctcggctcactgcaacctccaccgcccgggttgaagtgattctactgccgccgcctcccgagtagctgggattacaggcatgcgccaccacacccggctaattttgtatttttagtagagacagggtttctccatgttggtcaggctggtctcaaactcccaacctcaggtgatccacctgcctcggcctcccaaagtgctgggatgacaggcgtgagccaccacacccggccttgctttggcttttaacttccttcatattatccattcccactataacgtatttatttccaacaattcctcatcatgtgtcttctgttagccttagcacctgaagtccctttgggactcaccacacttatttctgtgtgcttcaaatttgttatgtaatttttctataattatgatgagtagcataaagctgaagaagtcttcaagaccatctaatttaattctatatagatttataggtattcaagaccatctaattgaattcccttcatttatagatgaggaaaataaggcatagaatgtaaattgcataggtcatggtcatatacatttctgagatatgtattagttttatacctcagactattagaagtttcttgaagtcaggtatcacatccctatatttgttaaatccctataacctaggagacagtgatgaccatataggttgagataactacaattaatagcatattatagactattaacacagactttcagaaaattcctcagagcttccactgtttccttcttatttaccctgctcacaaaattctaagagatttgtcttaatatttctatcatacttatgctgaaggaattttaagataaataacacaattagaattttattgagtttctttctgttctgtgccttgcacaacttaggtaccagtggtgcaggtataaacaaagtagactaaaaattcctgaccttggggaattctagtgcagtatctagtatcagcaaactttttctgtaacaggtagagaataaatattttatgctctgtagtaagaaaggacttaatcacactactcagttgtgcagttgttgcaggaaagcagtcatagacactatgtaaacaaaggtgtgtggctgggttccaataatactttatttacaaaaaacagatggccagcccacaggctatagttggctgacttttattctagtggtttagtagcactttttggattatgaaacatttttatgtacatatataatacaataaccatgtgtgttagacatatgatttatctacattttgtaggtgatacactaaacctgagagagacaaatctctatcccagatctgctcaccaatgtcacttaaccacagttacgtagttcaggaatgatttagagaagaaatgagctcacatacaatgagaaagtgacaggataaaaccagcagataatcccaggaatttagttagcatcttatagctcagatctggcagaaatataataccaaaaatatccaggaaggttttaggaggtaatcagtcctttttgttaggctcaaatttgtcttttaggtatcgcctttaggagctttaaaattcaatctatgtttgtacagaaattcttttgtacttttactagacatcacccctatcacttcagttaagagatcttccagttctagttgggccactctgagcacctgcctacaactttacaagctttaaaatttcctatgggtctctaaaatttgttactttaaagccgttatgcatttttcctataaacatgtaaccaaaaggagcttttcatttaaatattcagatcctggtatgatagatgaagcactggaatgaatgttaagtgaatattaggatatatttgttaagaaagccttctgaatttaacctcaactaatttttaattttcagctctttttaatataaaaattgttttattaattttaagggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggtaagcaaccagagaaacatttctctttcttcataataagggacactttcttgcagtgacttgggaaattccgtttgggtttctattaaacttccagagcagaaagtaaaaaatgataacacatgagacaaacataacatcagcatacatatatactaacagaatacaaagtgattggacatcactaaaaagtaattttaataaagcctactgtcaacagtgactatttcttgtaagaaatttgttctttttcagtagcatctcttttcctgtcttgtctagttgggttgatgcctagatacaagtatttatgttaactcttaggtcaaaaccctgcagtttcacatgagatatacagatcattgcaaaataccttgatgtaaggtaacaagtgcactgttttgaatatttaagttctctttgatagcataataaccttgaataatgagaaaagataaagccggtatcaacctgtatattaatattctacagaaatatttgtttttctctccaagaaaaagagaagaaaaaggcataccaattgtttgaggttcagatagtgtttccgtttaaaatatacagtggaccagagatcactgtgctgatcagtagtaagagccagagaattattttgatttcttctttgattaaatggtctttttaagtaaaagagttccaagaagaaagtaataagcgccacccccagctcctctgaggaaactggtgataggagagtaccagtgaagagctgacttcttcctgacagaaactggaagagaaacactgtgaaagccttgatcctcttctgacctttggtctcacattggtcctgctggagtgtatatgcttagttcatttcatgacccctctctgttccctcactacttctaggaataaaccaaacaaacaaaacttagggcccagtaactatgtcctggtccaagaaggtttattgacttgatgtctaatgtttgtcacgtccattctgaagtagaataagatgctgagactctgaccttgggactaaccgtataggctcaagggaggcagacagttggtactactattgtttttcctgtttgttcttaacatattaacaccaaatcattttcttttcctttttaagaaactatttgatgagaacatgctgttaggctaggaaagtgttcataagttacttataaattacttgtagctcaaaagccactcaacattacgtacagtcaaaactgccagctttttcaaaggaaggaaggaacttttcatcccaatgttatattacttttttatatggggctttaattagtactttgaaatcttacagttatttttgacctaatcacagtcgtcagctagctttttggacttgttcctacagaattgttctcttcaatatattatgatgcataatccccatgtgcattcatgatttgagtgcattgagttggtcaaaatagaatattttcttctatcagaatacagtatttgaggctcatcctttatgccgaatatttttcaagcaattaaattgtaattattcagtgatgcaccctatattttacttcttatcaccaaaatttgcattccattttacagtcaactctaaaatgaacttttgttttcttttattagaataattttgcttttacttttctcacctactatagaatttgtatttactttttaagtaatttgtatttacttaagtaaataatttagcactttcaagtatatgcttggatagtgcggcattagttttttaacattatgacagattatttaagtctacttaggtaaatagtgtgtgatcatcttttttttctttttgagacagagtctcgctttgtcgcccaggctggaatgcagtggcacaatctcggctcactgcaacctccgcctcctgggttcaagtgattctgctgcctcagccttccgagtagctgggagacggtgcacgccaccactcctggctaatttttgtatttttagtagagacaagttttcaccctattggccaggctggtcttgaactcctgacctcatgatacacccgccttggcctcccaaagtgctgggaatacaggcgtgagccactgcacccagccttgtgtgatcttttaaagtacagttcccatagatttacattaagaataaaaaagtcatgacatcttgcttttatatggcagtttactcaagctttttaaagaaagagcattcatcttgcttttacgtggttttagaatgttgaaaaccttttgttaaatctgagtaatttactgcattttccattaattcagcttagttagactgctggatccagtgcttgtttgctgtcacatatacctaatatgcttttaacatatgccaaattctgttcttagttctttacatttattaacttatttaattttcacaacaaccctgtgaggaatatctattatgatcttcattgtatatatgtaatgaaatggagatacagaaagagtaaataatttgcctaaggcgacatagcttataagtaatagagcaagaatttagactatgtatttgataccttgcttccttgataacaataactacaagctgttttataatagtttgcaaatttaacttttttctaattgtggtttcatttatatttctttcaacttaggagtgtcatctaatggaccaggtgaaatattaaacaaagaggaagtaaaagttgaagggttacacattaatggaccaacaggtggaaataagaaaccacttcatgcagatatggatactaatggttatgaaacagataaccttaccactgacccaaaacttgcccatatgactgcaagaaatgaaaatgattttgatgaaaaaagtgagagacctgccaaaaggcgaagggtaaacagcaatggaaaagaaagtccaggttcttctgaatttttccaagaagcagtctcacatgggaaatttgaagaacttgaaaacacagatgactaaattttagacctattttactttctttggagtaaattctggtgtgactaaaattttcagggttgatgggttaccttaaaaagttgatttccttgaagcagtttgaaaatttgaattgagtcttaactttaggaaatgaggtttcataattctgccttttgcagatttttttactttaaagctgtcagactcttttaagggtattttaaaaattagtaaatttgaatgaactaaagatatatctctaccttctcatttgaatatctttagttcattcagatttactaattttggtaaatctgaatgaactaaagatgtatctgtaccttctcatttgatgtattaatcataaaatttcactacaaggtaatttttgcttagtttgatggatgaatgggaaactcaagtccaaatttctgcttaataccaatttctctgagtttcttgaaatgtctttaaaacagacatttttctcaccaaacagtttgagtatctttattaaggaaacccttacgaatcctgaaaattatgctagcatgatttttttatatatagaagtttaaaaataaaccaggtcaggtttgtatatgtaaaattgttgacatcaatgatgtctttccatattcttatctgggcttaagaaatacattctgtatttttccagattctttgtagcctttgaaagatttttacagtacatatgtcttgactgagctgtcctttcttaatacaaaagcgtgtataattttcttaacttgtacagttggtaaacttttatgagaggaattgttattctgagtctgtcagctttcattttattttgctaaggtttttctaatgaatttttaagtgtttgtgtagtaattaagtcatatttcttatccaggtggttaaagcattcataaaggattataaaatttttttttttttttttttttttaaatttctacttaagggcaagtaatttgagaattctgaaattaagcatgatgcttagattgcagtttgttttgcatttgctataattttcaaaattatttttgaagcaagacaaaagtttaatgtcagcttaagtgcttaaatatatcatgctgaccagaatcctgttatttttatatgcatcataaaatttcccatttctgcattaaataaacagaggaggggggtcaagtgatacttagatattggcacacacaaggaacaactgttggcaggcagtatcgattttatgaagagaaagtgaagtttgaaaacttttcaaacttttctagttacaatccaatttttcagatttgataatgcttttccaaagtgaaaataagatacacaataatcattgctctgtgtgattacagataggattatccatctgcatagccttgtaaaagtgccattttatttttagtgctaaattcttgttaaataatgtagttttatatagctgatagaccaacctatatccaaacttttataaaatattaattattcttgtttttctcacacaggcatactccaaatgcttcttccagttcatttttcagccatcagttcaagagccaatgcctttttaaaataaagcttctgtggtcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacacttgacttcatcttaatgtacattcactgttgttacatacatatctaagtaaatcaaagttttgggtggaagtgttgagaagtatgagttttttgttgtttttgttttacttaaaacttttaatttatccagaatggcagtagctttagcaagcagatggtcacaatctgttttctaaatcattttttattaaatgaatccaaagtatcctagctctttgtcaaagatggtctgtagaaatgtttttaaagattagggatgctgtactttttgaattgttgcagtgttggagatgccattttcacctttttaaaaagatgcattttatttgcaggtttgtgaagttcttgcaaactcttactacagaaatgttttaaatacattctcaggcatgtttgcaaaaatatggcacatgtatacattttaggaaatgttacttttgttaatctttaaaaaatacacctaatgaaagacattccactattatgcgtaatgctcagctttttgtaaagaaatatttaattgtattttgtgtttatacaggtatttcacacaataatttgttcttaatgcagccactataacttgataagtcattgcactatttaaaaagttttagtaatatcatgaatttaatttgcttaagatttagtacatttcagaacttttgaacttttgacaaattgcattggaaaaagaagtctgttaatagtgatttagtctccccgcctcattcccacccccaacaaagcactatcattttcatttggaatgggtattttctgtttcatgatgtattttcaaatagagttcaggatctgcaattcagttcaacacaagtttgttgagctttaaaatgtatttgaagtaatatttaaataggcatttaaaatttcaaattagatgttaaatttatgcatagtaattttgcactgtaaaataattcccttctcccattccttgtctgccattctgaatatgcttattaaaatatttttttaaacatatttgcctacataatactgtgtgaatattttcattagattaattcactaagattttattagagattgtttgaatgatgcatgttattgacaaggcaaatatatatatatacacagtctgtttcttctattcctagacatattgcactactttttcagtggttcttggtcccctttaccacatcttgggtgatgtatttttgtcttcttcccctttgccacaagagatcctttcagtccctagacctccattcactctgtttctcttctgctggattatataatttaaaaataatgtgttcccgtattttgtagtggagttcatatcacattatgttttgcaaaataaaacttgttttgtcacaatattttctttgctatcgatggataattaggagtgggcacttggaataactgagggctggtgaatataataggcaatatttacatggggtgtgtaactaaataccaaatcagatagtaaggttttcccaactataatccatattcatgaaaaatgccagtgtggaaaaccatgtaacatacagaagaacaggagtttccaaattttaaccttttattctaaaaatgactctcttctctcaaaatgactttttctgtatcacataattctactgatacaactttttaccgtaaaaattaactctcttctttaatatcaagttcatcctttgcagaatcttaaagggttttccacacatccatccacccacttacagactgatttcatgtatctgaatatctgattaacctttcttttctaataccagttttccataaactcttgtcatgtacccttagtattgtgctgatcttttgccaactatacggacgtggagtttttccttttcagaatatgattattttcaatttgtctttagttagtataaagaattatagaatgtataatgtaattaaaatgtcattttgcttgctcttgagtaagaagtaatttgaacacacttttaaaggctacttattctgtgaagaatattgaagaattgccatgtaaacgagatgagatggattctaattgtccaaattgatggtgacagtttcacatttaaatgtcaatgatgacaagctttcattatgtttccatatactctaatatccagcaaatatttcggcctatacttgtaccaggtactatgcttgcttggcttgtggcttcagagatgcggcatgccctgttcttcaagaaggcagcaaagtgttaatggtagaaaagtaaagtgtattctgagtacagagacagcaaaaagaggaataggcacgatctcaagaaaatgagtttaccttcctctttgccatgtaagtctagctaaatatttttcttttgtcaaacttcgtatttgctggaaattaaccaacatgaaatgcatgattttccctaagaaattttgtcttttaaaaaaaaaatttcctgcagagctggttctaccataacagcagctgtggattatttaggactcatcccttttttcttgtcattcactgttccatgagcactactatttattaggtggagaatcgcctgattttctgaagtttggaagagaggacgcctaatgcaaatttggcctggttatagaacattcactttttggtattctcatcgttgttaacatgaatggttgactgaatgtagagctggctgtgttgttctgcacactgactggaatttgtagagttcaggtagttctaaaataaatggtttcactcagcaaagttagatgatccctgaaattgactttggattaatatgaggaatatataaacttctaaaaaattatttgagacggtctcagttggctgcgtaggctggagtgcagtggcaagatcatggctcactgcagccttgacctccttgggcgcaggtaatcctcccacctcagcctcctgagtggctgggtttacagttgtgcaccaccatgctcagctaattttttttattatttgtagaggtgaggtctcactatgttgccccggccactctggaaatcctgggctcgagtgatcctcccgcctcagcctcccagtgttgggattacaggcgtgagccaccatgtctgagcttaaacatttttaaaaagaaaacatacgggccttaaattgggggtggtttcttccagaaacaagatcaggtagagaactgcatcagaatagattgatctgagccactttaaattcttgaccagaaaatctagatttaggttaagagcttgttcccaagaggggcttttcaaattccttagtctactcttgtcaccagctgtgctttagctgagtgaacatgagaaactagttctgcttaggagctaatagtggtgccagtcattctaagtgtatccttttttattatttttgaaaggtactcccttaatcccctctaagcacatatttgtacatgacagaaatttacttgggtggctggtggttttgagctttcaaacatcctgaattataagctttatgaactgctctgctgtgtggcctcctttgttgtcttatgcatttgcctctagtgtttagtagacaaatgtttgcatttaaaaaacacaccatgaacatacgtggactacatctgcaatttttcttttttccggagacaacgtcttgctctgttgcccatgctggagtgcagtggtatgatcactgctcactgcagcctcaacctctctgactgaagggaatcctcccacctcagcctcccaagtggctgggacaggtgtgcgccaccacgccctaatttttatttttttgtagacagggttttgctgtgttgccagggctagtctcaaactcctgggttcaagcaatccgcctgccccagcctcccaaagtgttgggattacaggtgtgaccaccacacctggccacaaaattcttgtagctagtgctagtaggttagaataaaacaactcacttaggattgcagcagatgggagttgtagtagaacctttgaaaacaatgataccagttttggcaaagggatctattttcgtgtatatgtatagttagttaggaaaagtaatgaaggtcatatgccaaaagtaacggttgtttttgagtggtggacttagagtggccagacccccttattaaagaagtctcatagcacttgtcccaggtgccatttggttttgcatgactatttccccctccgacagtaagcctcctgaaggggagggtcgagtctgttttcctcaccatcatacacccacatccaagcacagtgcctcttcccttactcactgaacatattagcatataggttatagcatagcctataatcatttgtctctcctgcttagggcctaactctggctactctttccagtgattgttctattctgcctttggggatacatcctgagttgccctttgtaccgctgccattcttcacttccatctgagtagtagtataaacgtgttttcatccagttactgcatcactggtagagggtaccattttacttgctttttgggggagctccgactctaggatttttgaaaacttttctttcttcaaagggttgcctggttaaattatggaaaacagcatctcccattgcttgtgtaatcctatacctacacattctcccactctaaagcctgttgatttgggggaggctggggagaagagaagaaacaattacatagatgtcagtgaccacattgctagcctgagtcccagttgccctctgggttccacagagagtcacagtcccatttttgtggcatgaatactagcagtatcagagccctttatttccatccctaaagtttgtcaaaaagtcaactcatcacctatgtgacaaacttaggaagtgtttctgaaccactgtcatttatatccatgctagtcttcacaaggtatatcctgtaagttcgatggggaaagcagtagattcatctgatgcttggagccacattaatgtttattagtccttctaactattccagaacgaggagtgaaagcccacagtacctggccttgcatttccttatctccaactatatctcctattgttcctccatttcaaccaagggatagcctaaaatattattttattcagaatcctcccaatcaaaatatttacagcttttttttttatatcataccacctttttccatacccactcatccaaattcagccacgtttcaagatttctcctcttcatctggccgttactgtataatctgtggtaagcaaaacctctaaactggccatctgtaaaataaggatgataccaatgtgccagtaggtctgttgagattataaatgggataccttaaagggaaaatattttgtccctagagagtgctggctaatgatcaggtaggtaatagtacaggtctacaatcccttatccaaaacccttgtgactagcggtatttcaaaacacatcacagcacattctcgaacaaacctatggctggatatatggccacaataaaatgtattgacatgaatttcaggtcagattttgtagccaaattcgacaagaaaaagcttggttttcagagccctgtggatttcagaactgcaaacttgtagtggctttcaaatttttgctggtgctcacttggcagctggtcccaactgcctttactttctacataactggcagagacaaattagcaggtgcactctaacctgtatagcagcaacaacagaaccttgcacactctgagccttctgcagagcaaccggaagcctataaatgaagccggtgagtgagaataggctgccaaagcccagatgcggtccttctggaatctctcactcaatcctcttgtcttacagaagggaaaatccaaggcagaaaatggaaaaatgacttgtccgaggttcaacaactttagactgagctgctttgacaatgtcggatgcctgtatccttttccttcatggcactgaatggctcacacgtattcatggctagagccatgggcttaacccttgtccagtcaatcccgatggccagaaaagtaggatactattagctacgctttacccaacttgtctttgcggttaggcaggtaggtcttcatcataagatggcagcaccctttgggtttatttggctacaacagttggggaagatgcattccctcaaaaggaaaataggctggtcacagagaaagactattaggcagataaaacaagtctattgcaaatattatctaccattgttaagtgattgctattaaaagcacagcactaattataaaacaatcttcacaacgttattttccccaatttacaaataaaactgagctaccttgagaagttgtaagacttgctctttccaatgatctggattttacctatttttctaagtcaggtctttgtgtttagggaagatgtgtgttgtagaatagaaaacatgttgcttgcaaacaatctttctcctagctttttcccacaactctgaactctagaaaagagaaattcccccagctggaaaaaagacgttagtaggctctgagaatggcaggaatgtgagcttcattctctagaaagacatcagaggaataactacatggagtacaaaacaggttggactctacgcactggaacttccagtagtagaaactattaccagggcaaagtttgcaatttgttgtaccatctgccttcaaaggacaccttagagttggtcactaaggagttcagcagtgaccatgatggactgaagacaagagtccctcttgtatcttctgcgcacaggcaattctcctggatcttgtgtaaccttagcaaagaactgggactgaatttcccggtaggtggcaagatggggactcagatatattttgatataaaataatatgtactgtgacatttctttcaccctcaaacatcatatactttactgcttgttctaggaagctccatgacctcagagaaaaagataggctttacagaaaggcaaatttatattctaagcaaagactgtctcacaaataccactgtccaacaatgaaactttcccatgcttgtttcacctctaaaacaacactaggactaactttaaaggattgtttagaggattaaaatgtgtcaatacacaaggtgctaaaaaaaaatgtgtagcatgtaaaaatggctcaataaatgtatttttactgtggtatagcaggcactctgtttcttgctacacttcaaatattacctttttggaaaactcttggaaacataagttagtcacctcaaagacgttcctcctgcttttatactcggaaagcattgaggttaggtgaaagtacaccattatgttttgtaagtgaaaataattggatcaaaacttactggcttacctaaaatgcaggacaatcagcattcttgtagatcaaaatcagctttaaaaacatttaggtttgcaagcatgcatgcttagatgttcattaggtcatgggatggccatgtccagcactggactctcagccctagcacaggtgggccatgagcccttcgggaaaggttccgttcacctgacgactccggtgagatgattagtttcaccgtcagtgtcacatggccatcttaagtctactttgtcactattagcgctgcagcaccctgagaactgccagtttgatccagagagaagctgaactcataattctgatggctgatgaaaacaataagatattaagaaatccaggccaggcacagtggctcatgcctgtaatcctagcagtctgggaggccgaggcgggtgatcacttgaggtcaggagttcgagaccagcctggccaacatgatgaaaccctgtctctactaaaaatacaaaaactagccagacgtggtggcacaagcctgtagccccagctcctcgggaggctgaggcaagagaatcacttgaactcgggaggcagaggttgcagtgagccgagatcgcgccactgcactccagcctgggcgacagagcgagactctgtctcaaaaagaaaaaaaaaagaaaaaaaatccaaagtgataatgggtgaagtctattcagcatcctacagtggattattaaatttttaaatcttagttgaggaaacaggtgtttcaaataatgttctggaaactatcaggaaacctgttttcaatataggcctcaagttttaattaagtatttaaggtggtttcttgaaaataattaaataaaatgcttaattaaaaaaatgttcccaaagttaaaatggtctcctgaagacacacatttaggcaaaaaaagaaaaaaaaaaaaaaagaagaaacaactttaaaaaaaagagaaacagtcttatcacctgttaattataattcctaaaataactcaaatcccttttcttttctatgtaaaaagaaacaactgtactttaggacctcatcattctcactagcacaacagcctgctctatctgatgcattcacctccagttctgcccttccgtgatccccacctgacagtcatccacgcagcaatcccagtgatcctgtcatagtgcaaatctcatctgtagtagttcaacttagtcacgctggtagccagtgggctaagtctagctggcagattttttgttttatttcaatgcctttgagcaggtatgtaccccaagccccaccattcactctaggcattcacacctggcccctgtgagacatctgaatttgccaacctctgacctacagtatacaatccaaatactgcagctggtgtgatctttctaaaacgcaaatgaggccatgcttctgccctgctacgctaaaaaaaaaaaaaaaaaaaaaaaaaaaaaaaaaaaaaaaaaaaaaaaaacagaccaaaacctctgtcttcatagagcttgaagtgctatggggatgaaataagggagagaagagaacatggtgtggtgagggcaggggagcctatttcagataggctggtcaaggaagacccacagagatgaggggacgtactataacgaaagatgcactccaatcaaggagtgggacagaggccctagaaggtgggtgggctgtccccgccagtattttctcaggcaaatcctagttgtttttcaggaatcagctcaaatgccatttctccaaggaaacctttcctaccattcccaggtggaatgaaattcctcctcccatacattcatatgcatatctcagctatactttcataattctgtcatcatttgtgaacattgtcctcaaaaatattcaccgaaaaaaattatctgaaggataaataggcagatatgataaagcactcttgatgaaaccctcctatttctttctctaacaacgagggatggtatatgaaatatattcttcagaaagaaaggggttttgaaatcaaagtccaggtttacatttctcatgtgagtgaagttggacaaattccttagcctggctaaagccaccatttatgcaccagtaaagtgctggaaggaccaaatatgagaaggcacattttagcccgaacccagtgaaaacacatagtcggccctcagtaaatactgcttttccttcctcttaaactgctttccatcatttagctgccaaaagcaggtgttgccacaagagggcacttttagcacagctggaaaagcatagctgctttgccttctcagattaaaccagccaccatctcatgcttaagctttaaatccacagtgggtgaacaatgaatgaaaaataacatttgacaagtatagagcggtgatgagtttggtactgccaagtctattacagacagacttaagagaaacgagaacctagcatggtggcgaagagcaagggtgtttgaagtcagactgatgggggtttgaatgcgggttccctgaccacaccgggcaagtgtgcctctctgagcttcacctgtagatgccaggcctctagtagaggatgggtgctggccccagtgaactcagtctggcttgatggatggatgaaccaatgtatacataggccccaagtgatgagaactgtaggaaagaagaattgaagttacctggtaaatgctgacccactgtgggtacacaatggcactagctctgtgctttctcctctgagcagtgcatcatctatagcgttgcccaatactgacagcctatgcttcaaggaagccaagtgagacaagaagctatcaaaaagatgaattctaacttcaacaaattagaaaaaaatcagactctaagagggttttttaaagttgattaaaacacatgtgttaaggacaatctcttcaacaaatggtgttgggaaaatgaaatatccacatgcaaaagaatgaagttggacccttactttacaacatatacagaaattcactcaaaatgtattcaagatctaaatttaagacgtaaaattataaaactcacattggatttggcagcatatcttggatatgccaccaaaagcacaggcaacaagagtagaagtaaataactggactacatacaaatttagaactttgctgtgcatcaaagtcaatggatataatcaaaggagtgaaaaggtaacctgtggaatgacagaaagtatttgcaaataacatatctgataaaggggctgggcacagcaccttacacctggaatcttagcattttgggagacccaggcaggcagattgcttgagcccaggagtttgagaccagcctggacagcaatagcaaaaccccgtctctacaaaaaaattagctgggtgtggtggtatgcacctctactccgctactcaggaggctagggtaggagaatttcttgagcccaggaaattgaggctgcagtgagctgtgatcatgccactgcactccagcctgggtgacagagtgagaccctgtgttaaaaaaaaaaaaaaaaaatatatatatatatatataacccctttagatatagatatatctgtgtgtgtatatatatacacacacagatatagagatgtataaagatgtatctgtatatatatgcagataccctatatctaaaggggttaaatatgtatttacaacatatacagaaatcaaaaatatattcaagatctaaagacataaaattacaaaattcttagaaaacaggaggaaagctgttaaatatatatatatccttaaatatatatattaatttaataatataaatattgttatttatatattatatgttactgttaaaaaaatatatatatatctccttagacatatatatctaagggggttaaaatccagaatataaagaattcttacaactaaacatcacctcaagcatatgaaaagatgctcaacatcactaatcattaggaaaatacaaatcaaaaccagaacaagattatcatatcacatccattaggacggctacaatctgaaaaacagaaaata

SEQ ID NO: 365 - DNA, 83336 bp, Homo sapiens
ctgccctttgtgacaatgaggatgaaccgggagaaaattatgctaagtagaataggccaggcagagaaacacaaatactgtactgcatgatcttacttatatatggaatctaaaaaagtcaaactcatagatgtagagagtagaacggtgcctaccagaagctggagatttggaggtagtgattatttgaatggggaaagggaagatgttgatcaaagggcacaaagtttcagttagacagaaggaataagtctgtgatctattgcacagcatggtgactataattaagaataatgttttatatatttcaaaattgctaaaagagtatattttaaacgttcttacataaagaaatgctaagtatctgagatagaaaatatgtcagtttgatttaattattctataatgtgcatatatgttcatatataacatctcctgaatatatacaattcaggatatatatatatatacatatgtctcctgaatatatacaattattgtcaattaacaataaaattaagaaagatatagcaagcaaaaaatactcctcttccactttccctcagtactttacaaatacatttcccactgcattcttatgaagtgctagtttagtaattagtaagcctctttatacttcaccctcattttaagtcaccgtttccatctattttcctttactgaaatctgcctatcctttcactctacagctttctcttaaggaggttgttatttttccattccctacatactaggggactgtgatgaagggtagcaatctcctggtttctcattgccaactccaggttggtttgcttccatggcctctagaaaaactaatgctattagaaggtggtctcttccatctggctctaccatcctctgatcatccctgtggctttgatttaccagcccctccaacagctggaccttgtatcatggtcttcgtcttaccccaagtcctatctgccacagttctaggagatgtaatatgaatgtagacaatacacacatggagatttaaaaaaaaacaaaccaccttccccctttcccccatctgactaattcacttgctcacttcttggatctttccataacctttagaacttattactcttctaaaaccttgagctccgatatctccctccaggacctcctctccttccctctttcacattccctcaccctaccctcatggctcttagactcctttaagtcctccagtcccttgatcctccacccccttgatcctccaccttcccccatcatccaggtccttcatggcttcattgttccccacagggctggatttctttgattgataagataaacttatacttccccaacatcctcaattccttgaggtcctatctgatcagacaagggtgaagggctgtcagaaaaaattacacgcccttgcagattggtaccatttctaattcatggtccctaatctgacatggtcaaatctttgtcatcttttctcaaactcattatgcaacccttatctcttactttgttaagaaaattataccatcaagagtcgtctttcttaggttcacagcacctactcttaaactatctagaggccccattcttacctcctttcttccagccccatgtctccattctaatagaggactatgatttctgtcagagcttctgatcccattcctctgggatcttgggccattagccatacctctcttagtgtcttccattttttcttctttgtgaacttcttttcacttgcttacaaacacgctcaaaactctctccttagtaaaagaaaaaaaaaataccccattgactacctatcctctgctgttcatctcccagtatctcctcccttttcatccagactttatgaagtacaggtttgttgtttcttttcctcacccacaggctgttcacactctctccaatttgccagagtttcgctcttgaggcaatagtccatgtgaattttgtattgggtatttgaaaaaaaaaattccggagtaaaataagggtgagagctctgtgtgtgaagaagtatttaaaagctatttgggttttaaattgtattaaaagtcagaaaatttaaaaacaagtcttccttaagcatttctgttcaacttacaaatctttttatactgtttacaagttgagtataatgagaaatatcacctttacttttttattgattactgtattagctatttttggattaacatttctaaattgaacagaataattttcctcaatactttaattatattcgattaaatattttaaacagtttttcaaaaatttgactttaatttttaagcatttcaaatgtctgacaggacaaatttacaatacctataaacaaaatgtttccgagaactcagataatgcttgaaataaaattatttatactcaggaaatataacaaatcaaagtaccttatataatctgataatatacggaaacttagtcaaattatttttgccttttagcttaaaatcaaacttaaaatcaattgcatattcaattggaattatgaggataacctctgaaattctatgtattttatatactgtataaagttttaaataagaaacagagtttttctttaaatttagcacaaatgctatgtttgctttatttcgacatttctatatttaattcaaaaccatcccatggtggaaaggcacttacctagagtgaccataaaatatatcttctaaactgggacacatttgagagggaaaaggggaacactaaaaataattaaaacttgttaattgatctacagtaggtataaaccaggactatcccagccaaaccaggctgatggtcactccttcctgatccaagtgtagggaatcacttacaatttggacgagcagagctttgtgggtcaagtgtttatgctcacaatatggctatataggtcagagatgtgagtgagaccagacataggtcctgagagcgatctgcttcctcagtgattccatctgtgttgcagggggacctctgaggttttttataactgttgcatcaaccagggacttcaagtttacaccatcaaagtgattttgtgattaattctttctcactttctttattgcctgatttgggtagatagaagttaccaccaccatcatcatgggttgcttttaatgtttccaagaggtcacaactctaaagtcacagggatgatcagaggatggtggagccagatggaagagaccaccttctaatagcaaagtcattttaatggcatctcattgtctttggcatttccttcatcctatttttctggctctgaaacaaatttttgtttttgctcaggataaaggtcattaacaacttcttaatcaaatctaatcgaatttattttttcttagtattaatggaccacatgattcattatctaaatgactgtctcctgcacttcaatttccttcatacccaacttccccgctaacaacacacacacacccctcacctctctaatttcttagctcatcccttaagactcactttctccaggaaaactctaaaagatgcccagctctgtgttttcacagtatctaaatttacccttatcacattgttttataatatttgacttctctttctgactcttctcaccagatcaggagtttcttaagggctcagagactatatagatcatacatctttccctcttagcactaagtttaaggaccagaacatgatggtgtagagaaactttcccgttggagacagggcatacaaatttatttcatgtgaacacatgggagccttcagaatgaagacccaaagatccagggaaaattttccatttttatgattagctttgttaacccaaaatatctgagacaggtctcagtcactttcgaaagataattttgcccaatgttaaggatgcatcggtgacacagcctcaggtccacgatcggccttccactgcatacacaatttagtctggttcagtgaatctgcatttttacataaacaatagggcagagaaagcaatcagatatgcatttgtctcaggtgagcctcagagggattactttgagttctgtctgtctttcgtccacaaggaatttccttgggcaaattgtgagggaggtatgtagcttcttatatttgtagctatctcttccaggaataaaacgggaagcaggtttgtctaacatagttcccggcttgacttttcccttggcttagtcattttttcccttggcttaatgatttatattccacaggttcaacaaagtatggacagccatgtagaaatatgattggacaaaaagggcatgacatactgctaacagactgagtggggaaacccagcaaagctgtctgtctagattcttcttggcctctctgtgtaggattccttccttatgggtatgagtcaggtctctctctggaatgggggtattataacccacagtcaaacaagataggtcagacaatttcttcatggccatattcgcatatcttttggttcttacccttcacacagaaaggcagagggaaggttagagaaatatgtttaggttttacggctggctttagggaaaagatcttctggtttctattatccaccttggggaagaaggattctagtttctatggtagcatcagggggataatgggcgtgaaagacaggcaggagaaggtcagagaaaaactttcgcttttgaggctgcttctgaggacttcctttttggggtgttgttatctgaatctcaacagtggaaaaaataataattaatcaagagtttagactttgcaattaggacagattcaggactgaatctcaattactttagttatataaatttgagaagacttcttaaatgctctgagcctcatgttcctcatgcaatgatagtgataataacaccaacacttgtcctttctcaaacatcacatcctacctagaatttaattatctcaatttaaggcttaatacctgtaaaattcataaacccctgggtgaggtaacattttaaggtgattttggcaacttaacaggtttgataggtttgattgacattttgatgggctagagagagggaagtcctgaagattccaaacggacaaggaagctttggggagaggcaaataagcagaaaagatgaagttacagcaattcaacttctctctctctcctcctctgtaaaatggaaattacattaatagcaatgacattaatatctgtgaggattaaatgaagaatatgtggctcttaataaatattagctgttttgttgttgctcttgaagatgctcagaagacaaatatgactttgttcccaatttgtttttaggattgtatgtacagacaacatatggatttgccagagaagaaaagcaatgcttttagacttatttcctgccttaagtttttaaagtggaataaagagcagtgggtcacataagagctcattatatgggtctttcatcatagctttagatcctgacacgctaagcagagattatgttgcatctgtgatattaaaatacatctgggtatctattactttttggcccttttctatacaaagcacagaagctgagaatcatgtctcttcagatcaagattgaacatactctctctttcactgagggaggtatagggttcagggcttaatcttacactttgcttatcctataacagaaataataatacctattattatttataataggtatgtgaagatcctgggagtccagggtagatggccattctgttaacctgaatatgcttttaatgtgcagcattaatctaagaaaagtgaaaaaatggtgagattttacttcaaaaaatccaaattatatgcaacttaagtcatcttcagtagagtttcagaaatgataggggagatacaatttgaagtgaactttgaagacaagacaaggtgatttgcaatgaaggatatttctagggtaaaagggactttgaatagaaggaacgaataaagaaaactgaaggagaacttgattctattgcaacaagaaacatatggctaattccaactatctggagcataccaactttaaagcagactgtcaaaactgaccctacttaactcattttaaagcatggggttcttccctcaaccaaaaacacagatgccaggttacactttataactggactctccactttcattaaaggtcattataaggaattgccacctaaaatgtgatgtaaatattttttgagaaacctagtatatcacttgcaattccctctataaagtacctgcaataaatgcatttttaatattagatttcagtaatattttcttcacttgtgacatactacttattttgttttatcactatgataatgggagaatggaacacttctctttgttttttgttcttatttccttaaagttttagagtaatagtcacatactaacctataagaaatttagaaaggttcaattaggccttctatgacaaaaatatctaagtctctagttactaaaatgttaatgtttatgttgtatcatggtctatactgcagagtcagggtaaagacacatagctgtattttttagatcaataatttgttcagttatttacaatcaagagtgttaagagaacttggattgcagacaaatctcttatacatttatccaattatattcaatgttttttcagaagggtaccttaggactggcctggtacatacttgcatatcttttgcttcttaataaacactagccactattttcttttcagtacattttttttccttcttgggcaggataaagagaagttgattattctgataattgcctgtggagaagtttctttggatacaattttattaagggcattgagtctctgagtttaacttttttcttcccaatgaccacactgtgcacaacgatgatgttgtggattttgaacctgaatttataccagttcagacatctttggcttcttcatgctggcataggcttgcctggctgagaatctgaagatgcaataatttttaaaatgtattactgtcattattataattagtttacttattgttcccccagatattttttcaacaatgttctgctaaatctagagtggctgcttgctaatagaactttagctttttcacaaagcttccaatgtgggaatctaatccattgtcaaaagtagtggccaaaatgtccctactcattgtggctgtgatacaggtgtattgtaaaaagatgtgattcacacaccattggggatctctaagcacacctccatgttatttagaatttttattttggcccaaatatctacaaggtagtggggagttatgtgagtttcttaggccatgacaacttgccagctttaataccttcagatgaggatgggttaccagccagcttgggcccattttgtagtacccatccaggacagacatactggtcaggggcagaaatataacaattcagtgggaaagctgatatggttggctgaggtgatacatttcatgcatttgtgtgaatacttcctcctgaagatttgatgattctggaatggtttggagacgacttcaaaaataacatgtttagtaaaagggaactgtaggacactgaagaaccactgctcaagacccaacatagtcagctactggtgataaccatttcagtactttgttggctaggacctagaagttgggaagacatttatgagagattatcaaaaagggagaagctgttggaatccttatactgtttcataatcagaattgttgtaaggtgacctagttcttgataattatctttagaaaagcaagggtacaggttaacagagggggatttataggataagaacagaagggcagggcaaaatctatgttcacaaatagaccgactctccttgtcttgttgacatagtaatcaaaaagggagaccactgaaaatttttgcgtattcaaaattattgaaaattttgtcttccttttattttagggcttgttaagaaaaaacatgacccaaaatttggaaataaggcaaaaatattactgcctaccttttcaaagatactgcactaaagaaagcactgtcccacaggactgcccaagggttatccaagtctgggtagcaaggggtcgtctgattcaggcactaccctgagcggaaaacaatggcccaagacctcgaccaaacccagctctccacctgtttttgtacagctttgaactgagaatgcttttttacaatcttaagtggttgagaaaatatcaaaagtagaataatattttgtcacatgtaagtttacatgaaattcaaactttagaagaatttcctcttcacagacatcacatcttcaagagcaaatgcttgagccctaacctgcaagttatagtagaaaagtccagaagtccagcctggtcctcgccaagtttccaactcctatgcctaggggtattttatgcttacaggatctaacttggttacaacgtctaacttttagcagagaggcagtgctgagtagaaactggacttgttaaccatatcaagtcacttaagttggctaggatcccctacttaggtagcggccataaagcctagggcatccctgtgccctcaatggttcacttctgagtggtgggcttcctgctcctcaatagagcaatcggcagaaaggcccctagaaagctacattgtcttcatccgcgaaggattccctgtctcctattcctcaaaggagcacccggattctactttcattcttcttttgccattgcattttataacttaaaagaaatagatgattgtaacagaagaaagaaaactttacattgtgagaaaatttagacctaaagcttatagtaatgtgaggacgaaagtctatactgtttaagtaaataggttctatgagcagcatccaggctaacatcacacagtggtattttgaattaaattgtacttgtgttttgtttccgtgttttgctgctgtaaggaaagaggaaagcatcccctttctcggccctcctcccacgtccaggctaatttgcagcatttctacatctcagagtccacccttaagatccttgccacccattattttgtttcagaacgcttaatccatcaaggaaggttaaattggattaccccagtagggaagggacgggggctgtaagcatgagggattatccctgtaaagggctcgtggtgtgtgtgtgtgtgcgtcctgctagtgttgaatgacggagacctgagtttggattctgaatccaggtgtattcgatgccgctccggcgtagaacgggttaaagatgcccccagccaggtagagccagactgggagttgtgcaaggtctcaaccccctaaaagcggcccctcaaattgaagatgagtaaatcatagttcgtaaatcagaaagattatccagtactacgttactctgtttatttccctttcgtcatccctgagtcttgggtcaagtccatcccagctctgtcctccaggaatcaagggaaatacgcaaacccgcggtgggttcgcagccgcaggaaggacaaatcttgcccccgccgcggcggccgccccgcgttagctgcctaagagaatctccgtggccggccagtacccgccttggtgaggattctccctcccgcgagaacttctggaatgccgccgggccagattttgcagctgaggcctccgacgccactaatattgggccaagcagggagtgctgctcttccttataaggttttagcgaaagttaagtaagccaattaaagtgcaaaacacacagtctggaacaatacagcgctctataaatggtctccattattatcattatccgttagttataactggggataaaaaaaaaaaaaaaacgacaaaaacctggagaaccggaaaggtctgcaaaaggggcggaacgcgggaacttcgatttggggaaggggtggcgggggagatcccacacaagcagccaatccagctgtcccggggaggaagaggaggagtcaaggcccgcccctggtctccgcactgctcactcccgcgcagtgaggttggcacagccaccgctctgtggctcgcttggttcccttagtcccgagcgctcgcccactgcagattcctttcccgtgcagacatggcctctggcaccaccaccaccgccgtgaaggtgagatgagccctcccagccgcagcggttcgccctgccggatgccttctcgcccccgcgccgggggaccgcgcctccgggggccatgcgcccggcccgtgcgtcccttgccgccgcggggagggactggggcgcggcactcgggactcacttgccgcgcgaggagagggtacgcttgcaaatgatccccctgccgcaccgccaacacacacacacacacacacacacacacacacacacacacacacacacacaccaccttttggcttatctgcacccgcaccctgtagggcgtaggcacccctttagagagagaggtcgtggatgggagaggctgcacccatgccaccaccattcctgagaaccactcttcttccaagaaagacacccggctggagtcaggaggtgtccgggcgcctgcagcttctgtgaccgtctcctggtgccttgcgggactccagcttccgctctctgactctgcttgttgcctgcggcccacgtgggagaactgcttacttgctcttttgtatgcttccggcttctttttcctccaaacgtaggccttctccgcgctgaagttttccccagcagcgtaatactgtaagaattctgagactttcttcgaaaaggagtacaggcgtccgtttttagggctgcactgtttggaggcctctggcttgaaactgctttgttttgcagccttgcaagttagagttcaatttccttgtgccctaggccctgagaggccttgatacaaggggtcattgtgcggtgggaagctttgtgctgaggagggcacgagttctgagagtagcagctggcttccctggggttttaaacacttctctcctggttagtattccgagagagaattacagcacgtaaagaaaaattgatgataaaacttaagacctcttctaggcagtttattactggctaagaatgcgttcttgtttgatttttagaaatttttggcctatgggataggaaggtctgcgatcttctccaaagcatctcgattccctacactcgactgcagttttcccgggagaaggcgaatttctgcggtcagtgtgtaatcagccagattagtttattacgcccttgcaggtttaaatgagccacttagaatgagaggaatggtgaagggtgttgcatccagacttatatatgaaacttattttgtcattttgaaaagaatcttgcatccagcaaatatttatagaaggcctctcccctgccttcattgtttggcggaaacaaggcagaaatggttttcatgaaactcgtgtgaagtatgtgacttctcttaggtgctcatctataaactgagaattttactgcagaatttgctaggagggctagaattatattgtctatgttgcacatggtagaagcttattaagtggtagtgcttataagtgggggaactgagattaattttgaatgatcttttccccaaaaattattaagttattgtgttaggtatcattaggccacaacttttcaccttatccttgcaggaatacacttcaagcgccattaaaaatggagaaatggtgtttaaaacagtcttactttaatctggttagcattctccctgccacagggtttcccttcaaattaatgcagtgcatttaagtgcagaatgggcaatgggattctcagagacctgatgtaaatattgaatagtgtgtatttttggtcttggcaagcttctggatataaaattaagaggtacatatggtgctaggactgcctgctgatttctcttttaatttagaacagatgacagctttgccgtagagattccatgatgccagcaccgtattccccagacttctaaggcaacattctgtatagaagatgtgaggtgccagtgtccagagcaaaataggttaataaaaaccacatcctattcccaaattatagaatgatggggctggagtgttccttcaagaccatccatatagccacacaaacccgttttgcgggtgtaaagttgaggcccagaaaggtcagctaagtatccagaattacacagctggacctagataatgacagaattgggcctagagcctggcattccaccaactagatgtgaggcatttctgaaatctgaagtgtggtctctgccctgttttcttgtgacctaatgcacaattaaaatgagcacttgatagaatgtccatcttgaagagggaggcagagggtatgcagaaagcaggctgcctccagtgcccactgcacaccacccaggtataggtataggaggcacatgtgtgtctgaaccccattggtgtcactggcaggtcctttgagaggttgctggatttaaatacagtaacatgtaacacactcagcccagttccaggtactcctttaatgtcagcccaagtacctctcttcttaaaatagagatattaacggggtggatcttaaattcattctcaattttagaggtgcagttaactcatgcaagtgaaagattccactgagttttggattggcagtatatttggcatatctttcaaatctagccatctactggtggaatcctattcaaaaatatttattgaatacctgctagacaatggggatgcagctttgagtaagcgaggcctttatttattttcttcaagtttatattctagtcagggtgggaaaccaactgacatgaaagtgaaacagcagtaagattccattgggtgaggggtgtcagaaaagactcctagggaggtggattttaagctgtgcagtagtctgcctccaaaatctgtatgttgaaacctaatcgccaatgtgatggtattagaagatggggcctttgggcgtgattggggtcataaaggtggagccctcatgaatggaagcagtgcccttacaaaagaggccccagagagctgccttattccctctactaagtgagaggacaccatctatgagccaaaacgtgggccttcctcagacactgaatctgctgtgaccttgaacttgctaagcctccagactatgagaaatttctgctgtttataagccacccagtcctaagatattttgttatagcagcctgaatggacttaagctgatagtgaaaatagggataaagggtaaagatccaagtgaagacctgaggagagagatgggggtaggagagcgaaaaccaagatgtcgcagaagtgagctcagtgtggtaggaatggaaatcacggatgcacagtgagaattgggtggatgcagctcataaggccatccttgtagaccgcgatcaagaattttgattttaaatgttttggaaactgttgaagggttaagagtgggaggcagcatttgatttacattttaaaatgattactctggctgttgtatacagaatagcctgtgggcaggggaagagctaagagatcaggccagaagtcttggtgctggggctgaagtctagggtgggagccatggaggtggtgaggaataatcagattggggatagaatttgcaggtagaacacagagatggataagatgtggggagtgcaggaagaagaacaggatgatttctgcttttgacctggaaaaccaaaaagatgatgatactggtggatcatttcaaagtgggcgataaggggccacgagtgactccttggagccaaggagggtgagtgtaggattccttcctcccagatactgctggttagggggccagaggctgggatgctgaggggcctctttgctgtaggagcagagtgggtggcaggttgagggagggaggaagccacctggagtgagagtaattcaagcaatcttttttgtggttcactgcagtgagagatggtccaggcagggagtgaggatattacctggggggtagccatggagagaggcagcaggagccagaggctatgggattaacactgccattgtctgagaggacctcagggagacattgtcctccagcatcagccaagggcaggtggtattcctgacagagggccaaaccagtctttggcacccagatacagggcattctggagggctcctgcagtgtaccatggctcccctgggcagcctcccagctttcattctgggagattaaaaataagacttggccaggcgcggtggctcatgcctgtaatcccaacactttgggaggcccagctgggcagattacctgagctcagaagttcaagaccagcctgggcaacatggtgaaaccccatttctacaaaaaatacaaaaattagccaggcacggtgctgcacgcatgtaatcccagctactcaggaggccaaggtgggcgaatctcttgagcccaggaggcagaggttgcagtgagcagagactgcgccattgcactccagcctgggcgacagagtaagatcctgtctcaaaataataataataataacaacaacttgttaatcatggttgctgtgacaaggaggggatatggtcccattgtaggttggtagtgagctatcaacataatgatattaagggagatggacaagtcatggtttgtagactgtggaatatgggcctttacactccctgctttgctgtcttgagtgtggcctgcaagggccttcagcctgagagtccttgtgtggctatctgaaactgaggacaacctgcaggccccagttgaaaatcacatgaccaacaagccttcattttttttgcctagggacacaagggcattttgggcaggacaattatttcttttgtaggactgtcccaagcattgcaggacatggagtacaacccttaacctcctccacagaaatgccagtagcactccccctagtcatgacagccagaaatagccctgtttccagatacccccaggagagctgtttgacatttagttgaggaccccaaggctaaatcccaaaaaagactacctgctgaagagaggtaggagcagccaggttttgtactgctcagcagagtaaaaggaggaaataagggctttttttgttgctttgaggaagtttattttgattttttatttttgccaggagtggtagggtatacagaaacagagactgatggtaatacattatttcattttattctcttgataattttatggattagtaaaaatcttaccctataggtacagctgaggaagcagttaaggaaaatgtttgtatgcagtggattctggatcctcacctgtggttgtagtcatggcattccagcctgtgcctcaaaagcatctaaagcagtggttctcaaagcgtgtcatgcattcatatcacctggtcatttgctagaaatgcaagttcataggccccaccccagtcccagtgaatcagaaactctggggctggggcccagcaatctaggttttgacaagccttagaatattcagatgtccaccgaagtttgacagccactgacctagagagctttggaaagggtggccatctacatttttaacaagttcttcccttagtgttatagtttcctgttgctgctataacaattttcacaaatggagtggcttaagacaacacacatgaggccgggcatggtggctcatgcctgtaatcatagcactttgggaggctgaggtggatagactgcttgagctcaggcgttcaagaccagcctgggcagcatggtgaaacctcatctctgcaaaaaaaaaaaacaaaaaaattagccaggcgtggcggtgcacgcttgtagttcagctccttgggggctgaggtaggagggtcacttgaacccaggaggttgaggctgcagtgagctgagatttcaccactgcactccagcagcctgggtgacaaagtgagactctgtttccaaaaaaaaaaaaaacacacacacacacacacaaacgtattctcttacagttctggagtccacaaatccaaaatgagtcttacagggctaaaattaacatgtgtatcgggctggttcctcttagaaaaaccatttccttgcctttttcagtcttctgaacctgtagaaccatgagctaaataagcctcttttctttataaattaccctatctcaggtattctgttatagcagcagaaaacagactaagaaaaatgttgtgcttgtaagagattgggacacggacacatacagagggaagaccatgtgaagacacatggagaacgctgccatctacaagccaaggagactgaccttagaagaaatcaatcccaatctcaccttaatgttggacttctagcctccagaactgtgagaagataagtttctcttgcttatggggaaaacctatttccttgcctttttcagcttctggaggcaccagcacttcttggcccatggccccacatcatgtccccttttctctccctctgcttctatcattatatcactttcttcctcatttgaccttcttgcctccttgtgatttcatttaggtcccacccaggtaatctaggataatctccccatctcaagatcctggatttaatcatatttgaggtaacattcccaggttctgggaattaggatgtagctaggatctcttgggacaggggcattgttcagcttgccacactcagcccacgttttaaaaatttatggtctaggggccgggcgcggtggctcatgcctgtaatcccagcactttgggaggctgaggcgggcggatcacaagatccgaagattgagaccatcctggctaacatggtgaaaccccgtctctactaaaaatacaaaaaattagccgggcacggtggcagcctcctgtcatcccagctacttgggagactaaggcaggagaatggtgtgaaactgggaggcggagcttgcagtgagccgagatcgcaccactgcactccagcctgggcgacagagtgagactccgtctcaaaaaaaaaaaaaagaaagaaatttatggtctaggccctagagcaggttgcttagttctgagggcactttagaaccacctgcggagctttaaaaacaaactacgccttgcccaactaatcagaatccctgaggcctgggctttggtattgaaagctagagaaggggaatgtcctagtatccagcagctggttcaggagggtgggtggctcccactgttgctccacaggcaaaggagagctctaacaaagtatgcattagggagagtcctcctctaaaaatatctggccatttcagcaggtgaagtgtgtctttaagagggtgtctgccctttagactgatatctgtacttctcaaggggcatttgctcaaataaaaaccatggatgttttgagcgcttgcatcatccaagcttctctgactaaaatatagagtcactgtattagttcgctaggcctgctataacaaagcactacagaatgggtagcttatgcaacagaagcattatctcctcacagcgctggaggttagaagtccaagatcaaggtgagatcaaggtggatttcttgtaaggtcagtctgcttggcttgtacatggcaatgttctccatttgtcttcacagggtcttccctctgtatgtggttatatcccaatctcttgtaaggacaacagttttcttagtctgttttctgttgctataacagaatacctgagacagggtaatttataaagagaagaggtttatttaaaagaaatgaaagggagacgagggagataggaaaaggaaacaaaaaagagacaaactttgcttcataacaacccactctcactggaactaatccaacccaatgagagcaagaacaccctcccctgggactgcatgaatcccttaattggggtggattattaccatggctcatgactcaaactcctcttaaaggtactacctcccagcatcactatatttggggaccaagcctcaacatgagttttgaagatgaccacattcaaaccataacatgaggtatactgcattagggcccatcccagtgacctcatttgatctgaattacctctttaaaaacggcaaatacagtcacattctgaggtactgagagttggaacttcaacctatgaacttaggggagatacaattccatccataaccattacctacaagggtggcctacagagggggtgtcttgtcagagatggagaccccagctatccctgtggaccctattgcaggtttttaacagtcctcacagcctgagacagttggttgctccctctcatacagctaggcttccaggattttgcaaggccctgacaggcctcaaagccatgtcagcctaataatgagggcctccgtctgctgtgcttgccaaaattgttatggcaaccagagctaaaggactgcagtgctcagatcgggctgtgccagctccagctctggctcgcttaccttatcgtgagcttgaggcactcagaggcagcccatctccctggcatgagctagtctcaaccgcttggggtgatggtattttgaaaatgccattatagagtgctgggttccttacggcagtgtgcccaggcctcaaagtgatggtgaatggtttctgggacaaagaagggttggtaaaatctcctgtagccaggtactagaagaaatagacagagtaggggttactatgcaccctttccacattgctagaagtaactgttctgaccaggtgaactggtatttggataaatgctttcacagtctcagagaagtcagacccttggattgatttgctcttgaacaaaaaaattttttttttcactgtgaaaatgctttctttggggtgtctttagaacatgtgatgtcaagacacaacagcaagcgcacatacactaagacatggctgtcatagaacagattgtgcgtgaataaagggttcacaccacttccaccctttacacagtaacagaaggctctaggccacctacctcctccttggctcactcaaactcttcctcctcagccgtggcctcctgctactgctggtactcagacaccaggtcgttcatgttgctttcagcctcggtgaattccatctcatccatgccctcgcccgtgtaccagtacaggaaagctttgcaccgaagtatacctgtgaactgctctgagatgcccttgatcagatcctagatagcagtgttgttgccagtgaaggtggccggacatctttagccctgagggtgggaagtcacacacagctgtttttatatcttgggggatccaaccaacaaagtagctgctgttcatattttgggcattaagcatgtgcatgtccacctccttcatggacatgtggcccctgaacatggcagctaccattacgtagcaaccatggcagaggttgcaggcagccatcatattcttggcatcaaagaactgccaagtgggctcacgcaccatgagggcccagtactgctggttgtcccagctggtcagcagggggaagccatacatgaagtgcaggtgggggaacaggaccatgtttgcggccagcttctgcaagtcagcattgagttggccagggaaatgcagacagatggtgaccccactcatggctgcagacaccaggtggttcaagtcactgtaggtaggtgtgggcagctttagggttctgaggcagatgtcatagagagctttatttattatcattgcagaaggtctagttttgagaagtttggtttgatggtcagtccgtggaaaagtgtggcatgagccactagcttttaaaatctgtcaaggaccttgattgactccctatttcagaactctatcttgtgtaataaagaagtcctggctgggcagaaattccatctcaggtcttgaacacatttcctacacagtctagaattaactggactgaggactgacgcttcctgcccaggaggcctggcaaggtcttgtcattgtttcctgagggtggatgaggtcattaagaaagagttttcctcccctctgagatgattcactcagatacctggagtcactgtttctgtgcttgttctgtgaccttcgtcatgaacttgacctctctgagcatgttgtctcataacatggagacaaataacttttctaataaggtataatgttatggaggactccaggggatattgggagagggcacatcatagtggttaagcctgaaagacctagatttgtatcccagctttgctccttatgattggcccctggacgaggtttttaatttttgtgcttctctttcttcgtttgtaaaacgggtaacattctatagggcccatcttatggtcctgatgatgaaataaggtaaggccactgaagcacttagcacagtgcctttaacatgtaagtccacagacacagttactttataactaaggcagtactgagttgacacaaacttagagactcaaaggaatgtggatagaattgggccatcagtgcttgggtacttcatcccagttgtactttgctgtggagccagcaggtggcgacattggccacatcttggccctgctggcctccatcttagaggtccagtttcctgggatggcgggactcagttgctacacttgtccctgtatccctcgcacaatgtaggtttccgtaaacaactggacctagtaaagtgactggatgggcttgcctgcagatcattccagagcagtagccactcttgctttcatgtccagggctactacatgttccttgctgagggctgagttgccagctacctggtgcagagtcattatgcagccaggtggtgcagactgaagcttggggttgctgagagtgagctcaggggctctgaaattcagcgggacacctggttagcatttctcaacaactgctacaatgctgggcaagttcacctaaactcagagggtggctccaaacaaagcccaactcgatttgtgtatttgatcccgagcatccagtgttgaatccagaatctgagatgccctggctcagggaacacccagaaacagccaggccaaagtggtgataagttaaaaagctagtagctgaatccccagggagctggctgagagtaatttcagagtcagcagttcatatctgtgtcccaggtgaggatatgggctggatggtttcttagcctcctcatgacctgtggtgcttcagaggtccacggaatgaaggataagatggagaagccaggctaaggaaggattgggatttcctaaaacagtatgaatttttgttattttctattgaagtgccgtaatttaaatgtattgacttaagtgaacacttctgttgatttgaaagctataatactggttactctttgttcgttgacataaaagtatgttaacctgctgtggttttaataatatacctccacaagatggcgccaacatcaaagcctggctttgccacttaaggaaattgtggtggacagtcacaaattatgtaaccatgtcatgggaaacaggcagagttcttcagtaaaaacctcactaaattgtccttattttcttgtttgttttttgttgttgttgctttttttgtgtgtgtgttttgtttttttcaggaaactgagccagaaaggtaaccatttttttacgtgttgataggactcaacttgtgtaacctgacctgaaaattatttaatgcagatgttcactgaattcttaatcctggaatttttttcttgaggcctactttattttatttagttacccttgtgacaatagatttaaagcttttcattgaaaaacaacaatgctcaggtcacttcgcattaattaggtttctaataaagttagcctggcactgtttactctctaggaggtaccagcccaaggaaatttccctaatgatttgttacttatttttagttttaacagtttagttaatttttatttatttttgtaattgttcttgtttgtctttcttaatcatcaaattagatcaactctcagaggatagtgctaggtttctttaactcagacaaggactttcaagataatctctgaaaaatgcaatacaatgcatgaacttaaaaaaaacttataactaccttttgaattatttatatttgcataaatgtatttactgagtaatatacatgagtatgctatatgtatatttacaacatgtaaatatgaatttgcatacatatatgaatgattgttttcataaatgtatatgcgggtaacttttcatgcaatttcagtctcctctgtctgcattctctcctagctctgtgattctaatggcgtgggaaagataatctctcatttctttatcaaatagaacagtgaggagaaatcaataccaaatggaatacctaatattttatatcccagcagtcttctgaacattgtttattctatagtccatttgacagagaaacaaaattgatcagaaggtactttccactaccatacttgcctacttttaggtttgattttctaccttgagttggttaaaatacctctctatgctgacttgtaattcagacagtcagaagtaaatgtgatgtagtccaaaaaggtgccctacgttttggttacttatagaatatagaaggccttcaaatgtttgttgatttttatggaaggctttgaaatatttgttgattgatgttcagtaattttcagatttcaaaaaaataactagggcttggcaggaatggagaagagcatatgaataaatgaatttgcttagaatcttatttctaataaaaattaccaaatacaataatcttctctgtctttttctctcttagattggaataattggtggaacaggcctggatgatccagaaattttagaaggaagaactgaaaaatatgtggatactccatttggcaaggttaatatccaacttgtggagacatgttttttagttttttcatttctccttgctggcttgatttttgaattaaaaaaaaaaaaaagaattgcttttgttttggcagcccagggctgtctgctcccagcagagagggccagaagttctgctgttgggttccatcagctgagaaggtgtctgatgggcgcctcacactttgatgttttgagaaaatggctacttagtatgtaaatcacttctcattctgttgctggaaatcagatactcatttcagaccacagactcatttcagactgtacttttcaaatctacattcaaatcttctaatttgtggccaataggtcacaccacactaattaggggacaggctgatgactaataggatgaattattgttacgaagcggcatttgagtggaaagaattgttttggggaattagaacatacctgatgttagttgaatgtgtaactgagctagaaataaaatgctcctccttttataggagaggttgcttgttctccaagcccatgtcactcagcctaggccggggtgagggtgtctgcattctcctaattccatattgctacgtcctctggtccatctgtaagatctctctatctggctgtcccaaccaaaccctccttttcagctaaattcttaggttgaccttgtgtgctcccagtcctgcagtcatcctggttcattttcttaaacccctcggttctaagggtctttccagcctttgttacctcaagtcatttccatgatcatcttagacctggttaacacaagcagacatttccagtgctgaattcttagtgtcatgatggtggcttgttatcctttctgcctttcaccttcacacctgttctcaaacctgcccaataaccttgacacatctaaatttgaccagtctaccatcagagttccctggggtactcgttacaaatagatctgactaaatggtacctacacaggtgcccatggtaaccttgagtcctgtgaatctatgcctgcagagggatcaataagtaattgattaaatgattatattgataatcagatcttgcctcttctctaagttgtatcctcagactcttcagattccatgagtcctgttgtggttgaacaattataatttacatacctgtttttaaatcactgagttaaatgtcattttttcattgcatgcagccatctgatgccttaattttggggaagataaaaaatgttgattgcgtcctccttgcaaggtatggtattttaagctttttggatgttactactaaaggataatttaaatttaacttaaattctggaaagagtaaagatacaggtctgagcttttatatgttggcagaatcagaacatcttagtaacctttatttacaatgttttatttttggttaagttatattgacttaggagatcaaagatctcatgctcttgccccttacattgggaaagtagatcagatgactaaaatcaaagctctggttttagttctaactgcaagaagaaatgttttgttcatttttttcccccttcttataaagataaagaaaaacaatgcatcattaatgacctcttgctggtagtagttatatgtctgtgggaagtaggcttagggcttctgaagtgggttacttgtgtctgtgctgttgtttccttaaggaggctggtgctgctccatattacagaggaggccaagtcatttttatcccattgttagaagttagtcaagatatatgtatgagttctctactgttgtgtaacaaattaccacaaatttagcagcttaaaatagcacacatcatctcctagttcctgttggtcagaagtctggcacagcttagccagtcctctgcttggggttgcacaaggccccacaaggcatattcaaggactgagtccccatctggagcttgaggtccttgttcaagctcgtgtagttgtaggagaattcactccctagaagttacagggcggaggcctttggctcctagaggtggttcacattccctgccgtgtggcctgctccacaggctgttcacttgactgcagcttgcttcttgctattaggatatggcaaaggtgctagaagtcacctccatggttaagctgtaccttgcaagcatgcaggagtccggcaggagaatctcctatgcatgcttgcaaggtagagcctaatcgtgggagtgacttatagcacgtttaccatttttctattggctgaatgcaagtcccaggttcactgatcctttatacagagcatgacagtggggtcctcactagggtctgtctgccactctacatatttgaaacaggagtggcttctcagaatccagtgaacctaaattttagttttagttgctcactggactgggttctaggagaccccctgtgttagtctgtggtcattgctagagaatcacttaattttttctagactctaggagaaaacagttggtggtgtactcatcacgggttaacaatttcttctctccttccataggcatggaaggcagcacaccatcatgccttcaaaggtcaactaccaggcgaacatctgggctttgaaggaagagggctgtacacatgtcatagtgaccacagcttgtggctccttgagggaggagattcagcccggcgatattgtcattattgatcagttcattgacaggtaagcagtcatacaaaatgctttaggctattgtagctggtcattttcagctcaaatggacgacgcgtgggaaccggcagggcaactgggagggcagtgccacagactcgcttgctttttttttttttttttttttttttttggagacggagcctcactctgtctcccaggctggagtgcagtggcatgaactcagctcactgaaacctccgcctcccaggttcaagcaatgcttctgtcttagcctcccgagtagctgggactacaggcacatgccacaatgcccagctaatttttgtatttttagtagagatggagtttcgtcatattggtcaggctggtcttgaatcaggagatcacccgcctccgcctcccaaagcgcaaagtgctgggattacaggcgtgagccactgcacccagcctgtgttaagcttttcattgtgagtttttgttttttaattttaattgacaaatgataaatgtatatatgaggtataacattatattttgatatatgtatgcattgtacaatgattagcaaagctaattaacatattaccccacatatcatctttagtggtgagaacatttgatttttactttaacaattttgaaatacataatacgttgtcattagctataatcaccatgcagtataatctcaaaaacttattcctcctgtctaactgaaattttgtgctttgatcaacgtctccccaaaccccagcccctggtaacctttctactctttacttctatgagtttgacttagttagattccacatataggtgagatcatgcagtatttgtctttccatggctggtttatttcacttaacataatgtccaggttcacccatgttgtggcaattgacagagttgcgttctcttttaaggctaaatggtattctgttgtgtatatataccacattttcttttttttttttttaattgtacttttaagttctagggtacatgtgcacaacgtgcaggtttgttacatatgtgtacatgtgccatgttggtgtgctgcacccattaactcgtcatttacattgggtatatctcctgatgctttccctccccactcccccaaccccacaagaggccctggtgtgtgatgttccccttcctatgtccaagtgttctcattgttcagttcccacctatgagtcagaacatgcggagtttggttttttgttcttgggatactttgctgagaatgatggtttccagcttcatccatgtccctacaaaggacaggaactaatccctttttatggctgcgtagtattccatggtgtatatgtgccacattttcttaatccagtctatcattgatggacatttgggttggttccaagtctttgctattgtgaatagtgccgcaataaacatacgtgtgcatgtgcctttatagcagcatgatttataatcctttgggtatatacccagtaatgggatggctgggtcaaatggtatttctagttctagatccatgagaaatcgccacactgtcttccacaatggttgaactagttcaccttcccaccagcagtgtaaaagtgttcctatttctccacatcctctccagcacctgttgtttcctgacattttaatgatcaccattctaactggtgtgagatggtatctcattgtggttttgatttgcatttctctgatggccagtgatgatgagcattttttcatgtgtcttttggctgcataaatgtcttctattgagaagtgtctgttcatatcttttgcccacattttgatggggttgtttgatttttttcttgtaactttgtttgagttctttgtagattctggatattagcccttagtcagatgcgtaggttgcaaaaattttctcccattctgtaggttgcctgttcactctgatggtagtttcttttgctgtgcagaagctctttagtttaattagatcccatttgtcaattttggcttttgttgccattgcttttggtgttttagtcatgaagtccttccccatgcctatgtcctgaatggtattgcctaggttttcttctagggtttttatggttttaggtctaacatttaagtctttaatctatcttgaattaatttttgtataaggtgtaaagaaaggatccagtttcagctttctacacatggctagccagttttcccagcaccatttatgaaatagggaatcctttccccatttcttgtttttgtcaggtttgtcacagatcagatgcttgtagatgtgtggtattatttctgagggctctgttctgttccattggtctatatctgttttggtaccagtaccacgctgttttggtgactgtagccttgtagtgtagtttgaagtcaggtagtgagatgcctccagctttgttcttttggcttaggattgtcttggcaatgttcatggttccatatgaactttaaagtagtttttcccaattctgtgaagaaagccattggtagcttgatggggatggcactgaatctataaattacctatggccattttcatgatattgattctacctatccatgagcatggaatgttcttccatttgtttgtatcctcttttatttcattgagcagtggtttgtagttctccttgaagaggtccttcacaacccttgtaagttggattcctaggtattttattctctttgaagcaattgtgaatgtgagttcactcaagatttggctctctgtttgtctgttattggtgtataagaatgcttgtgatttttgcacattgattttgtgtcctgagactttgctgaagttgcttttcatcttaaggagattttgggctgagacgatggggttttctaaatatacagtcatgtcatctgcaaacaaggacaatttgattactcttttcctaattgaataccctttacatctttctcctgcctgattgccctggccagaacttccagcactgtgttgaataggagtggtgagagagggcatccctgtcttgtgccagttttcaaagggaatgcttccagtttttgcccattcagtatgatattggctgtggggttgtcataaatagctcttattattttgagctacgtcccatcaatacctaacttattgagagtttttagcatgaagggctgttgaattttgtcaaaggcctattctgcatctattgagataatcatgtagtttttgtctttggttctgtttatatgctggattatgtttattgatttgcgtatgttgaaccagccttgcatcccagggatgaagcccacttgatgatggtggataagctttttgatgtgctgctggattcagtttgccagtattttattgaggatttttgcatcgatgttcatcagggatattggtctaaaattgtcttttttggttgtgtctctgccaggctttggtatcaggatgatgctggcctcataaaatgagttagggaggattccctctttttttattgattggaatagtttcagaaggaatggtaccagctcctccttgtacctctggtagaattcggctgtgaatccatctggtcctggactttttttggttggtaggctattaattattgcctcaacttcagagcctgtttgttattggtctattcagggattcaatttcttcctggtttagtcttgggagggtgtgtgtgtccaggaatttatccatttcttctagattttctagtttatttgcatagaagtgtttatagtatgctctgatggtagtttgtatttctgtgggatcggtggtgatatcccctttatcattttttattgcatctatttgattcttctctcttttcttctttattagtcttgctagtggtctatcaattttgttgatcctttcagaaaaccaactcctggattcattgattttttgatgggttttttgtgtctctatctccttcagttcttctctgatcttagttatttcttgtcttctgctagcttttgaatgtgtttgctcttgcttctctagttcttttcattgtgatgttagggtgtcaattttagatctctcttgctttctcttgtgggcatttagtgctataaatttccctctacacactgctttaaatgtgtcccagagattctggtatgttgtgtatttgttctcattggtttcaaagaacatctttatttctgccttcgttttgttatgtacccagtagtcattcaggagcaggttcttcaatttccatgtagttgagcagttttgggtgagtttcttaatcctgagttctagtttgattgcactgtggtctgagagatagtttgttataatttctgttcttttacatttgctgaggagtgctttacttccaactatgtggtcaattttggaataagtgtgatgtggtgccgagaagaatgtatattctgttgatttggggtggagagttctgtagatgtctgttaggtccgcttggtgcagagctgaattcaattcctggatatccttgttaactttctgtctcgttgatctgtctaatgttgacagtggggtgttaaagtctcccattattattgtgtgggagtctaagtctctttgtagatctctaaggacttgctttatgaatctgggctcctgtattgggtgcatatagatttaggatagttggctcttcttgttgaattgatccctttaccattatgtaatggccttctttgtctcttttgatctttgttggtttaaagtctgttttatcagagactaggattgcaacgactgcctttttttgttttccatttgcttggtagatcttcctccatccctttattttgagcctatgtgtgtctctgcacgtgagttgggtctcctgaatacagcacactgatgggtcttgactctttatccaatttgccagtctgtgtcttttaattggagcatttagcccatttacatttaaggttaatattgttatgtgtgaatttgatcctgtcactatgatgttagctggttattttggtcgttagttgatgcagtttcttcctagcatcgatggtctttatattttggcatgtttttgcagtggctggtaccagttgttcctttcctccaggagctcttttagggcaggcatggtggtgacaaaatcctcagcatttgcttgtctgtaaaggattttatttctccttctcttatgaagcttagtttggctggatatgaaattctgggttgaaaattcttttctttaagaatgttgaatattggcccccactctcttctggcttgtagagtttctgccgagagatctgcttttagtctgatgggcttcccttgtgggtaacccgacctttctctctggctgtccttaacattttttccttcatttcaactttggtgaatctgacaattatgtgtcttggagttgctcttctcgaggagtatctttgtggcgttctctgtatttcctgagtttgaatgttggcctgccttgctagattggggaagttctcctggataatatcctgcagactgttttccaacttggttccattctctctgtcactttccggtacaccaatcagatgtagatttggtcttttcacatagtcccatatttcttggaggcttcgttcatttctttttactcttttttctctaaacttctcgcttcatttcattcatctgatcttcaatcactgataccctttcttccagttgatggaatcggctactgaggcttgtgcattcgtcacgtagttctcgtactatggttttcagctccatcaggtcatttaaggacttctctacactggttattctagttagccattcgtctaatcttttttcaaggtttttagcttctttgcattgggttcgaatttccttctttagctcagagaagtttgattgtctgaagccttctctcaactcgtcagtcattctccatccagctttgttccattgctggcgaggagctgtgttcctttggagggggagaggtgctctgatttttagaattttcagcttttctgccctattttttccccatctttgtggttttatctacctttggtctttgatgatggtgacatacagatgtggttttggtgtggatgtcctttctgtttgttagttttccttctaacagtcaggaccctcagctgcaggtctgttggagtttgctggaggtccactccagaccctgtttgcctggatatcagcagtggaggctgcagaacggcgaatgttgctgaacagcaaatgttcctgcctgattgttcctctggaagcttcgtctcagaggggtacccagccgtgtgaggtgtcagtctgccctactggggggtgcctcacagttagcctactcggggttcagggacccacctgaggaggcagtctgtccattctcagatctcaaactctgtgctgggagaaccactactctcttcaaagctgtcagacagggacatttaagtctgcagaggtttctgctgccttttgtttggctatgccctgcccccagagttggagtctacagaggcaggcaggcctccttgagctgtggtgggctccacccagttagagcttcccagccactttgtttacctactcaagcctcagcagtggtgggcgcccatcccccagccttgccgccgccttgcagtttgatctcaggctgctgtgctagcaataagcgaggctctgtgggcgtgggaccctccgagctatgcacgggatataatctcctggtgtgccgtttgctaagacagttggaaaagcacagtattagggtggcagtgacccgattttccaggtgccgtctgtcaccccttccctttgctaggaaagggaattccttgaccccttacgcttcctaggtgaggcgatgcctcaccctgctttggctcacactcgatgggctgcacccgctctccggcacccactgtccgacaagccccagtgagatgaacccggtacctaagttggaaatacagaaatcacctgtcttctgcattgctcatgctgggagctgtagactggagctgttcctattaggccatcttggaaccgcctctcccacattttctttatctgttcatctgttgatggacgtttatgttgcttccatatcttggctattgtgaataatgctgcagggaccatggaagtgctgatgtctttcttgacgtaaaatttcatttccttatacactctgagatgggattcttggatcatgtggtagttgatattttcagttttttggggaattttagtaatggctgtattaatttatattcctaccagcagtatacaagggttctgtttttgtcacatcctcatcaacacttactttgttttgtcattttgataatggccattgtggcctggcacagtggttcacgcctgtaatcctagcactttgagaggttgaagcaagaggattgcttgagcccagaagtttgagaccagcttgggcaacatagtgagaccttgtctctgtaaaaaataaaacaaaaattagccatgtgtgttgatatacagccattgtcccagatacttaagagactgaggtgggagaatcgcttgagcctgggaggtcaaggctagaatgattcatgaatgcaccactacactccagcctgggtgacagcaaaaaagccattcaggtgtgaggtgatatcttattgtggtttttatttgcattttcttgatgattagtgatgttgagcatttttcatacagctgttgtccatttatgtgtcttcttttgaggaatgtctattcaagtcctttgcctatttttttaatcaggttgtgtttttagaactttctttcatttagtttccttacgtattttgggtattaaccccttatccgaggtatggtttgtaaacatttttttcctatctataggctgtctctttatattatgggaatttttaaacatatacacaaaagaataataatcagggactctctaagttcctaattcctagcttcaagagaacattttctttttttttttttttaaagagagtataaattagtatttccttagtattagatatctaggaagttctctctattgtctcatgaactttttttttaatagttggtttgttcaaataagggtccactcattacacacataagcttaataagccttctagtctggaagattccaccttcttttttccttttccttttactgcctatccacattctggatgttactaattgtatcaagtgtcatttagtgtcttctcccggcccctgtgtttgctataaactggatttagttctggtggcctgatcagaaccaggtttgaattcttggcaaggatccttccttctgcatcctgtcggaaggcatgtgatgtccagttgtcccttcataatgcgatcgatcaggtgccagaggtgctggggttttgtttattattattattattattattattattattattattatttaactgcacaagtaatatatattgttcctttacccccccaaaaaaacaacaataatagactgccaaatttttggaccttttctgcatttagaggtagttgaaatcacaagggaaagtggtggtctctaggtcagggatcccccacccctgtggcttgttaggaaccgggctgcacagaagaaggtgagccgtggggcgagagcgagcattaccacctgagctccccatcctgtcagatcagcagcagcattagagtctcataggagcaggaacccaattgtgaactgcacgtggaagggatctgtgttgtgcactccttatgaaaatctaactaatgcctgatgatctgaggtggaagagtttcatcctgaaaccatcccctctgaccctctctgtggaaaaattatcttccatgaaatcagtccccggtgccaaaaagattaggggcagctgtactagggccaccccctcccctattcctggtagaaataattgcctctcagaatgctctgggtgaagacaggagcctcctgggctggatggagagtggagagtagcgcagagttaaatcatttggggatccttccacaatcccccatccaatcaccctgcctaccacctcagtccatgctgctcctcccatcagttatctctgagcttactgtactcacagcctgctcctagagcttctgctatgggagagagggttgtccagtccaggccactgtggcttctgcctttcagggattcattataatttccagtctatcagaagcattcttggttgtttcctgatggaatgaaactgttttgaaattgcccattctgtaggtcagaaatggttgaatatcagcagtttcatgtggttcaacctaataaataatggggttagactaaaatggttacatatttctcaccccaagttatgtccttataatgtatttatacctgacattatatatttgtgacctgtttccctctaagccatgtgagatcaaagtcactttctgcccagtttgcaccatatcaccaacacccacaacagttcctggcccatctttgctctgtcagtaatttttgagggcttgaacatagtcatttgaatagagagataggctggagtttgtgttttggagacatcttgatcaaaatctcaatggctgtcaacgtccatgtgtttggaggtaatagtttaagaaaatgattataatatgattgctaaatagagtggaatacaaaactccatattcaggatgatccagatgtataaagtattacagatgatactgtaaagtctgaattgggcactgagccttgggttaatctgttacttaaacagtatgactatacgctgttgcatttcccagatcttttactcacatgtcttaaatgtagatgtttcacatactggctctttcaagaaagcagttgggtcagaagatggagactagaaagaaaacaggtattgccatcagatctggtttcattctatcttagccaggtaaccttaagatcttctactatttttctgtttatgagacatatggataacctgccctcttaatgtttccttggaagttcaaagtctctaataagtgccttttgtgggatcttgcatgtgttaaccttctcagtaactgagtgccattattgagagtgtgtgcatactggctggagggtccactagttgacactactttacaacaacaggaggaaagaatctgttaaaagaaggatccctggcagggtgcagtggctcacgcctgtaatcccaacattttgggaggctgaggcaggcagatcacctgaggtcaggagttcgagaccagcctggtcaacatggtgaaaccccgtctttactaaaaatacaaaaaaaaagtagccaggtgtggtgagcacctgtaatcccagctactcggaaggctgaggcaggagaattgcttgaacccaggaggcagaggttacagtgaaccgagattgctccattgcactccagcctaggcaacaagagtgaaactccatctcaaaaaaaaagaaggatccctaagagaatataatttagcatgaaatctcaatttttacattgattacttatttggggtgataacgttttgaatatattaggttagacaagattttaaagttaattttacctgtttctcttttactttttcagtgaccactagaaattttaaaactatgtaggtggctaacatcatattgctgttggatgcatcttttaagtgctgctgcctttgattgagctgagtgggttccagttaaccaggcttgagcacatatatcattcattatgtgtttgaacatctcatagcagaagatgccttgcatatatatcattcattatgtgtttgaacatctcatagcagaagatgccttgtggttaatgccctctatgtgttttactgatagcacatttcttagtaaagtgaatcttggtgtattgagacgggcatctcctacctccacttgctgatggcatcagatacaaataggctgtgccatttttagcctggggtttcccagagtcatacccacagccccaacttgtttaacaggattgtaacatcctgtaaagccaccccgtggattatagaattccagggcagctggggcaggagcattgaatcaggaggtttcatcttgactctgtttggccctgtgcaaatcactttacccactacacgttggttctttcttcccaatggagggctgaattgcaccatctctctctctcattcttttgttgttttttttttttgtttgtttgtttttttgagacagtcccactctgttgcccaggctagactgcagtaatgcaatctcggctcactgcaagtgtgagccactgtgcctggccaggctccttttccctacactgcccgtgtattctctccagggacttacctagaaccacacacattggcctattgccgtaagtttgtcagcacgttgtctcagaaaaaaaaaaaaatcctcatcctaaagtgttcttcaaaggctagcgagattgtttaataatacggctattcttattttatagatggccaagctaaagcacatcattttcttttccttcagtgccagcatgagcagggcggggggaccaacctcagatttaagaaagacatgtggctgatttttagggttgtttttagaaacattagatttcttctctaataatgaaatatacttttgaaggactctgacaatgctggaagctcttttaagaaaaatgtcattcttatctgaaaatctttttttttcttctctctctcatgctacattacagctgatgaagttaaaaagcctgggcataagaaaaggggagccctgggtgtgactgccctggaaaaagaggtagagagtgcagtgggttcaagtatgtttgggtatgtgcagtcagtctttgtgtctttctcattcaagtaaattccatagcaattaaagtgaaaataatcatctttcatttgtgagtagagcatccatagaaagcaacatatatcttggtctagaacttaaattccaaaagaatgtgttatatttttcattttcccgtttttgttgcacagggacgagtttcctgatgcttccttgccataggccctgggctctgtgtgtagtgttcttcccaaaccaaaaattaaaaataggaaaatcagaatctataccaagaactttgtctaggaggcttgtctgcagtaggtttcttcagtgcctatgcctcctgctggattgtgtttgattaatccatttcttttaacttgtacaaggtccccattgttagagccacaagtcatttggccactgagggtaaaagatggttaggagtgggatttgttccacttctttgcagcgattaaacagtcagtttgaactggggaaagtatttgacctttagtctgtcctaaaagaatgtcatcaggctgtttatacattaaaaggctctcataagatatgtactcccagattcataattttggaacttctctcctatggtacacacccttgtatgtatgcacacctggctctcactgagtcacttatgggaaactgaagcaagtttttctattaataggggaaaaaagacctcataaaagagtcaaagtaaatgagacttagagaaatgtagaagcatgactatgcatcactgggcctttgcttagtttttattcatcagccatggagaagaaaggcatgactctttcctgcctcccacacccaccggacttgtaaagctcgacttcgatgatgcattataaagtggtgcacaggattggtttttaatgagatttttgccattggagcaaagcaagactgtttccctgccagctgctttattcaagtcatgaggcattttgttgtctcctcctgtacttgtggtacatgggccctccattttctagcccagttcttgttagatacctttgcacattcatttgtatgtatggcagaactgatgatatggcctttctttcacccccaactactaactgtccatgccattaaagatacatggacaggggattccagcaatttctacagttgctcttctttctctttaccattaatcctgatgattgtaggaaatcagtacaccatatttattatgcaaatctaagaaaaacaactagatctataaactatttgaaaagatgcccacattgtatttttttgttgtttttttagataggatctttctctgttgcccggggtagagtgcagtggcctgatcgcagctcactgtagcctctacctcctgggcttaagcaatcctcagcccgtctagtagctaggattacaggaatctgccactgtgcttggtaattttttttttttaaggagatggggtctcactatgttgcccaggctggtttcaaactcctggcctcaagcagtcttcctgctttggcctccccaaagtgctgggattataggcatgagccactgcacccagctacatattttttagaaaaggatcagatgagtaggacttgctcaactgctatcactgtcagaaatatctcaaggtgaaacttgcaaacatatcagtaaggagaaggatgagatttcttttttaatagtcttctttatcaggaatgttttgcagatattgattttttttttttttacaatgagaaaaatatgaccaaaaactgaatattaaaggaagcagagtgtgattcccggtgctaaacagtttctataaaatgtggctaataacatattggcctgttgtgcctaaggcctgtgtttgggttatgccttctcaaagaatgcagtggaagaatctcagcttagaagtgaggacatccagaattctttcctggctgtgccgtgaaattcctttgtcacttagtgtcctcatctgctaaatgagggtgttgaattgattcctaaaagttctggtatcctcccctcttcagattatttcttcaacttattttcttggtagaactgggagaggttcgactttgcttttgtcacgcattcttactcatcaggaaagtcccgctataaacacagtgctgagggatcagttatgtcagtctgtttccttctcccagagaccagccctgccttgggcttcccctagaactttatgtcatagcataaaggcccgtgtctgggccctgaggttgggagtatgctctgatgtcaagtatttgatcattctctttctgcctcttgatgactagaaagcgttttatggtaaagagttacgcaagaagcctttgtttagctctttctctcattgctaaaaatagtaagctgtttttaacccttactgttcttacttcttcttactcatttccctcactctttagctgagaatgtcacctccacctttatagagaagacagaaacttaagcataaactcttcaccttccttcaccttccctttccccagttacttgcgtccctgttctttgtcatcctcttgtctgtagctgtccttgaagtggtgtccactattcccctggatgaggttcattcttacgttctgttccataacctagttgtgttattaacttcccatcatacatccttttattaaaaatcctacactaccagtttttgagttcctattaggtgtcacaatcagttaatcccacttacggcatacagcagtcattattccagtttatacttgaagaaacttaggcccttactatgtttctggcactgcttattatcacagctctagaagacatcttctatctaccttatccttcccttttacaaaaggtgagaaaactgaggcccaaagaggttgttgtcaccacctatgtagagtgaggatttttatttttgtgctattgtttagcatgatctcatgaaatataatagaaaataaggggaaactatggtacctgtttattgagcagccttccttgactgggatataaacatccattggttttcctcctttttcatgccaccacaagcactcaggggcactcttgataccagaacagtgggaggatcttagtgatattggtccaaattcataagttttcacttctcttttttttgagacaagatctcactctcgcccaagctggagtacagtggcgccacagctcactgcagcctttacctcccaggctcaggtgatcttgccacctcagccccccaagtagctgggactacaagggtgtgacaccatacccagctaattttttgtatgtttttgtagagacagggtttcactatgttgcctgggctgatcttgaacatctaaactcaagggttccacccaccttggcctcctaaagtgctgggattacatgtgtgagcctcacttccttctggttatagagacagaattgttccacttcttagtctgatgtttctgtcagaattttttctcatgactgcctattcacgctgctgtttgattcttgggatatattttaaatgatgggtagattcacttcccctaaaccgtcctccttatgagcagccgttattctgctctgccagtaaattaattgactcacgattctgcatgttggggcttgttgtggatacagaccgtattctgaaatgtcctcagaggtcgatgattgtgtttgcttctgccaggggatgggtgtttgccctcagcttgtttgcaacaccacatttcctcaaaggaaacgtattaactaacagctatcttcaagccaatgtaagagtcttgattcaagaaacaacctaccagtcagtctatttctaggcttttctccctctctttgaaagtgccagtgttcttcctttcactctcttgaactcatttttcctgccagcacacatcattttgtctcctttacttttccataggctgtttttttttatttgtctactagcttttcttatcacatatccctgcttgacaaccttaagcaatttgttggatacccttgatttgaggcccatcaatatgtcatactttgggattggcagaagaaatgtttagaagcatattttccataaatgatagtgacaagtgccaagcacttgcttcatgttgtctcattcagttttcacggggactttataaggtaagtgggattactcccgtttaaggaaactgatataactgaggtgcagagagacgagagtgactttcccagaggcacacagctagtgagtggtaaagccagtagataagccagtccctgaaatccgtgttttccagtaggatcccaagctatggggagataaaaattagtccccttgcctagctagagggctttaaaggttaaagcaagaggaagaagcagaccttatcttttagttctgtaagtttggagtgtatcgtgggtctcactgaaactagaaaaattgtcagcacggctgcattcctttctggaggcttagggtagaatccctttccctgcctttgccactcaccttggcatatggccctcatccatcttcagagccagcaatggcaatggagtcctcacctctcatcatgctgacattgactcttctgcctccgtcttccacatgtgaggactcatgtgaagacatgccgcacacctagttaatccagaataacctttctattttaaagtcagcttgttagcaaccttaattccatttgctctcttagttcccctttgccatctaaagtaatatattcataggttctaagggttagcatgtggacatcttcggaggggccattatttgaaatctaaaatggagatgttattgcatcgcagtctattgggaggtagccactggaggtttttgcagccttgtttttatatttaagcaagggtgtatatgtgtgtcttagtctgttcaggttgatacaacggaataccatagactgggtagcttctaagcaacagaaatttctcacagtcctggaggctgggaagtccaaaaaaagttgccagcagatttggtgtctggtgagaacctactttctcacagatagcaccttcttattgtgtccttacatggtggtagaagggcgacctagctctctgggatctcttttataaggggtctgatcccaatcatgagagatctgcctaatcacctccaaaaggctccatctcctaataccatcacatcttgtgagtttggatttcagcataggaattttgggaggacacaaaacttcagaccatagcagtagggatgttgctaatacctcacgaagaaagaacttaaagaagctgagtaatttgcccaagaccacacaaaaattcattcgaatccagggacaaaactatatttcctgtgttttctccatgtcactcagaaaattcagcatgagggagaaatatgattcttaatatagaatcatatttctatattgaaatatgatttcaatatagctgttttggctagaacttggaagtgaacaggcaggcttaattgggcaacagtccccactttgtggggtgtgatcggcaggcttattccaggcttcttgctgagttataaaacttctgatttatctgatagagaccttcagaaggaggactggtgctattaaaattatacacatttcattctggaatttcttttgagggcatcatccactcccctcagctgtgattgtaaacctcattgctcttggtcagaatttcattcagcattaacaatgacacatcctgttatgctgtgcaggtgtattgctgtttataggaatttaagtttagatcattaaatgtttcaatactgaatgtattgacagttaagttgatgacgcagaaaactacaaatagctgggcaaactataagaggtgtttctcgtctgcaccttcccttctggtatcttgatagtatagcccaaaaatggttttaagcccttgcttctcccccagggctaccctctttgcttgcaccttacaaggttgagtgttgtgaggccccatctggtgccgactccaattctgtctctagcccagacccacacttgtgagctgctatgagttatctgggcatcttggttgacttaatcttcctaacatccttgtaaataggtggatgaatactatgttttatgattggaaaatgaagaatcaaaaagatatggcaatttggtttaagtccacatagctagtagttagggagctttgttgagaaagaaaaatgcatgagaggaaattaagactgtagttaataattatcaggtgcatattaacgttgcatgaagcttaacttaaatacatgttattcttaaggttaaaaagttcaaaacaaaggcgggggttccaaggcaaatgggtggggatagacaggagatgggcagaggtagatgaaatgcgggtgttatggtgtggaagtcagttggagtatagccactggaggcttttgtggccctgttcatatcatagttataagtgggatgttgctaatgcttgactcatcaaaggctgaaacaaagccagagctgaagttgagtacgtgtcaccgttttattggttaatctttcaaaaagagaaaagcctctgtttatacaggctgaaacagtcatttgacctgttcttcaactccatctggaattgctttggggttaacttagcatttcccctaaagcgcatatgacagtgggttgggaggagctcggatggggtttttgttcctccagagcgctgaggccttatttctgagtgaggtggccttggtgccagctaatgccactgtttagtgtgtgatgaactagaagtaacaggttaattttggccagtagacttgccagctgtgtaaacggaaccagtgaaactatttctcagtgctgcctcccacccctggaagaggacatcatgttatctacctgcccctgttggcttcccttgacccatctctcccatgctgtcccctcctccctgtgttactcatcagttcaaatttagaataattgaatgcacagagaaagtggcttgttctgaaaacttctgacaagaaatttccaggtgacttggtgctagattaattttagcctctcttatggattcaaaactgttttgtcagaagacttgaactaagacactttagaattaattacggctgggaaaaagaacaatctaaatgaggcagcgaacaaagattcctaaatatggagcaagacaagtggctctttatttcagtgggtcactggcatgaaaaaatatagttggggttacaggcaggaattactcttagagacatgggaattaaatgcaaggtaagtaccttgtttggaccctgaaactaacaaagcaactgtttaaaaacaaatttttttaagacattggggaaatttgcatctgctctgagtcaaagcctgggatttgtgtttgtgaaaaagctaatagaggaagcaagttggacacaatttaagaaattgttgaatctgggtgatgtgtatatggtgttaagtatatgattttccacgtctgtgatgatgaaacatttttgtattgacttcttaagtgtcttacctggcctttctgagcccacagttgagttgcacctgcaatccaaagtggttaccccgtcacggctgccagaccacagacactttaattcttgttgtgcggtgtgttgctgccagcccagagccaaaaaagcggaataccaccctgaagcttttgtaaacaattgtctttagcttatccagaggaattgagtctggagtaaagacccaaatattgacctagataaagttgactcaccagccctcggaggatggaaagatggccttaaaataaaacaaacaaaaaccttttttgctttattttgtaggaccactatgagacctcagtccttctatgatggaagtcattcttgtgccagaggagtgtgccatattccaatggctgagccgttttgccccaaaacgagagaggtgtgtagtctttctggaaggtgtaccagaataaatcatgtgggcttggggtggcatctggcatttggttaattggcagagcgagtggccccataccctcactcaagtttgctttgtattatgcaaagttttatgaagagttatttcctgttgctaataatttcctgttcctctgttactctcagtcattttaagctgaaccactcaaagttgcaacctacctttttaataagttttgattttgctatctagataaaatgatttaacatagaatatcacattactcaagagtatgcagtctggagccagattacttaggatcaaatctctgctcttcaacaaagtagctgtgtccaagaggacaaattatttgacatatgtgggtttcagttatcttacttctaaaatgaagataattatagcatgtaccttataagactgtgtgagggatgagagagttaatacttaatgaagtctctgaaccatgcctgtcagttatggaacatccaatggctggtaactgcttttgtgaattaaattactattattgatcttctaaaaatggtcagattggcagctgttgcctttgacctgagtttggccattactgcccagccttctgtctaccattatagccaaatcacagaactatggggacagccccacaagggccagtggtggtataaggggtggaatcacagttttagttcccaagcaacaaaaatggctaccatgactaagaagcctatggcttggtccacatgtgctacttctcttataatcccaggtttgaaagtcaggtgcaactcaaaagatcagaagtatcgttagagattaactgcttcataaaatctcccttatgagttaacttagagaatataaatacctaaacacgttagttattcagataatgttaacacctgcatatagagagtagatgatttcttttagcatttatgttttatcctacataatcacagaaaacccatttccttatagttaacagcaagggcacctaaactgaggacacagggttgggagaaatatttctagtctcaaacaagaatttggaatctaaaaccgagtactgagggaagccatttcggagataccactgcgcattgattttctctgacttctaggaaagtacgtcttttacttggtttttttttttttttaaaaaagtggcaggcgaagtttgtatatgtatgtatagcatgtttctggatagttatccacagaatgtatcagaatgctgctagtcttcctctgaagcacagatctgtccacataatagatttgctatcctgggggaaatgaagtatggataaaattcttgtccacttcaaaatgggggcagcttgggaagaaatagtctaaggagagaatatgcatgctcgtatgaatctgaggtcagttctcaggcaaaatacagtgacttggggaactaggagtagaggtagatggggaaagcacaatggagctgtatagagcacatgtaaatgtgggtctgtggtgataatttccagtaatccaagttagcctcccttgaagccaaattaattcagcttcataaagactgagagaatactgggaaaggcaatttaagaaaatggcaaaataagcattcagaaagaaatttttaaatattatccaaaaacatgaagagtaaatagtgctgccacttggtaattttcacttttaacatccacatgatctttcatgtactgatggaataggactgtcatgatgaattgtcaagtggcaagcaagatactcagtggttgtaccatattctaccatttatgttaaagtatgtatatatacaaagaagtaagtatgtaaatatttatatacaaataaaatatttttggaaagttaacaaaaaaagctggtaacaggaaacagggaagatggcagataagagacagggctggccaccacggtggctcacgcctgtaatcccagcactttggaaggccaaggcaggcggatcatgaggtcaggagatcaagaacattctggctaacatggtgaaaccctgtctctactaaaaatacgaaaagttagccaggcatggtggcaggcacctatagtcccagctacttgggaggctgaggcaggagaatcgcttgaacctgggaggcagagcttgcagtgagccaagattgtgccactgcactccagcctgggtgacagagactccatgtcaaaaaaaaaaaaaagtaaagaaaagacagggctaacgtgcagcttccacaaggacggacagaatagcatatggagacactatgatcttttgttccaagaaccactgtaggaacttaccgggaaaaccaaaagaattcaaagatcctttgaaagaagtggcacaccactgcaaattctgcaaaacaggcaagaaactgagttcccaaagtgtgagtcggggagaacctacctctgaatacacatccccactggggaaatctaaaaatccagatcatggaggaagaatttaaccttacctagaggtgaaacggatttagggggttatgtgaaatatgaaagtagaagtagcaacaggaagtgctttggatgtactcccagtctccagcttgagtccagggaagccagccctgactatatctcacagtggccctcaggtaaggcagccagtggaattggagagtgatggcagggcgaaggaagctcccaaatgaaatcagtagtggtttcagctggtcacaaattttctcaggcagagtccaagggactaatgggagccgcagcagatacaagtgagtacaggagctgctgctgatggagtgggcaggtgggaaggggtgaggtccaaaggccatgcttgctttcccagtggggtagctcacagcctggggcaaggtctgagcagggcactgcaggagtgagactagcctcaccaactgcatagtagctggatgaggcctcttgctgctggctctcccccactaccctggtaaagtttatgatacagcagaggcagtcaagatctcctctggaacataaacccagtggcctgacaaaccacccccatcccccaatttcccacagtgtctgcagcaagccctgcccaagaagagtctgagcccagaaccacctaaccctgccccaacctgatggtatttccctacccaccctggtagccaaacacaaaatatttattgccctgcctattgcctgggaaaccaaaatagttaccttgggcatcttagggcaagcttagagccccctactccttctgcagctggtgctctcttgaaagtgccacctcctggctggaggccagtcaactgaggccattacagcaactcataaaacaataaccctgatcccaggacggaaaagacaacacctaatttcactgcctgcaacatcctggctaaccagagatcctgaatatgtccacatgacaacttcactgctagcataagcagcattcaagagagccagcacattaaacatatctacaaccaatgactcttgcagagtttacttcacttccctgccacatctaccagagcaggtgctagtagccacagcttggagacctgaagatggatcacatcgcagtactcattgcagacatcccccagcaacagcccagagcctggtggcctcaatgggtggctagacccagaagagcaataacagtcactgcagtccagctctcaggaagccccatccctaggggaaaggggagagcaccacatcaagggatcaccccatgagacaagaaaatctgaacagcaggccttgagtttcaacctctccactaaaatagtctaccaaaatgacaaggaaccagaaaagcaattctggtaatatgacaaaatggggttctgtaacacccccaaaagatcacaccagctccctagcaatggatccaaaccaagaggaaatctctgaattgccagataaggaattcagaagattggttattaagctactcaaggaaatagcagagaaaggtaaaaaccagcataaagaaattttaaaaaacaatacaggatatggatgaaaacttctgcagagaaatatcataaagaaaaaataaatcacagcttcaggaaatgaaagacacacttagagaaatacaaaatgtagtggaaagcttcaacaataggctagaacaagtagaagaaagaacttcagagcttgaagacaaggctcttgaattaactgaatcaagacaaagaaaaagaattttaaaatgaaattttaaaagaaatttgggtttatgttaaatggccaaacctaagaataattggtgttcctgcagaagaagagaaatctgaaagtttggaaaacttatttgaggaaaactttgctggccttgctacagatctagacatccaaatacaagaagctcaaagaacacctgggaaatttattgcaaaaagatgatcagctaggcacatatttatcaggctatctaaagtcaagatgaaagaatcttaagaactgtgagacaaaaacatcagataacctataaaggaaaacctatcagattaatagcagacttctcagcagaaatcttacaagccagaagccagaagggattggagtcccatttttaacctcttgaaacaaaattattctcagccaagaattttgtatccagtaaaactaagcttcataattgaaggagagatagtctttttcagacaaacaaatgctgagagaatttgccactattgagccaacactacaagaaatgcttaaaggagttctaaatcttgaaacaaaacctcaaaatacaccaaaatagaacctcattaaagcgtaaatctcacaagacctataaaacaataatacaatggtgaaagaacaacgtctttaggcaaaagctagcatgatgaatagaacagtacctcacatcccaatactgatgtcgaatgtaaatgacctaaatgccccacttaagaaaagatacgcaatggcagaatggataaaaatctaccaactaagtatctgcagtcttcaggagaatcacctagcacacatgaactcacaaaaacttaaggtaaaagggtggaaaaagatattccatgcaaatggaaaccaaaagcaattaggaggagctagttttatatcagaaaagaacagactttaaaacaacaacagttaaagcaaagagggacattatataatgataaaaggagtagtccaacaggaaagtatcacatttctaaatatatatgcacttaacacttgagctcccaaatatatcaaacaattactaataggcctaagaaatgacatagatggtaacacaataatagtggggcacttaagtactccactgacggcactagacaggtcctcaagacagaaagtcaacaaggaaacaatggacttaaactataacctagaacaaatggacttaacaaatatatatacccaacaactgcagaatatacattcttttcatcagcacatggaacattctccaaaatagaacatatgccacaaaacaagtctcaacaaatttgaaaatcaaaattatatcaagtactctctcagatcaaagtggaataaaattggaaattaactccaagaagaatcctcaaaactatacaaatacttggaaatgaaataatctgctcctgaatgatctttaggtcaacagtaaagtcaagatggaaattaaaatattctttgagctgaatgattatagtgacacaacttatcaaaacctctgggatacagaaaaagtggtgctaatgggaaagttcatagcattaaattcctacatcaaaaagtctgaaggaggacaaatcaacaatctaaggtcacacttcaaggaactagaaaaacaagaacaaagcaaacccaaacctagcagaagaaaagaaacagcagagatcagagcagaactaaatgaaattgaaacaaaaaaatacaaaagataaatgaaacaaaaatatttgaaaatttaaaattgatagaccattagtgaaattaaccaagaagagaaaagatccaaataagctcaatgagaaatgaaacaggagatattacaaccaataccacagaatacaaaagactattcaaggctactatgaacacctttatgcacacaaactagaaaatctagaggagatgagtaaattcttggaaatataccaccctccccaattaaatcaggaagaaatggaaaccctaaacagaccaataacaagtaggaagattgaaacagtaattttaaaaaattgccaacaaagaaaacatccaagaccagagggattcacagctgaattctatcagacattcaaagaactggtaccaatcttactgaaactattccaaaagacagagaaagcaggaatccttcctaattcattctgtgaagccagtatccccctaattacaaaatcagaaaagaacataataaaaaaagacaactacagaccaatatccctgatgtacgtagatgcaaaaatcctcaacaaattactagctaaccaaatccaacagcatatgaaaaagataatacaccatggtcaagtgggtttcataccagtgatgaagggatggtttaacataggcaagtcaataaatgtgatacatcacataaacataatttaaaacaaaaatcacatggtcatctcaatagatgcagaaaaagcatttgacacaatcctccatctagttataattaaaaccctcagcaaaattggcatagaagggacgtacctcaaggtaataaaagccatctatgggctgggcacggtggctcacacctgtaatcccagcactttgggaggccaaggcgggcggatcacaaggtcagatcgagaccatcctggctaacacggtgaaaccccatctctactaaaaatacaaaaaaattagccgggcatggtagcgggcgcctgtagtcccagctactcgggaggccgaggcagtgaatggcgtgaacccgggaggtggagcttgcagtgagctgagatcacgccactgcactccagcctgggcaacagagcgagactccgtctcaaaaaaaaaaaaaaagccatctatgacaaacccacagccagtgttatattgaacagggaaaagttgaaagcattccctctgagaactgaaacaagacaagattcccactttcaccacttctgttcaacataatacaggatgtcctagccagagcaatcagacaagagaaagaaataaagggtaaaaaatcagtaaagaggaagtcaaactgttgctgttcaccaatgatatgatcgtatacctagaaaaccctaaagactcatccaaaaagctcctagataaatgaattcagcaaagtttcaagatgcaaaatcaatatactcaaatcaatagcacttttatagaccaacagcaaccaagctgagaatcaaatcaagaactcaacctgctttacaacagttgcaggaaaaaaaaagtaaaatgcctaaccaaggacatgaaagatctctacaaggagaactacagaacactgctgaaagaaattatagataatacaaaaaaatggaaacataccatgctcagggatgggcagaattaatattgttaagaattcttacaaaagcaatctgccaaaaagcaatccacaaattcaatgcagtttccttcagagtaccaccatcattcttcacagaaatataaaagtatcatatttctgccaaaagcaatccacaaattcaatgcagtttccttcagaataccaccatcattgttcacagaaatataaaaaaaaaaatcctaaaatttatgtgagaccaaaaaaagagcccatatagccaaagcaagactaagcaaaaagaacaatctggaggtatcacattacctgacatcaaactatactacaaggctatagttatcaaaacagcatggtactggtataaaagtaggcatgcagaccagtggaacagaatagagtatccagaaataaagccaaatatttacagccaactgatctttgaaaaagcaaaacaaaaacatacactgaggaaaggacaccctatttaacaaatgttgcaggataattggcaagccagatgtagaagaatgaaactggatcttcatctctcatataaaaatcaatgcaagatgcatcaaagacttaaatctaagacctgaaaccataaaaattctagaaaataacatcggaaaaacctatctaggccttggcttaggcaaagagttcatgatcaacaacccaaaagcaaatgcaacaaaaactaagacaaatagatgcagcttaattcatctaaaatgcttcagcacaacaacaaaaaataataatcagtggaataaatgaccacccgcagaaagggagaaaatattcgcaaactatgcattcaatagaggaccaatatccagaatctacagggaactgaaacaaatcagcaagaaaaaaaaaaaaggtcgctaagtacatgaatagacaattttcaaaacacatggccaacacacatgaaaaaatgctcaaaattactaatccaggaaatgcaaattaaaaccacaatgcgataccaccttactcctgcaagaatggccataatttaaacatcaaaaaataatagatattggtgtagatgtggtgtaaagggaacacttttacactgctggtgtgaatgtaaactagtacaatggaaagccatatagagattccttacagaactaaaagtagaactaccatgtgatccagcaatcccactcctatgcgtctacccagaggaaaataagtcattatatgaaaaagacacttgcacatgcatgtttatagcagcacaacttacaattgtaaaaactatggaaccaacctaaatgcccgttgaccaatgagtgaataaagaaaatatggtatatatacagcatgggtgtgatggttaatactgagtgtaaacttgattggattgaaggatacagagtattgatcctgggtgtgtctgtgagggtgttgccaaaggagattaacattgagtcagtgggctgggaaaggcagacccacccttaatgtgggtgggcacagtctaatcagctgccagcatggctagaatataagcaggcagaaaaatgtgaaaagagagactggcctagcctcccagcgtacatctttctcccgtgctggatacttcctgccctcaaacatcagactgcaagttcttcatttttggaactctgactggctctccttgctcctcagcctgcagacggcctattgtgggaccttgtgataatgtgagttaatacttaataaactcccatttatctatctgtcccattagttctgtccctctagagaaccctgactaatacagattttggtaccaggagtggttctagaggaacagaatattaaggatggagttcttttattggtatgaggtttctggagttgactgcttaatatgattagacccaaagatgctaaggactctacttctaataatatggataacaccaatagtccttgacttgaactgtttagagagttatgcaaaataaatatatttgagactcctgattcatcactcgtgagaggcaaggactctacataatacctttgaccatatgtggaatcacccttagtgactctgtacataatacctttgaccatatatggaggaccagggaacataatgaagctggttggttgctcctaagttcagtggacaaagtgatgaaagaaaataatgaactcagggattgtatctcccagctccagcagcagatactgagcctcagatctgctaagattgttctgaatgaaagacttatctcctgtagagaaagagctgaaattgtggaaaaacagacacaagctcttatcatgtgagtggctgacctgcaatgaaaggtacatgcacagcctcgccaggtgtctactgttaaagtgagagcattgattgaaaataaatgggaccctgcaacttggaactgggatgtgtgggaggaccctgatgaagctggggacactgagtttgaaaactctgatgaaccttatttaccagaagaaacagctttcccatccccagaagtggcagcatcccctccctgacctatgctgccatcagccttttcacctttgtctgaggagataaaccctgtgcggcctgaggcaacagtgatggcctcccctgaggcagttgccaggcaagataatgttgattcttctcaggagccacccctaagactcccatttgcttctagacctataactggactgaagttccagcaggcccctagaggtgaggttgagattgtgacccatgaggtggtgtgctacactcaaaaagaaccgcttgagttttctgatttatataaacagaaatctggagaacaggcatgggaatggatactaagggtgtgggataatggtggaaggaaaatggagttggatcaggctgaatttattgatttgggcccactaagtagggattctgcatttaatgttgcagctctgggagttaaaaaaggttctaattatttacttgcttggtttgctgaaatatggattaaaaggtggcccactgtgaacaagctggaaatgcctgatctcccttggtttaatttagaggaggggatccaaaggcttatggaaattcagatggtggagtagattagtcactttagacctatttatccctgctggtccagaaaatatgcccttgaccaatgccttgcaaaacagatatgtgagggcagcactgggatctttgaagagccctgtaattgctcttctctgtatgtcagatctaactgtggtaatgtcagatctaactgtgggaaccgcagtcactcaactacaaaacttaaatacagtgggaataattggattccaaggcagcaggggccatggcggcactcagctgtcaaaggcaaggtgggcatagctaccataatgggcagcagaggcaaagcggcaatcagaacagtctgactcgtgtaaagctctggcactggctaattaatcacagcattcctagaagtaaaattcataggaggcctactgcattcctacttaatttacataagcagaaacttctaggtcaaatggacaaaaaactaatttgaattataaaaacagactcacagcccctcaaccaatttccagacttgagctagtttacagacccagaaccccttgaatgaaggggaggccaggtcccgttgaggaaggaccccactatattaccaacaatttatgctgtgaatctttctcccgtccttccccaaggagacctccgaccttttaccagggtaactgtgcactggggaaagggaaataatcagacatttcagggactactggacactggctctgagctgatgttgattccagggaacccaaactgtcatgtggtcctccagttaaagtaggggcttatgaaagtcaggtaattaatggagttttagctcaggtctgacgtgcagtgggtcttatgggtgcctggactcatcctgtggtcatttccccagtgccagaatgcataactggcatagacatacttagcagctggcagaacccccacactggctccctgactggtaaagtgatggctattacagtgggaaaggccagatggaagccattcgagctgcctctacctagaaaaatagtaaagcaaaaacaataccacatccctggagggattgcagagattagtaccaccattaaagacttgaaagacgcagggatggtgattcctaccacatccccatttatctctcccatttggcccatacagaagacagatgggtcttggggagaatgacagtggattacaataagctgaaccaagtggtgactccaattgcagctgttgtaccagatgtgatttcattgcttgagcaaattaacacatctcctggtacctggtatgcagccattgacttggaaaatgcctttttctctatatctgtccataaggaccaccagaagcaatttgccttcagctggcaaggccagcagtataccttgactgtcctacctcaagggtatatcaactcttcagttttgtgtcataatcttattcagagagaacttgatcgctttttgctcccacaagatatcacaatggtccattacattgatgacagtacgctgattggatccagtgagcaagaagtggcaaacacaccagacttattggtgaggcatttgcatgccagaggatgagaaataaatctgactaaaattcagggaccttctacctcagtaaaatttctagggggtccagtggtgtggggcctgtggagatactccttctaaggtgaaggataagttgctgcatttgtcctctcctgcaaccaagaaagaggcacaatgcctagtgagcctatttggattttggaggcaacacattcttcatttgagtgtgttactctggcccatctattgagtgacccaaaagggtgccaattttgagtgggtccagaacaggagaaggctctgcaacagttccaggctgctgtgcaaactgctgtgccatttgggccatatgacccagcaaatccaatggtccttgaggtgtcagtggcagataaggatgctgtttggagcctttggcaggcccccataggtgaattacagtggagccctctaggattttggagcaaggtcctgccatcttctgcagataactattctcctttcgagagactgtccttggcctgttactggactttggtggaaagtgaacttttgactatgggtcatcaagtcaccatgcgacctgaactgcctatcatgaactgggggctttctgactcatctagccataaagtgggttgtgcacagcagcattcagttatcaaatggaaatggtatatatatgactgggctcaagcaggtcctgaaggcactttgctgtgcccgtgcatggcctccatccttgccacctggacactttgggctcctcctgcctttaagtcaacaggctaagaagggagttacagtgctggctggggtgattgacccagactatcaagatgaaatcagtctactactccacaatggaagtaaagaagagtacacatggaatacaggagatccattagggtgtctcttagtattaccatgccctgtaattaaggtcattgggaaactacaacagcccaatccaggcaggactacaaatgacccagactcttcaggaatgaagatttcagtcactccacaaggaaaaaaccacaacctactgaggtccttgataaaggcaaagggaatacagaatgggtagtagaagaaggtagtcatcgataccagctacaaccatgtgaccagctacagaaatgaggactgtaattgtcatgagtatttcctcctccttttgttaaaaacatgtttgtgcatatatacagttgtactaagaaaatatcttcattgtattttctttctcctttatcatatgacatgagatttattgacttcacatcaacatttaagtattgctaactttatgtagtagtatttgggttggtgtttggtgcatttccagttgcacaaaggatagctgtattatgttacgtgtaattatgaccttattattgtctttatttgaagattatgtatgatctcaggagatgtgtatggattcatgtggacttgtgatggttaacactgagtgttaacttgattggattgaaggatacaaagtattgatcctgggtgtgtctgtgagggtgttgccaaaggagattgacatttgagtcagtgggctgggaaaggctgacctagccttaatctgggtgggtacaatctaatcagctgccagcatggctaggatataagcaggcagaaaattgttaaaagagagactagcctagtcccccagtctacatctttctcccatgctggatgcttcctgccctccaacatcaaactccaagttcttcagttttggaacttggactgtctctccttgctcctcagcctgcagatggcccattgtgggaccttgtgatcatgtgagttaatacttaataaactcccctttattagttatgtccctctagagaactctgactaatacaatggaatactacttagccataaaaaagaacaaaatgatggcatttgcagcaacctggatggagttggagaccattattctcagtgaagtaactcgggaatggaaaactaaatatcgttatgtcctcatttgtaagtgggagctaagctatggggatgcaaaggcataagaatgatataatagggccgggcgcagtggctcatgcctataatcccagcactttgggaggccgaggtgggtggatcacaaggtcaggagttcaagaccagcctggccaagatggtgaaaggggtctctactaaaatacaaagaaaagaattagctggccgtggtggcgggtgcctgtaatcccagctaatcaggaggctgagccagagaactgcttgaacccgtgaggcagaggttgcagtgagccaagatcgcactaatgcattccagcgtgggcgacagagtgagactccatctcaaaaaaaaaaaaaaaaatgatgtaatggactttggggcctctgggggaagtgggagaggagaatcagggataaaagactacacattgggtatagtgtacatttcttgggtgacaggtgcatcagaatcccagaaatcactactaaagaacttatatacatcacaataaaccacttgctccccaaaaactattgaaatgaaaaaaaaaaaaaagcctggtaataatggtttcccttgggaagggacagtggttttccttgtactatttaagttttgtaccatgtacaaatacgtgttccaaaagcagtgttacttctattcattttaggagttaatatgaaagtcctgacattaaatctgtttaggctggtgatctaatattgctagttccttggtgagggttgtggtactttcactaccacatccgtctgtttagtagttcagtgattacacgaggtaagaaaatgaaatcatcttaaactcagacctggaccttgaccctgtatttgatattttttgctgccttaagatagtgttagctgttcttgaaggaatgcaaaatgctggttcaggtggctgacatatattcatagcctccatttcttcctcctcctcataagcatggtacctatctcccaaagtgccagagtgacagtgaggacttgtcaagagccattcatctctagaagcactgtgaactttagccaagcatatggttcagttattcaggatctttaaagacattattgaaccagcgggagtgggcttgttatgtcttaactttaggggggaaaagggggtggggtagagatttaggcttttgcatttataacatatactttttagggaaaagtgttaattaagcataattttattttcagcatttataagataaacatgatgtagcatcaactgttcattgtccatagcttgctaaattttgagttgccaagactcttgtgaaaattctgtttcccattgcagtggcatagtgtaagttattttttaaggaaataggttaatttgtttatgtgatgaacacatgtgcaggtgagactttgcccagattggagactttgactttgagtcactccactttatttatatagtatcccaggaaggttagccaaatatgtgtagaagctgccagtattaatgattgttagaagaccagcttagtgcatacagtgtttacagcgcacctggcatgcttctatgcttgtatataccttagttcatttaatcttcctcatacaattgaattatgcgatatcattattctcaatttacacttgagaaaactaaggcatacagagatgatttttcaacagtgcttcagtaagttaacagttaagttgaaaagacttttttttaattaaaagggaatattgaataagctaagaaaaaatgaaggtaattaataacttgaagattagatgtgcagtattaaataaaacactggagaaaaggatcgaacttttcaatgatgtttctaaaaatccatgcctagccttgccactaaaggaattccaagatgtttatccctgtgaacagaaaaacaatcagcacaactctgtggaaaggcaataggcaaaagagaaatcactttctaaccagcaaaagcttttacagaagtcttcagattctgtatttttaaaagtaatgagaattaacttttcagaagcctggaaatagaactcaacacacctgtttgagaagataagcgacgagaggcaccttagcttagcctgcgaggttaaaagttaagactccagtctgtattctcaaaccagcttagtctcttaaagttgttaagaagcaaatgagattaaagcatataaacaaatgcctggcgagtagaaagagctcagtgcttgcttgtgtagctattagtttctacatgcaaagggctggggaaacaggattatgtgaatgagaaagggtccaggaaacacccttctgtggtcctctaggttttttctgagagcctggcagatagtaggcatttattatagtgacaaatcatctttaagaaatcaacttggtaaacattggggggaagtgcagccttaagttgtgcatgtgctagtatgttttgaagtttctggtttttcttttctaggttcttatagagactgctaagaagctaggactccggtgccactcaaaggggacaatggtcacaatcgagggacctcgttttagctcccgggcagaaagcttcatgttccgcacctggggggcggatgttatcaacatgaccacagttccagaggtggttcttgctaaggaggctggaatttgttacgcaagtatcgccatggcgacagattatgactgctggaaggagcacgaggaagcagtaggtggaattcttttctaagcacatatagcatgggtttctgggtgccaatagggtgtcttaactgtttgtttctattacgttagtttcagaaagtgcctttctacaaggttttgaagttgttaatattttctgtagttccattggaaggtaagaacaaagatcaaaggaaagaaagagacacttttacccaaggatcagtagtgaaaatagtacattgtaggcaggtagatgtgttgagaatcatactaagacttgggccttattttcaggataaaggtgtattttgattgccaatttctgctgctatgctactgttttttgttttcaagaaggaaaaaaatctattaaccctttcctcatgagagggctgtatgttcacatccatctatttaacgtaccgtggctggatactctgttcagcatagaaatgtgacaacaaacagagaagtccttaaggagccgacattctgtcggatggagatagaagttaagcaaaccaatataagaaagctaacggttataaagaaatagaatggtgaggtacaagggtacactaggtcaactgaatagagttgaccagaccaaatatttgaagtatgagaagccttcctgttttaagtgtgatgggcaagaagggcatgattgagtagagtggaaaggagggagactggggagaagggagagagaggagggatgcaatacagtagggccaggccatacagaccatggtaagggtttcagatggaaggacagtgaggggttcaggcagggaaggcagcaggatccagctggaatttgaggacactggaacaatgaggtcagcttccaaaacaaaacaaaacaaaactttaaacatctgtgtaagtacagggtggaatataatgaattccaggtacccatcacttaggttccacaattagccatggccaatcttgtgtgataggtatgtccctacctatttctcccctgccctcattgtgaagtaaatattttcctaaaaggtctttttaaaattaagttataaccatgccatcattgtacaaaaataatgatattaatttcttaatataatcaaatattcagactattcctttttccttcagtctcataatttttaacaatttgatcaaatcagaatcccttacaatccatatgttgtattttaatgattacctcttgtctcttttaatctaattttcacctctttctctttttattccttgtgttacttgaataaactagatcgttcgtcctgtcatttatctcattttaagataaagggacgacaaaactgcagtcacttttgaagtaaggaaaacatttaggggtgactttctgagcacatttagggtaagtgacatctccaaagaggcctaatattgtaccaccgttttagagagtttgttttactatctaatgtgtacagtgttttgggtcatagatgaacacaggttctttgtttttcatgaattccttatgatgactcttcagtgtaataaactgtttgcttagtactaggatgccttttatgtaagagattcgcaaattattacattaagtcacaacataatatcttatttggcagctttggtaacctaaggaacaactcagcctcgtaatgtcaagaagctgcttccaattaataggaaactccagcccctgccacaccctgagagcggtttgcttcctgcctgtggctttctgctcagtctaataacatatgtctcctcctttgtagaaccagcagtgatttcctttagtagccaaatgaggttggggaaatagtcagctggagctactttattgaaaagcagagaaattaagctctgtaagtggaaaggcttgaagacagtgttaaatgctacaaggaaggcccacagaaagatggcattatttcagccaatcgtgtgttgcagcctggcatggcaaaaaggatttggagttctctaaacccatcttcagatttgagttgctccatttgcttgtcacattgggcgagttatttcacttgtttactcttctgtagaatgaagccagggctctgggtgaggagtggaggttgtttagtcattgtttagtcagttagaccttgaaagattactggaagaattaaaccaaatgagatatgtaaaaaagctagtataatgctggcttgtaagagggtggtcatcagatggtggctctgatggagtggggggcctgagaggtgggtagtatcagggaaaagcatttaaactgcaccttgaagagagggtttattttgggaaggtcagtaggaaggacattttgggtgaagcccaacagctggaacaaagagaagggaggtcagtgtctatacagaaataaccagtcacaggaaaaatatataaggaaatgagtaaatacaaggcaaatttcttggatgcttcatgtctgcattcaaagactcagcttaaaacatatcatttacatgtgcctggcagatacccagcctgtcactgctttgtgttcccatagtagtgcaaactcccctctgctacagtgttcatcattttttcctatacacatcttggtgtttgtgggtgggatctggactatgcttaaggaaatagaaagatgtaatccttgtgtccctgaatgctggatttcttcgaagcataggaaggcatgtcaagtactctatctctgatggtaattttgtgttcactttcttcaactttttcttatgaagctattttagtcatatacagaagtagctaatagcacgagcttccatgaattcagcatctagcttcaaccattatattaacttacaaccaatatgattattactcccatcaataattttatccataaacacttcaggaggtatctaacatgagcacattatcattttcattctccaataataattctttaatatacccagccagaatttaaatttctggttaaatgccttaaattattcttttggttgcaagctttttatgaaggaaccagatcatttgtcctgttgagtttcccacagtctgaattgctgaaatcatctccttggagtagtttaataggcttctctgtcctctgtattgtctataaattggtagctagatttagaaatttaatcagattcaggtgtcttaaggtagcattttattttttcatcaggaagcacataatgagtggtttatttgggattttgtttggttcggtttgtgatgttagcagccaatccattaattcactgggagccataaaaatggtggtattttaattccataatatttttctttagtagctggaataattttctaaggagaaacgtacctgtttggttttccagtgtagcaacagttttaacattgtaatcccttcggctgtggacatgaagagaacagccacatctttctagaccatattaacccattatacatctgagatattttctccgataccatattgaaatctgtattagtctgttatcacattgctatggagaaatacctaaaactgggtaatttataaagaaaagaggtttaattggcttatggttctacaggctgtacgggacgtgatgctggcatctgctcagcttctggggaggcctcaggaaacttccaatcatgttggaaggcaaaaggagcgaggcatctcacatggtgggagcaggagcaagagagagtgagaggagaggtgctgtacacttttaaacaatcagatctcacaagaactcactatcagtaaaacagcacctgaggatgctgctaaaccattcgtgagaaatccaaccccatgatccaaccgcctcccaccaggccccacctcccacaattcgacatgagatttggtgaggacacaaatccaaaccataccagaattcatcagtgcttttcagagatgtcactgagtttctctaggacctccgtgctaggactaagaccatcttgataaatgccgagcttgaactcaggggtttaaacgtagaataaacagacttcacaagtcaggtttttcttagtctgtctggactgttgtaacaaaataccatagcatgggtggcttctgaataacaagtttatttttcacatttctgtaagttgagaagtccaagatcaagggactggcacatttggtgtctagtgagagcccactttctggtagacagccatcttctcactggaacctcacacggtggaaggggccctcgaagaatagcactggggcctcttttgtaagatcactaatcctatccacgaggactctgccttcatgacctaattgcctcccaaatgcccaacctccaaataccctacattgaggattcggtttcagcagataaatttgaggggacacaaacatttaggctgtagcaaggctggagctcagaaaaatgttttatgacaagcagtggaattttaagttctagtaacctccagtgctattgtttctctaggtttcggtggaccgggtcttaaagaccctgaaagaaaacgctaataaagccaaaagcttactgctcactaccatacctcagatagggtccacagaatggtcagaaaccctccataacctgaaggtaagtgtcagccatggacaatcaggcatgtctgtagactctctattgtcttcttttcttacttgcatttcacctttggtcctcatgtattttatgccagcctagatgttttcaacaagtttttgtgacatctactactaccataccaaccacttgtgaaactgagtagtcttattttctggctggtagtgcaagaccactgaaggctagggttgagagagttttattatctcgtgtaccagattcttcacattgccctgctctgtagtatccctaagtcttacttcagaagattgatagtgctttctctgcatatcgcttacattgttgacaaagctattttctctttggcagatccattcaaatttgtggcaatcctttaaagccaaaactctgacaatagtaccaaaatggtgccagaaaatatctgcttaaggttaatcatgcatcaaactaaacagtaattaatgataaaccaactctagtattctcagaatataatttaaactaactgataaactcggagttgcatgatttttctttgggcactttgtgactcttcttaaccacatagggaaagacttgtctcaaactgatcagatattgcattctcctactatccaaagaggaccataccccaaagtctcctagaatacacctgtacttttgggtcttctggtggtggtggagagaggatttgaaaggttgatctaagccctccttacctgaattaccacctaggagctctgtaatgagagagccacagttttagtataatgaggacattgtatggtggtaagtgactgccaatcactgggcatggcagagccttgatttgtaatgtttgctaatttacgtggtacaagtgctccagtacggccagtttcacactactaatgtgaagccactgatgagttgagaagtgatacacacagctcttgcaagctggtacgaacagaatccagcacaccactgtaactaaggtgtctctcagcagttaggactgacggtcaagaatgttggaatttgtagcttatcttccctactaagaaacaaatctattggtttcaacactgtatacctaggacctaaatgttatttaatgaataaatgatactcctttcccccatgaagtgttttatcataatatatagagatgcaggaaacccttattattagaattaaaagggaaaaaatacatttgagtgcagtcaaatggcacaactggagcttgcataaaaaaacgcatgttggtttgccagaaatgtgactcctacttgtactattgttagcaaaatgtcatagaagtttgtttgtttatttgtttgtttgtttgagacggagtctcattctgtcacccaggctggagtgcagtggcacgatctcagctcactgcaacctctgcctccctggttcaagcgattctcctgcctcagtctcctgagtagctgggattacaggcatggaccaccatgcccagctagtttttatatttttagtagagactaaacctagtagatgaccaacatggtttcatcatgtcggtcaggctggtcttgaactcctgacctcgtgatccacccgctttggcctcccaaagtgctgggattacaggcatgagccactgcgcccagccaagtttattttttttaagtctcccaactaaccccactttgaccatagtctttcaaaagcttgaagttaatttctcaaataatatatttactgttttagctttatttttaagtaaaaatgcttgaagagtagaaatcagtgttctcctttcctggagcttctgaaattgtaaaattgtgtgattttatttgtatgcatttttaaagaggcttagtttacgtagctttcatcggattttcaaaggaggattttatatatatgtgtatatatatacacacatacatacatatacacacacacacatataaaacctaaagagagaaaatgaggaattcctgctctagacaaaactgagaatcttggtcttcatgctacagcattaaggaacaccatactaataatccctttttctggggtagtattgttagcactgaaatgtgtatcattcattccctcactaagtcatttcagaaacacttagcacctgctatacgtcaaggtctggtttgcaaagataaagagttgtgatgatgatcctatggtgtttggagatatagacacataaaaatttcaatgatttcttacagtggggtaaggataagggatagaggttgcataaacaataatccaggctgggggctggtatggcaataagtgattatcagaacaatgctctgagataagcattattaacctcactttacaggaaagggaggtgaggaaccaagagtttagagtacccgaagttccacatctggttagtgaacttgaaaattttctgtagaatttatttaaagtgtatgtttcctgcgtcctcactttgatctagaaaatcaaaatctgtttttttttttaacaaacatctcagtaattacgccaacatgtgaatatcactgcctcctttcttcctttcagaatatggcccagttttctgttttattaccaagacattaaagtagcatggctgcccaggagaaaagaagacattctaattccagtcattttgggaattcctgcttaacttgaaaaaaatatgggaaagacatgcagctttcatgcccttgcctatcaaagagtatgttgtaagaaagacaagacattgtgtgtattagagactcctgaatgatttagacaacttcaaaatacagaagaaaagcaaatgactagtaaacatgtgggaaaaaatattacattttaagggggaaaaaaaaacccaccattctcttctccccctattaaatttgcaacaataaagggtggagggtaatctctactttcctatactgccaaagaatgtgaggaagaaatgggactctttggttatttattgatgcgactgtaaattggtacagtatttctggagggcaatttggtaaaatgcatcaaaagacttaaaaatacggacgtactttgtgctgggaactctacatctagcaatttctctttaaaaccatatcagagatgcatacaaagaattatatataaagaagggtgtttaataatgatagttataataataaataattgaaacaatctgaatcccttgcaattggaggtaaattatgtcttagttataattagattgtgaatcagccaactgaaaatcctttttgcatatttcaatgtcctaaaaagacacggttgctctatatatgaagtgaaaaaaggatatggtagcattttatagtactagttttgctttaaaatgctatgtaaatatacaaaaaaactagaaagaaatatatataaccttgttattgtatttgggggagggatactgggataatttttattttctttgaatctttctgtgtcttcacatttttctacagtgaatttaatcaaatagtaaagttgttgtaaaaataaaagtggatttagaaagatccagttcttgaaaacactgtttctggtaatgaagcagaatttaagttggtaatattaaggtgaatgtcatttaagggagttacatctttattctgctaaagaagaggatcattgatttctgtacagtcagaacagtacttgggtttgcaacagctttctgagaaaagctaggtgtttaatagtttaactgaaagtttaactatttaaaagactaaatgcacattttatggtatctgatattttaaaaagtaatgtttgattctcctttttatgagttaaattattttatacgagttggtaatttttgctttttaataaagtggaagcttgcttttttaactctttttttattgttattttatagaaatgctttttgttggccgggcacagttgctcatccatgtaatcccagcactgtgggaggccgagacgggtggatcacaaggtcaggagatcgagaccatcctggctaatgcgttgaaactccgtctctactaaaaatacaaaaaattagctgggcgtggtggtgggcacctgtagtcccagctactcaggaggctgaggcaggagaatggtgtgaacctgggaggtggagcttgcagtgagcagagcttgcagtgagacgagcttgtgccactgcactccagcctgggcaacagagtaagactcagtctcaaaaaaaaaaaaaagagtgaaatgctttttgtttgcttcagttttttatcatggggagatctttttcctcagaattgttttcttttcactgtaggctattacaggatacttcaggatcaagatacagaaccttttatttaaagagtttgtaaagtcaatgtgtttgtttgtgtctctgagattgacttcaagataataagctgctaattgtaaacaaaacagttaccctccagtattaatatgactcattagtgtgagccatttgggtcaagtatgattatgacccttggacttcctgatgtagtattaaatttcaactctggttatccattagcaatctgtagagaacttaatgaacctgaacccaggcttctctagctctggtaacgtgtgattgttttcactacaatatgatacatagatggtaccttacttttcctcattcttaataggtgtctaagaatgtcagggcaaaagtatgggcatttttcttgctatgttcagaaagtacagttctctccaacttgcagaggtacttttcttgattaaatagccttctctagcaacatcattttcagactaactaaatgaatgcagtatactcttttctttgttctcaatcattcactccttatgcaaagccaatataattttcctcataccttatgcttgaggatattgttgaagaacacttcctggaacacttctcacttgtgatgctgtactaattttttttttttaatttaagctagtatactaagtgaacaccatggtcagttgtgagcattttggtttccgcaaaggatggatggtgagcatcatgggaaagctgtagtttagtgacttagcccttagtgattaatagatttgcatgtacatagaagtctttgttggccttataatctgctgttatatttggcatggattttcatggttttgagaatgacatcctggccctgtggtccccgagggtcatggtccttgtgacctggcccctgttcactgcccccttcgctagcacgagttgctgtgcagggctggaggtagctaccatggcttgtttcaaggaaggaaactctggtacggtggcaccctcaggagtggaggacagtgaacttccttgaagagggagtgactaaggtgacctccaacctgccctgagccagctgccctgcaggtgccacgtgagcctgctctggcatccacaggatgctcctggagcctcttctctggctgctacctcagggcatggttgtggccccaccaacacctattttccaaataattattcattcttgtgacagtggcctgaacatgtttttaattttctcaacaagcatttagccagcacttatccagtgaaacaatttgataaggtttcaaggagtatctgatgggttaggaagtcacgaaatgaggagttcttgccacatttgcagagtccctccttgataaggtttggcggtgtccccacccaaatctcatgttgaattgtagttcccataatccccacatgttgtgggagggacccagtgggaggtaattaaatcatgggggtggttacccccacactgctgttctcatgatactgagttctcacaagtcctgtttgttttataaggggcttttcccccttttgctcaacacttcttcctgccatcatgtgaagaaggacgtgtttgtttccccttctgccacgattgtaagtttcctgaggccttcccagctatgtggaactgtgagttaattaaacctctttcctttataaattacccagtcatgggcagtcctttacagcagcatgagaatggactaatacactcctcaaatgttttgaagattgttgcaccttggaactaccagtgtgcacacaatctggctcaatgtatatattggcccagcaaggcaaagaactgaagttccaggatggaagaacctgtgttctcctcataatagtatagaataattcaagataggcaagaaggacagcagtaaatgaagaccatggaagaaaagaaggaatgccaaagatcgaggaaatctaccaagactagtagggtagtccagaagaagctgtttcagggcctgttgccagctatgcctttgagaacctcgggatcccaaagaatgaggggaatttcttcagaaagacaatctcggcatgcattatttctttgttttgaagattcactcatgttgcatgcatctgtagcttgtgccttttttattgcctagtagtattctgtcatatgcctatcttacaatttgattatctattcacctgttgatgaatgtttgaattttttccatttgaggaattttatgaataaagctgctataagcatgaaattacaagtctttttgtgaacatattttcacttgtgcaaatgcctatactcccaccagtaatttgtaagaattcttgacaaagcttggtattgtcagcgtttttaattttagccattctattgggtatattttgatatctcgtggttttgatttgcatttttctgattaaagatgttgaacttcttttcatgtgcttattggccattcacatatttcgtgaactatctgtacaaatatttttgtttattaaaaaattagattgttttgttttattattgaatagtaagaattgtttatatattctggatacactctttttcagatatgtgtgttgtgactattcttagtctttagcttgccttttcattttcttaattatgtctttcaaagaacaagtttttcattttgacgaagcctagtttatcaattttttttatggttggtgctttttgtgtgttccaagaaatctttgcctactcatttaattacctgtgtgcccttgtcaaaatcatttaattttgactactcacttaattaccttgcctactcatttaattacctgtgtgcccttgtcaaaatttactgtttatctgtgaatctggatgatctatttatgtcatttatctatgtgtctcttcttatgccagtaccccactgtcttgattattgtggctttatggtgtcttgaaattaagtattgttaagctttgcaatcttttccaagattgttttggctataggtcctttctttataaagtttatattaagcttctccatttttctttaagaaaaaatctgctggaatggcactgaatttttaggtcgatttgggaagaattgacaatattgaacctttcaatcgatggacatggtatgtttctgcatttatttgggccttttaaaatttatctcagcaatattttgtagttttagtgaagaagtcttgtatatatcttttgttaaatgtattcctaaatattttgtggaaatgttactgtaaatagtactttaatttcatttttaagtttattgctggtatacagaaatatgttttatttttgtatattgactttatattctgtaatcttattaaattcacttagttcagtagtagttcttatttttattttattgcaagtgccttagggataccttgtgtacacaatcatgtcatatatgaataacaacagtttaccttttgtttcttcttgctttgtcgtaatggctaggaccttcaacctaatgttgaatagaagcggtgtgtgagttgttactcttgtcttattctcaacagcagaggatagcgtctagtttttcactattaaaatatgttagctataggttttttccgtttcatgtttttatcagattgaagatcccttttattcctattttgccaagagtgtcatgaatgcatgttgaatttcaccaagtactttttcctgcatctgttgagagaatcttgacttttctcttttattttgttaatgtagattctttaatgttaaactgatcttgcattcctgatataaaccatacttagtcatgatatgttatcccctttatataatgctggattcggtttgcaaatattttgtttgatttttgcatctatgctcatgagacagattggtctgtgattttcctttcttgtaagtcttgtcaggtgtcagggcttggttaattttgacacatttacaaacatatatttttaagataaaaataaacttcaaaaaaaaaaagatgacgacagcctgagttgtttatatacagaatttgttaaccaaaaagattgaaaaaggctggaacagcaggttacatttgatacctgaaaatattttgcagctataaatgcatcttggaactgttataggcaaaagcttgggaatggctaaaattctcagtgtcataggatgttttaaataaactaaggtacatcaattcaaataagtaatgtgcagttgtcaaaaagaatagatatctgtttatgcaccagtatggaacaatgttcatgacaaaaggggaaatcaaaaatacatagagtaaaataagtttgtggtgatgtatagataggatgtttatacttcatatttccagaaaggttctggaaagaaacttattgatggcttctgagggatgaatcaagagacttaaactgtctacttcatacctttctatagtggttgaatttttcaccacaggcaactgttcctttaattgatatattttaaggaatggatactagaggagacctagcttcatagcagtttatgtaacatgagataaaatatatgattcttggcattaacttctgataggttgtgcttggggcactatatccagttctgggcacaatgctttcaggaggatgactatctaaaaagcaccaagagaagagtgaagggactgaaaaaaccatgccacatatgtaatacttaaatgggttaagtatatctaactacttaggagaaagccttcaatgagaactttgtttaggggctgtcattctcttacagacatgtgcctccctcactgttctgtaagcttttgtaaaggcaggagttgtttttttaactcatcagtttaggagcctcttttccttgtatttagcacaaactcaacaaatatttgtgtaaataaaaatctgattacgtttctttcctacttaaaacccttcatcagctctcccaaacacctccccatgttcactttcagcaggtgactttagttccctcttcacagacagaactgaagcatcagcagaacactttcaagacccccctctgctgctctctcccaaactgttttccctcctgttaccatctgtgatagtgcttctcaaacgggagcacgcatcgtcatcacctggagggcttattaaaacaggttgcatggcaccaccccagagtttccgattcaggatatctggagcatggcctgataatttgcatttccaacaagttcccagatgatgctggtcccactttgagaactactgtcatagatgtttctccctgatcattgtcttatgcaccagaccccatacctcacacctagtaaggacatcagtctagtaactacccatttcataatcatttttctccttattattgaatcactttttcagcacacaaatatactttatttctcccattaaaattcttgaccccaattctatgtgctggctcatttttaagcttttcattggcataaaatccctcgagttattgtttctcctgcctccaattcctcttctccagtctttccttagtcctcttcatttcagattttgccagtgcaccatcttcagcaccaacaagattctcaaggtcaccgatttactgcatgtcaattttcacacttaacccttagtttcctatcagccgcatttgatacacttgaccccttcctcctctttgataagttttctttacttggcttccaaggacaccacactcttgattttcttccttcattgatggttgctgcttcttagtctcctttgctgatttcttgccttctccctgatcttttaatgttgcctgccctagagctcaatccttggatttctccatcttcacttgttccttggtggtcactcctcaacttcccctacacctgctttcccatcccagtctagcagttccatccttctagttcctcagactaaaaacttgaagtccttgactcttctcttcaaaacccacattaaaaccaggaaaaatttatttaccatccaaatatgtcaagatactgactattcctcattacagctactgcttccaacctagtctgagccactctcatctcacctggatactgtaataacccctaacaggtcctgtgtctacttttgttccctagagcaagcaacccaggaggcagaatgatctgtacaaaatgctatttcacttgtattaaaatcccacatttatgatagcctatgaatccccatgtgatttgcacttgccctcctatctctctgacttcctctcactactgtcctcttgctcactctgctccagcccttttccaagaacacaccaggccccctcctgcctttaacattagagtatttggtttgtgttccttctacctggaacactctcccagcagataaccacctggcctcactacagcagctccttcagatctttgctccaaaatcaccttagtgggtcaaccccaaacatcgtattttaacagatgataatgcccttcactccatgcccaaagtactcctaaggactcttacaagcacagcttttttgtttttcccatagctcttaacttctccctacttactctagtatttgtatatatttgtttattgttttgtaactcccaacacacacacttcctccaaaatgtacaacctctgtgacagcaggaaacttgtcatttactgatatcctaaatgaccagactagtgcttgggatttagtaggcttccagccaatactatcttgaatgtacagcttcccaatacatatggcttgcaaagccgtgtatgttctgacttactccagcctctttctcacctcccacacctcatggcactctaaatcagtgctgtctgatagaaatatgtgagccaatatgtaattttaaattttctaggagccacatttacaaagtaaaaaacagttgaaattatttataatatattttaatataatatatccaaaatgttatggagatgtaacatttaaaaattatgaaatttttattcttcaaatactaaatctttgggatcagatattttatactaacagtacatctcaattcagaggttaaatttttttttcttttttttttttttttgagatggattctctgtctcccaggctggagtgcagtggcatgatctcggctcactgcaacctctacctcccaggttcaagcaattctgcctcagcctcccaagtagctgggattacaggtgcctgccaccatgcccagctaatttttatattttcagtagagacagggtttcaccatgttggccaggctggtctcaaactcctgacctgaagtgatccaccagcctcggccttacaaagtgctaggatcacagccatcagccaccatgcctggctgtgaggctaaatttttataagaaatgttctatctgtgtttaaattttgtaaaatttactttgaaaaaatagactcacatacctaagttgttccagtgattttgaagcggctgtcaacttttaaatttaacttaattaaaactaaataaaattaatttcatttgctcagttgcactagctacattttaagtgttcagcagccacacttggctagtgatgtattagcacaactctttgaccccagctccaagcagaccaggctcctccttgtctctggccttttgtaagttgtccctccacttggaagactcttctttgctccaccatcatctctttttatctgactcactgtctgaattagccctttctctgcactttgcaaacaccctattctgttacattactagtcacactgtattataattgtctgattcattgtgtgatggttcaggaattatttctaccttgtttacttctgtgtccccagactcttcggacattacctttcatataagagatactgtgtatgtctatatatacatatatgtatttgttaaataaatttataaatctatgaaatttatgcctatagaagttttagccatccttcggtttccacctcaaatcccttcttcccaggattcttgtcagagcagtccacagcaaatatttcctgttttgtactcccaaaccacctgcagctcatattactcataggccatttgtaatacatgattttactacgtaaaattctacctccccagatagtgaaaactggaagagcaggaattctggaaaagaaaatgacttacatattaggtgttcaataaaaacttgatgacttattaaatatattgtctgatttcagtcttatgtctggtgattacttttcctgaggtaattcagtaaaaccagtgaaaatttttgtgtgttttaaccattatgctaaaaggtatctgctctctgccaggcgtggtggctcacacctgtaatcccagcactttgggaggctgaggctagatcacttgaggtcaggagttgaacaccagcctggccaacatggcaaaacctcatctctactaaaaatacaaaaattaaacaggcatgatggtaggcacctgtaatcccagctactcaggaggctgagcttagcaggaaaatagcttgaacccagaaggcgggaggttgcagtgagccaagattgcgccactgcactccagcctgggcaatagagaaaaactccatctcaaaacaaacaaccaccaaaaactgtctgctctcaatcttttgattgaatagtaaaaccaatattttttttaaaggaaggctacttcccgaatgaccttatctacctatgtgtctgtgtagttggccattaatcaaatgtcatttatatcccaaacttcattttcattcattgttgattcggttgatactcatgtccatctgtctacagatatacactgtcactcatcagtgttatatacaaaccttactcattttattatcactaatgggctcaatcctaaataagatcaaagcttatttttcccttttgcatagtatcttccaatagtcaagctaaagaagaaaaaagcaaattgcattatgaaaatgctatactacacagtctgttctgtgaggtgtagagcaagcattaatgaccctttttttctgtgccagattggaggagaaaagagagaagtagaaacaattaactgtagacagatcagacctttcaactttttcatgctttatgactgcagtcctaatgataaagaaccccagaggcaatgtgagcactccctcgggagggaatgtgagtctggtatctggtcctctctaacagttcatgcctggtaaggatcatggtgtcctggcatgacagacaccaaaagtccacattttccaagggaatgaatgtttacaaatacattggttccttgatgttactagagccctcttcctattctctcctcttttcctaattcatgcccccttattaccttaacagaggtgggagttaatcaggatgtaataaaattgaaaaagtacctaggatggaagggatttggaattctgaatattgtgttttaagttggaaaaaaaagttacataaaatgtattctattgtcttggcagttatttactttgttttttatcttatagtttgtcttcttgagactgtaggcgtctataaactgtgaactaatttagatgccactcctgagggcctggcacatgatttgcacttaatgaacagctgctttggtctgaatttctgtgtcctcctaaaatccatatattgaaatctaatctccaatgcagtagtatcaagaggtagagcctttgggggtgattaggtcatgatagtgtttccttcatgaatgagattagtttctctataaataaggcccgagggagctcttttgccccttctgccatgtgagaacacgtctagaaggtggcatctatgaagtagagtgggccctcatcagacactgaatctgttggtgccttgatcttggacttccacccccgccccccaccccaagaactgtgagaaacaactttattgtttttaagttactcagtctaagatactttgttatagccacccaaaaggactaagacagcagccactaaaaagtgttcattttacctcaatcagcaatttaaaaggaacagctatagaagttgaacaacagtcgtactaaatggttcctaaggaagttatttttgaaaaagtataaatatcaacatgaaaaggtttcagaattcagtgtataagtgaaaaaaggacatgttcttggtttaataatcattttgttgcagagcacttttttcggaataaaaaaaatttgattatttcatttagggaagattaacaggaaatagtgttatcaaactgtgccctcagttttatagatgactcagtcttaaaaactccacacatcggaatgtgatgatgtgttcattagctgctctgtttgacctcactttagtttacgaattcccaccctttaggaatcaagattacaaggctaaagcagtaagtaataggaaagtcaacttcaaatatatacagaaatacaaagatcaatataatgaacccctgtctgccacccggcttcaagaattacttcatagacaatctgtttattctataatcccactgactgttcacctccgacgttattttgaagcatttctcatgtatgatttcatctatgaatatttccatgataagaataaaaatttcttaatgtcagaaaatatttagtgactattcaaaatttcaaatgtgttataaatgccatgttttacatgttgtttatttaaatcaggatccaagtaaagtctatacattgcaattggttaatacatattttgtgtttcttttattttaggccatctcttttagtaaatgtccttgaatgtttcttaagttgctgtatgttcatggaccatttccagagactttgattggttgttttaaaataattttcacccattctgtaggttgcctgttaatgctgatggtagtttcttccgctgtgcagaaaagaactctggactcagttcccagaaaaactagtgaaaattatttttttaatcatttttctttttttttttttttaattatactttaagtgctgggatacatgtgcagaacatgcaggtttgttacggaggtatacatgtgccgtggtagtttgctgtaaccatcaacccgtcatctacattaggtatttttcctaatgctatccctcccctagcccacaccctgacaggccccggtatgtgatgttcccctccctgtgtccatgtgttcttattgttcaactcccacttatgagtgagaacatgcagtgtttggttttctattggaatgatggtttccagcttcatccatgtccctgcaaaggacatgaactcatccttttttatggctgcatggtattccatggtgtatatgtgccacattttctttatccagtctgtcattggatgggcatttgggctggttccaagtctttactcttgtgaatagtgccgcaataaacatagtgtgcatgtgtctttatagtagaatgatttataatcctttgggtatatgcccagtaatgggattgctgggtcaaatggtatttctagttctagatccttgaggaatcaccacactgtattgtttcctgactttttaatgatcgccattctaactggtgtgagatggtatctcatggtggttttgattagcatttctctaatgaccagtgatgttgagctttttttcatgtttgttgactgcataaatgtcttcttttgagaagtgtctgttcatatccttcgcccactttttgatggggtggtttgtttcttctaaatttgtttaagttccttgtagattctggatattagccctttgtcaggtgggtagattgcaaaaattggttattttctctgctcctcaccctcctcccacccttaaccctcaagttggccccagtgtcttctttgtgtctgtgagttcttatcatctagctcccacttataagtgaaaacgtgtggtatttggttttctgtttctgtgttactttactaaggataatggcatccagctccatctatgttccaacaaaagatatggtctccttcttttcagtggctgcatagtattccatggtacatatgtaccacattttctttgtccagtctgtcattggtgggcatttaggttgattccatgtctttgctgttgtgagtagtgctgtatgtgtctttatggtagattgatgtatgttcctctgggtatatacctagtaatgagattgctgggtcaaatggtagttctatttttagctctttgaggaatccccacaccgcttcccacaatggtta

SEQ ID NO: 366 - DNA, 168955 bp, Homo sapiens
agatggggaaaaaacagagcagaaaaactggaaactctaaaaatcagagcgcctctcctcctccaaaggaacgcagctcctcaccagcaacggaacaaagctggacggagaatgactttgacgagttgagagaagaaggcttcagacgatcaaactactctgagctaaaggaggaagttcgaacccatggcaaagaaattaaaaaccttgaaaaaaaattaggtgaatggctaactagaataaccaatgcagagcagtccttaaaggacccgatggagctgaaaaccaaggcacgagaactacatgacgaattcacaagcctcagtagctgattcgatcaactggaagaaagggtatcagtgatggaagatgacatgaatgaaacgaagcgagaagagaagtttagagaaaaaagaattaaaagaaatgaacaaagcctccaagaaatatgggactatgtgaaaagactaaatctacgtctgattggtgtacctgaaagtgatggggagaatggaaccaagctggaaaacactctggggaagttctcctggataatatcctgcaatctagcaaggcaggccaacactcaaattcaggaaatacagagaacgccagaaagatactcctcgagaagagcaactccaagacacataattggcagattcaccaaagttgaaatgaaggaaaaaatgttaagggcagccagagagaaaagtcgggttacccacaaagggaagcccatcagactaacagctgatctcttggcagaaactctacaagccagaagagagtgggggccaatattcaacattctcaaagaaaagaattttcaaccagaatttcatatccagccaaactaagcttcataagtgaaggagaaacaaaatcctttacagacaagcaaatgctgagagattttgtcaccaccaggcctgccctaaaagagctcctgaagaaagcactaaacatggaaaaaacaaccggtaccagccactgcaaaaacaggccaaattgtaaagaccatcgaggctaggaagaaactgcatcaactaacgagcaaaataaccagctaacatcataatgacaggatcaaattcacatataacaatattaaccttaaatgtaaatgggctaaatgctccaattaaaagacacagagtggcaaattggataaacagtcaagacccatcagtgtgctgtattcaggaaacctatctcacgtgcagagacacacataggctcaaaattaagggatggaggaagatctaccaagcaaatgacaaacaaaaaaatgcaggagttgcaatcctagtctctgataaaacagactttaaaccaacaaagatcaaaagagacaaagaaagccgttacataatggtaaagggatcaactcaacaagaagagctaactatcctaaacatatatgcacccaatacaggagcacccagattcataaagcaagtccttagtgacctacaaagagacttagactcccacacaataataatgggagactttaacaccccactgtcaacattagacagatcaatgagacagaaagttaacaaggatatccaggaattgaactcagctctgcaccaagtggacctaacagacatctacagaactctccaccccaaatcaacagaatatacattcttttcagcaccacaccacacctattccaaaattgaccacataattggaagtaaagcactcctcagcaaatgtaaaagaacagaaattataacaaactgtctctcagaccacagtgcaatcaaactagaactcaggattaagaaattcactcaaaactgctcaactacatggaaactgaacaacctgctcctgaatgacgactgggtacataatgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaactagagaagcaagagcaaacacattcaaaagctagcagaaggcaagaagtaactaaaatcagagcagaactgaaggaaatagagacacaaaaaacccttcaaaaaaatcaatgaatccaggagctggttttttgaaaagatcaacaaaattgatagaccgctagcaagactaataaagaagaaaagagagaagaatcaaatagatgcaataaaaaatgataaaggggatatcaccactgatcccacagaaatacaaactaccatcagagaatactataaacacctctacgtgaataaactagaaaatctagaagaaatggataaattccttgacacatacactctcccaagactaaaccaggaagaagttgaatctctgaatagaccaataacaggctctgaaattgtggcaataatcaatagcttaccaaccaaaaatagtccaggaccagatggattcacagccgaattctaccagaggtacaaaggaggagctggtaccattccttctgaaactattccaatcaacacaaaaagagggaatcctccctaactcattttatgaggccagcatcatcctgatagcaaagcctggcagagacacaaccaaaaaagagaattttagaccaatatccttgatgaacattgatgcaaaaatcctcaataaaatattggcaaaccgaatccagcagcacatcaaaaagcttatccaccatgatcaagtgggcttcatcctgggatgcaaggctggttcaacatatgaaaatcaataaacgtaatccagcatataaacagaaccaaagacaaaaacgacatgattatctcaatagatgcagaaaaggcctttgacacaattcaacaacgccttcatgctaaaaactctcaataaattaggtactgaggggacgtatctcagaataataagagctatctgtgacaaacccacagccaatatcatactgaacggacaaaaactggaagcattccctttgaaaactggtacaagacagggatgccctctcaccactcctattcaacatagtgttggaagttctggccagggcaatcaggcaggagaaggaaataaagggtattcaattaggaaaacaggaagtcaaattgtccctgtttgcagatgacatgacggtatatctagaaaacctcatcgtctcagcccaaaatctccttaagctgataggcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactataaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaagaaactactttaaagttcatatggaaccaaaaaagagcccgcattgccaagtcaatcctaagccaaaagaacaaagctggaggcatcatgctacctgacttcaaaccatactacaaggctacagtaaccaaaacagcatggtactggtaccaaaacagagatatagaccaatggaacagaacagagccctcagaaataatgccgcatatctacaaccatctgatctttgacaaacctgacaaaaacaagcaatggggaaaggattccctatttaataaatggtgctgggaaaactggctagccatatgtagaaagctgaaactggatcccttccttacaccttatacaaaaattaattcaagatggattaaagatttacatgtttgacctaaaaccgtaaaaaccctagaagaaaacctaggcaataccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacagaatgggagaaaattttcgcaacctactcatctgacaaagggctaataaccagaatctacaatgaactcaaacaaatttacaagaaaaaaacaaacaaccccatcaaaaagtgggcaaaggatatgaacagacacttctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcggggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtgacacatatacaccatggaatactatgcagccataaaaaatgatgagttcatgtcctttgtagggacatggatgaaattggaaatcatcattctcagtaactatcgcaaggacaaaaaaccaaacacggcatattctcactcataggtgggaattgaacaatgagaacacatggacacaggaaggggaacatcacacaccagggactcttgtggggtaggggaggggggagggatagcattaggagatatacctaatgctaaatgatgatttaatgggtgcagcacaccaacatggcacatgtatacatatgtaacaaacctgtatgttgtgcacatgtaccctaaaacttaaaagaataataataatacaaaataaataaaaataaattgtacatcaagtaaaaaaattaaaaaactagagaagcaagagcgaacaaattcaaaagctagcagaagacaaaaaataactaagatcagagcagaaatgaaggagatagacacacgaaaaacccttcaaagaaccagagagtgactttcaattgaaggacagagccataccaaggtgaccttacagggaaacagctgggagagtaaatacctaatttcactcttccctgtctctgatctacagcccagctagaagccaggaggagcagacaccctgctgatggagcccaacaaggtcagcctcccatgtctgagagaagaatggattctggttctggaggagcagtcaaaagatatcggcaaaaactctgtcacagtattggccactttaaaaaatagatatattccatacttctgcagtgagatgggctgaaaatatatttgaagctgttatatgaaaagccacaaaacctttcctagctccagctccctggttgtagtttcatgactgtggttcatatgttttatttttaaattcccttttctattactgttttaaaatgtactttgtctaagatatgtattaaagggccatattttaggaaagtccataaggagaccttctttgagaaatgacatatccctttttctttaaccatcactctcatcccctctttggctatgacatttccattgttagcagttggtaggaaccaggccaaggatcacaaggagccaggaattgctgagctgactgaactgcctttattccccggctttggagcacctggatcaaccatacacatttactgctgcttctgatgatgtgtttttacactgaatgcatttttcatgttgtttgttaaagatatgcagggagagtaactcagatgattctaataacatgattatattgagataggactaagggagaattttggtgtttgcaaagaaattatttttaagttctctttttttttcctgtagaaagatgttgtgtccctcctggtgagcgctgtcccagtgcacccgataatggcgaagaaaatgtggtaaggcattatttcctttatcaaaccatatacagtataaaaatgcttctttaaaagggtaattgaagttctgactgattcacatatcatcaagcaagacttttatacagaaaaaaacagcagcaggggttgcaggataatatagcacgaaaaatataattaggcttttcccaatgtctataattaaacaggctctacttgcttaaatacatggttgttcttcttgtctcctattgttatttgtagagaagatctccaatggcattgtgcatatgagggtgagccaatgtacttattcttatgatagaagcatgaaacatgggattgtatacaagtggaaagaaacacaactataattcacttgcaaattatagtttgattgtatacttcctttttactgcattccttttagtatttatgtgttccattaatcagagtataaataagggccaggagtgtggtaaacttgttttttccactgttaaaaaccatgaaacagctagtagggagattaaaattaactgataagactcagacttattttataatggtctcatggatctttaatttcagatgcaagcaatagactaaagctttttgccgcccaccccaaaacactactatcaataaatatttaagatataaatggttattctgacttgaacaacagacatttagagtctatttttcttgcttctagcctctttcaggaaaagtataggaaatgagagaagactgtgacaactcatgacctgcatccttaatatccagtgacttcatctcccctttcttcaccacaattccaggcaatggcctgtcggagcagacaattctaccactgcaaagagttgtaaccattttctggtatcacatttatttttcaagacatacttttcaagacatcattcactgacccactacctgcattgagtataaatgcctggatgttaaggattccaatttaactttgaaaagaactgtctcattcatttacatttctgttacagtcagcccaggaggttacagtgagctctccactaagaatctggaagaaatgcatcactaggggttgattcccaatctgatcaactgataatgggtgagagagcaggtaagagccaaagtcaccttagtggaaaggttaaaaaccagagcctggaaaccaagatgattgatttgacaaggtattttagtctagttttatatgaacggttgtatcagggtaaccaactcgatttgggatgaatcttagggcaccaaagactaagacagtatctttaagattgctagggaaaagggccctatgtgtcaggcctctgagcccaagccaagcatcgcatcccctgtgatttgcacgtatacatccagatggcctaaagtaactgaagatccacaaaagaagtaaaaatagccttaactgatgacattccaccattgtgatttgttcctgccccaccctaactgatcaatgtactttgtaatctcccccacccttaagaaggtactttgtaatcttccccacccttaagaaggttctttgtaattctccccacccttgagaatgtactttgtgagatccaccctgcccacaaaacattgctcttaacttcaccgcctaacccaaaacctataagaactaatgataatccatcacccttcgctgactctcttttcggactcagcccacctgcacccaggtgaaataaacagctttattgctcacacaaagcctgtttggtggtctcttcacatggatgcacatgaaactatgaacataagaatctctgaagttaggttacacttgaccacacaaggcttgcatagttgagtgactagccatgaagataatttaaacaactcttctggctcaattggcatattgctaatcaatcttctaataaatttagattttcatataaatttttaagcaagagaagggagaactcagctaacctaatctgtttcccttaattttagtcatcaatttacataaaagaaacagtctaatgttaatgcttgtgaacttgtcactataaccaggcttttgtgtgacttagtagatcaaggtttcaactctataagagaaagcaaattctgaattgtggtgtaactgccacctggtccaattttatctgacctcagtttcacaatcctctccttgtatgtagttaactctgtttttgctacaatgttgtgatgggttatcacaaatagcaaagtattaagaattccagtcagaatgttaattattaaaaagtcaaacaatagatgctggcaaggctgtggagaaacaggaatgcctttacactcttggtgggaatgtaaattagttcaaccattgtggaagactgtgtggcgattcctcaaggatctagaaacagaaataccatttgaaccagcaatcccattactgggtatatacccaaaggattataaatcattctactataaagacacatgcacatgtatgtttattgcactatttacaatagtaaagacatggaaccaacccgaatacccatcaatggtagactggataaagaaaatgtgatacaaacaccatggaatactatgcagccatgaaaaggaatgagatcatgtcctttgcatggacatggatgaagctggaagccatcattatcagcaaactaacacaggaacagaaaaccaaaccacatgttctcactcataagtgggagctgaacaaggagaacacatggacacagggaggggaacaacacacaccagggcctgttgcagggtggggggcgggggagggaacctagaggacggttcaataggtacagcaaaccaccatggcacacatatacctatgtaacaaacctgcatgttctgcacgtgtatcccagaacttacttaaagtaaattttttttaaaaaaataaatataacttagatatcttttaaaaaaattccattgtgaagaaaaactccattgagataatatttgtctaccatctctgcttccccctagccttggttcctttttaaaaattgtgtcctagtgagagaacatgatacttaataacaaaactggatgcatccccaagctgaagttttactttactgagtatgtgcctggggtgtggagaaacaatagcatcctaacttcaggattggtaatatgacaacagcaaatttctaagaaaaggtttgggatatagagatgtttcctgaatataaacattggcttattaaaggataattccaaacattttttactgaagttttaaaaaattactattccaggaaaaaaaaaaaaccctagaaaagttccatgttaaatgtttcatgttgttttctcattgcgttaagaccgatggtaagaaggagcgactgctttggatacagcccgacacacatacctgctagttcactctgtggctgtgcatccctctccgccaaccacaaaactcaaatttggttcaccttgctcaaaatggtaccctgatttttcaagagcatccactttgatctgtctgagccaaccctgacaattgcagtcctcttgccactagactggttcagcataagcagataaagaaatctgctcactagggtatgaggaaaattattccagaggtctgtttctgggaaagtgtttctccattttaagaagagacaggttatcgtatggggagaaaatgctcaggactgctgaagtcctcttacggcgacaagagattccgacaagaatgaacctgggtcctctgataccactgagtccctgaattaatcgtcaagctacccatatgagtcagggttggatcagggaggcagaatcagagaatgacagaataaagatttattatagagcttcagccttacacaattgtgggtgctggtggagaagtctaggccaggctgttccctctgcatctggttctgggcctgaagtcactgtaggtcgactgtgaatgcagcaaggatgaagggaagtccataagaacaaacagaacccatgtctgtctcacggcctccactgcaatgctgtgtgtgatctcaggaaaagctgatgctggttgccatggagctgcacacacacctggccagtactttgcaaagctgaaggaggaggctggcaggagctggaagagctctgggtccagggagctgtctctggtctcttctagctcccctttttggcctggagtcatattttcaagctgtcaccatgcttgggtctgtacactgaccttatgagtataaaatagctgctgatcaaattaatgcaaatttctttatgacctactccaatccagaaccatgagagagaggaattccgggacatgttcctccagctgagccaaatcggtactgcacaaatccagcatattacctgtcactgaatgtctcgtgtggggttacctccatgtttaaagcatgtaccagcatatagcctacatgtgtgttgattaggagagttttgcctacatgttcaaattgcctaactatagctatatttatatcacaatgctgaggagatcttatgacttccattctaccactgctggctcacaatatacattcatagatttaggggtgaatcaagccaaagttgcctaactttagtaaaaaccattcaccaacatgccctagtccccatgaagcgtgactggtctaaggacatcttctatgagtcctacccattaagaggaaatatggacaaaggatcaagtatttattcattttttaaacatcagaattgaaaaggttcttccatttatttaatctgtcatgtgaagcattagaaggtagtttacttgcatttgaggatcaaaaaatccccattaactgtggaagcaatgatattccctttaattatttttctaattgccttgtttatatggtgtgaaaagcaatttaaacatgtttttaaaaatgtttccatgcaacctaagtttttggccatgaaacagcaccttccttgtacttctccagctgttgtcctttcaaagcaggggatgctattcttcttgaacctgaaaaacagaatgtcagtgtgttctgtgaatttcctgtgattttcaccagtggaacacatgtccagaaccaagctgagtcccttccagaggtaagcaggccttagccaactcttcattaacttcaaagggaggcagggaattgaggcaattatctgcattacagaaagcagaccctggtaattcaccccaagggcatgctcggtcactctcaattttctgcctgccttgtcttgccaatgaaggcagcgcccccctttgccaaccccataaggagaaagattctgcagccacatcaccagtttgctccccagccctgacacagaattctatcagcaaacctcttccttgtgcatatgacagttgaggattttttggcttttcttctgtgaaggggaaacaattagtcattgcactgccaaggaaggttttcctattcctctctggcctctcaaaagcaatttctacttcactcactctgttctttgttgaaaataactgtgacaaagtcgaatgcatggcatctgttttgaaggcccttcaacctcctgcagctgaatgcaattgcagcacatgggaagcacctccctaaacaagtcattacatggggttgctggtgggctctgcagagaagaccctaaatccagtgccacaacacttctcaaattgaggccaaagttcaaaccacttaattgcccctctcgcataggacttatccttgaggcagctattcaggcatcagtaaaaaatttctggagtctctcaatgattcatatttcttatatttagatctaagtatattcaatataaccaactcttaggctctccttcaaaagagatgcttttgacctcccttaaggtagtatttatgcatattattggcaaccctatcaacttaccttgcagggttactagtaattcagttagggcctggattcatttgtataaaataatcaggagtccatggaacaaagatgattttaaaaagcacagatggatcggctcaaaatttggagtgaactctttccatagtagacacatgtgtgactttttaccatgtcaatatggagtccaagagggaagacgtttaagattgaggcagtgaaggaaaacaaatgcaagagtcttgctttgtagttctctgctttatattcctgattctgcccgaaaacacagagaaagagggctggtgatgcaccacgtttaaaaaaaaaataataataatgaaatgatggtgcctaactatgccagaagctatgctcagtgatttcaggcaatctattagctaataccacattatccaatctcctttgattcctttcgcctaaagccagacctcgtttaaaaactgtgtgttcctgggaaaatttcaacaaggaagccaagactacctgaccctaccaaacatttagtacattgttctttgtcactctaccagtaaaatcagggcaatggcctctaccattagattagaagagccattttgtggaccaaagagacatagaaagatcctttctctgtgtttttgggcagaatcaggaatataaagcagagaactacaaagcaagactctggtatttgttttccttcactgcctcaattttaaacatcttccctcttggactccaaattgatatggtacaaagtcacgtatgtgtctactgtggaaagagttcattctgaattttgagccgatccatctgtgctttttaaaatcaactttgttccatggactcctgactactttacactaatgaatccaggccctaaatcttagatcctgcaagttaacatggaagtaagcatttgaaaagtataaatacaatgtgcatgtcactcaaatgcttagcatttcatctaccaggacaagtataatttagcaaacatgggaagattttattggaaccctttgttcttatcttttaaaagcttttaaggagaaaaacaaatttcttgttatactggtccatgcaatgacatcagccctaaacaaacatgattaaagagttagaacagagttgaatatctgccatacctttttcccaaactctcttgctttaattttgagtttattgacttgagattctgccacctctgccctttccttcacttcattcaactcatgttgctgtttcttatacttggaaaggtattgattggcttgtgtttcctataaaaataaaaaaaaaaaaaaagaaatctccatgcctatatagtcaggtgttttttttttctgctctgacatgagaaagttgaataatgtgaaaagaatctaaacttctgagtattgaatgggatatcatattttggtatgatatattaggattcagactttctagcaggtataagatccatttttttataacttttgttccttggaaattcagaacctagttggcacttttcatcaactggatgcagtaaagctctcacagactgaaaatgtgctagaataaccacagttgtctattttgtcatgagtttaacatcctattctacccctgggtagagggggcttgtctttaaaattatatgggtcaacaggtaattattagaccttgggctagaacaggtagtgttttaggccaaatcattgaaataatcaaaacccctcaagagttaatattagggataaatcaatatatatgacacttatcaattacattccctgtagttatagatactgacccagggatggcaagtacatttcaatttatggtggttttgtccacaaccatatccaggatcatcaagaacaaatactgtgaaccatgtttatgtttacccaaggttttgggatgagggaggccccagggtgactaccttgcccaaaactggccttccctacgtgacactctgcttttacctatctcatttcttgttgtgtacctgtttgggtgcaaccacaaaggtaaaggagagagctctggcttcctggagggaaaagccacgcacatttttgccatgggtgagaattctaacttgagaaaaaaaactgaggatgagcagactctaagctgagcaggtcctctctgacaagctgcttgctgagctcagggtcacagatctcccttaatcaaaacaacactgggaaatccatgaggctgaaacttccccaggcactcaccgccacctcgacttgctgcttgtaattttgcacttttagctgaagtttatccatctgagtttgcatcctgctcagattcttcttgtcttcctctgcctgcaatacataggcatgtatgggaaggtgattcagaggatccagcagtctacgttggtgtagtctcatgtggggaaataaggatcagggaactttattaaacatcatctcagagttgtgattttaacaatgggtttaactcacccaagttccaagaaattgataaatagaactgtcagtactaacagtcatttgtcctgatccatcaacctttgctgaaatgggagttaaacccattaggttcagtttgggtcttcagtctttccagctcaaccaagctatatctgcctgaagctatatctgtatacttaaaattagtagtgaattatctactgttatattttactttaaggtggtggtagtgggggtgcattcagatgacgaaaacagcaatagctttagctatagctaaataaaaagctgtatctttatttagcaggaatgaagtgcattattataaaagccacatatgcaaaactgaaaaccaattgctccccaatcaaaacaactattcctttgaactttctaattgactcttggttttgagtaatagaactatagaaaagataaattttctggaattctgatgcggagatagcaaggaagattctacaagctgtggggaccatggtgtgcccattctcattgcctcaattacaatccagcctcgggctgaagaaaggaaatctggtgggataatgtttctcaactgtgctctgcagagcctttggtattccagagagagaggaggctagaggcaggcaggtagataggggtctgcctgccccctctttcctcatgcccctttaactggaatatttccatattggagctattgtacttttcaaaggaagaaaatatctcaatttgctcagggttgagaagctgatttaatcaagaaagatctactactgcttaaaattgttttctggctccatttgacctattccatcaagtatgaacttttttggcagctttaatgttccccctacttaccttccattccccccaccaccacgaacccactccaaccaggtcacattctcctgtttccccagagctcccctgctcactctgtcctccttaggtttagccaagctattctcatcatctggaatgctcccccgccacacacaccaccaccttaaagtaccatgtaaaagtagatattaataattactaattttaaccatcaggaggcagggatgaatatatatgaaagaacctagttggggaactgagacaagtctggttcaaataaaatcccttctttgtttttatctgcctatccctcaacttgtcaggtttataaaattcaaaagactcatagcattatgtgcttacagtaaattataaaatcaacacaggtttaattgctaataatcagtttactgagaagagagtaaattggtcataaaggaggccacacagaagaaaactgaaaaaagctagaagtggttgctgatgttactgatgtccctcccacatgggaaggcaaagccattgatgttaggcctaggttcccatctcagctctagggcattgagtaactggtgaccatgactatgcacgtcctagatttcctatcaagaaaagaacttgacattcagctgtgagaagtgcagttacctgataacctccaactgcagtgcctttgggacccgccacagcattagcattgaggccacacacttcccaggcagcccccaggcaatagctgggcatagtgaagtcactagtgtctggccatttctgcccaacatgggagtcctttctgggcaatctttgtgctggagacttgcccagagctgcactatagtctgacgctcttcccttctcctcttcctccctcagcctctcccttcacgtctctgccccatcctgcttgcttgcatcttcatccttcatagatgttacttctaatagatctcttgtacatctaactctatcctggcatttggttcctagagaaccctctcaacacagcaacttaaccaaattgtatttccttatccctaaaaatgatactacattcttgactagatgtgtaaagattaaataatatctatacagattcctggatgtaggaggcagttgatggtagaaccgagtagatgggtggagagtgaggggcagaggaactatcttgaccttctatagcagttacaagtacctaatcttatgttctgctttatagcacatttttctaggtgctggagagagaaaataggacaagtttccaaatgctaaggggatataaaggagaagataaatgcagcatggggaccagccatagaactgtcatggagtgggaccacacttgactcctttccagtagcagaatcttcccagaggacttttcctaagaaaatgatatttgtgtccctttcaaaatgacatttttaattgcacctaggaatgggctatcaccaaacaccctgcctccttgtcctggtggttattttgatgattgagatgactcagcgttaaccttgaacacttcaaaaccaagtaccaggaaatgtggagtgtcctctaatgtctttttaaacttacagggtctagcctaatgatattagctgatttgatggcagaaaataggcctatctaagcattctgcagacacttggaagaaattaataaatgtacctcattctagtacatgagaaacactaggattattacaatgaagaaacaaaggtaagacacgatagaacaagaatgcattccttgggacaatgaaaaccaaaaaaatatataactttggttttttgttccataatgaagttgtttacagaataaaacaataagaagaatcaatgggaaaataaaaaggaaaatccagacattaaagcagcatttcatgtcatcaacatgggtggcttctccaccttcctcaaagtagaatagcaaacttttaagttcccaaggtgtttacctacttagccacacataccatgggcccacttctcagtggctttgatatacctagcatggtctaaagaagtgtcagactaactcatcttacaaaaggaaccgcttaataataaaagagctgtgcaagtagcttgtttcatcttaattagcccaagatgatgcttctgaagtgctgtgctttcttatctatccttcctgctgcaagggaagaagactttgacatctttaacaactcagcctcaggaaccagaatcaggagtagcagatcttgcattggcattgtcaaagaagctgtaaaaatgggtgcctaaaataaatttgcctttgtattggaataagctgtcatgtgcaatgtgagagggctgggataagctatcatgtgcagtgtgagatagcttactgtccagtgtgagatagctggaacaagctatcatgtgcagtgtgagagggctggaaagtgacttttagcatctgtgttcaacagtggaaatcacacatctactgtgtgataggaggatgccagaccctggaggggagaaaaatacagtgcctctgccatcagagaatctatgttgactgcattagaaggaaaagggaagcaatggttgaaagtgaaaatgtagatgatgatatttttactttagaaatgcattagtcacttgtaagaagtctgcccacctcttttcaattattgcttgagaccaatgttagtcaacaggttagattcagaaagcttcagaggtctctctttagtattttgtttccacctggcaccagcaacagtgtcctcagtggccttgagtgtttgcgcaaccagaaaataggagtggaaatgccccccgctgcaattgaatcagcatcccatgtaacctgccagctgggtagccaccccgagcctctgccattaacttcatttacacattgttctcactcagccactcacaggaaggcatctttatgaaagcactgcaaacactatgtgtgaaaaaatccagatggtataaatagcttttcacttctaattgcaacttgcccctcacattttgtttcctgagagctctgaaaagagaccgatccaaaccactaatagcacaggagctctgggagggtgagtcagtgtctactgctgaaggagaacaaagatgaagagagaacggcaggagtcccagaaggccatttcaggcttgaaggagtacttttctgcagggtagtgcccagccagacaaacagggaatggtttcctggagtacctgataggtcagctctttgatgcatcgctcaagtctgcgggctcccctctgggcctctgcactgcgacggatttcaccctccagttcaccttccagttcacgaacctgcaaccaaaacgtgacctcagaccagacgctgccaccaagtctggcattctatttgctgattggcacaatcatttgaaagacagcaaagtgtcaagggaacatgcacacactgtttttggtgcttaaacaggacagtgtctctgggaaaactctctcgccaaaagtaagatcttttatggattcataaaagaactatttagactgaaatatgtgaaaggctaattcacacagatatgagaagcttttttcttgaattacaaaaccacacccaaagtgtatgtatgaatgtatatgtaagtatagagagtaagcaatgtgtagcccatttgaggatttggtcaacatactacctaatcttaagctgctttccctatgttcagctctgactctctaaagaaatcagatgctgagtttatgtcacatgtatgtcacccacaaccctccagtcctgcttgagctgcctgctgccttatagagttacacaaatgagcttaacattcattcaatgcaggtgcctgctacataccacaccccagtgctagcaatacagcagtgaacaaaacaaacaaaaatctcttccctgaattagcatacgttctaatgaggggaagcagacagacaaaacaaagtaaaatgtaggctatgttgatggagataagtgccatagagagaaataaggcaggagagggagtagggagttgatgttggctgctccccctgcctagggggctcttacccagatatcctcttttcctgccttctccttgacgccaatgccaccttctccaaggggccttcttgagaacgggaaggccagtgccctgaggcaagaatgtgcctagcacatctgaccccacctcttactccccactggagccattcttccctcctgtacctcctcagagaggtgcaacgtgaagggaggggagcaagtgtgagacttccttgtggataaagcccatttaaagcaatcttctgacacctgctatataggaacctgacacacagttctgtctgtcgggatgtgagctcttacaggcccctctactttttttaagcactccttaagaattttggggggggattaaagtgattaaaacaccttggggaaaaactgctctactaaagcaaatcctagacattatgtaattccacctgtaaatactattggatatcattctaataggtaatgatggtatcatggttgtgtctttaagaatattaaccataattccttagtattatctgatattaaggagttcattgctggtcgttgctactgagttatcactggttctaggccataatagtgaacaaacagcaattggaaataaaacctggcaatcttaaaactgagttggaaaaaccagtttcatgtattttttaggggaaaaatgcatacttttaaattttatacctatatgccgtttctcttataccaaaaatcttggttcttatatatgtcattggataaacttactgctaatagcaattaaatgttggtattttgaagttataaatgcatggtttttgccattcttttgttattttgtccttatattgagggatgtatggacaaaacattatgtttaaaagtcactgagaataattcttacttgtgtatgtttaatgcccccaatttaatatatcattaacttcatttgcttccattggtgttaaaattttagagactgctgagtttttttctttgacttaaacttgtttttttaattataaagtatgcaaatgatttatatgattttccaatcaaaacaactaaacaaggtacattaggagggtccaactgtcatctctgtgttatcctctcatagatagccatttttatttttctgatttatcctgttaccatttcattttgaaaatataagcaaatgtgtacaccttcatattctcccactttcttgaacaaaagggtatatacgctttccacattgccctcactgtatgactgtatggaggtacccgaaatggacatgggtattccattgtatggatataccataaacatgcaaaggtgataccttattttttagaggcccttttgaacaattgaatcctagttgaatattctttccattcttgtagcatttatcatatgccttgtctgtagtcattaaaattgattcaataattttacaaatcttattttcaagatgctattactcatttttaagctccctgaaggcagatactacatcatttctgtcagtccttactgtatcttctctaagtctttcttgatcattgatttagttgttttctctctcctttctctggctgtcagaaaatgggcattctctgcagaggaattaacgggagaaaaggcacagaaacaagactgccaggggtgtgtttggaaacaccaggtagccttggagtgagagcctggagctggtgaggtgagcaagaagggctgcaatgttagttagcaagagggaaggcagatttcatccagtccaaggaaagtcctatgtgctcacccaaagtcaagcaaagaatgaatgcatatattgagatctgacactcttaaatatctgaaagtactaaaagcaaaagtgataaagggtatgtgtgttggggggcagatctagtgtcacattccaggacaaagaggtcttgaattggggactgtcaagccctcatgattacccagactcctaccctggattctagtttctggatttgctttctactccccatcagggccatctgttcagcttcagccagccttttctgtaagtctgtaattgtctgctccatattttctcttgtcctttccaagtgggcaatggtgtcttgcttcttcttcagttcttctgacaagtttgctgcctagggggttaaaaaaagggactgagctagttcagcagtcaattgatcttaacatttttacccatgatctttagttcctggtctgactggctgccacgccttgcctctatgtatgtgatctcttcccattataatctccctaaccactaccaccctcgagtttgttaacagtaaggcaatagagacagcagtagctacaggagagaacagggtaaggagtggtggaaacagactaaagatgaagaaacatatgaacattattatgcaacacctgtattaaaataaagatgaccaactgaagcaatggcttttaattgaataaagcactgggatgactgattattgaataaagtaaccggtgtcacattaatgcaccaggaaagatatggagaagtgcctacaaaaatcttttcacatctcacttctataattctgtgattcactacacaaacaagtttggctccaggaatttggcagtaacagatgctctcactgccaataatctggcaagaaaaaggttaattgtgaagcctgctcttggctttggctgtgtgtacaagggcttggtgtctcaatgcaatcattaagaactgttttgagaatctctaggtacatttaatgtaagaacatggccctcacagcccaagcttttctgtctatcaggttaccaaccatctgcagaatttaagtgtgagacttctatgcagatggtgagggcaaagaatgaattacattctgtgatgtggggttgggactcagagctaaactgtgggaggcttggaggctggggtcagagatgagttcacttttcaacactgtcaagaaaatcttatcaaggcaagattaagcagagagcatcttcataatatatgattgcatatgtttatcaaacaggagcagctatttttattcctttctacctgtgtggattttcataaatgttacacatatttgttcccttggccatcaaacatcttcaagatttcacacacctcgttttcctcagagatcagaatatccgccttgatacaaaagggatgagtgaataggcatggttgcccattcttagagggggctggattctacaatgattaggtggttgggatttggtgcaatggttttgtttagttccccaagtgttaaataacttgagcaaatatagatacaagctcttcacctcctttgaattttaaagtgactaatgtaaaatataatcaaatgtcctgtctcctagtttagcaggggaatctgcttcccttcatgtgggaggatcagggctgttgcatgtggctgtgcatttgatgggctgcacaaaagctcttgatggagaaggggtgagcagagacagaaaccaaccccaagccccactctgcaagctctgggaccttcaaagctgaatctgccacacacaaacctccccctccactaacatatttttcccagtggtaccttccgctaaccatgcccgctgagagaagtgctgcatctgcccacagggggtgcccagagggtggccttttttcagtccctatgaaggtgcgccaaagctggcagccaactctgagctcaacatcatttaggaaaatcactgccatcatcaactggaaaataaagaaagtacagcagccctgaaacccttttttaccaacctgattttgctcttcaagcagtagtacaggttgtaaaaaaaataagtgaattaaacattctttccaaatcatcatcataaaactgttatagaccctaggaaaaatagctttttgtaaggaaacacagaaagaattgtttctagacactagatgtattgattcacaaatgaaaagtggcttaaccaaaacaaaagaagactcctgcttttataaggttttgcttatagcaattcaactgctccttttcatcaccagggtatgttggtgggaggagctaattggcctaatttttcaagatgagaacagggaggcagagaggtcagactaacctccccctggctgtatgggaaatcaatggaatactttttggctgcagatgtggccctgccccttggccactgcgccagtgaactctgggagacaggattgagtacgtggtcaagggacccacctcaatggctgccttcttggccttctcttctgcattttgacactcctgcaccacctcttcagcttctttctgcatccgggcaacatcagcctccagtttcttcttctggctgaggaggcttgtgttctaaagaaaagcagcattcctattaggcaagtaaaaaccagcaatgcaaatgcaagctggtctgttcaggacatgcaatgggagtcagctctggccagaagcaaattttattatagtgagccatagtcccttaagcagtgctcccaatcccgaaaggcttttgccatcaaacttgaatggaagggatttcacccattagaagttcaagactaaagagatggcagcctgaatcagaagggaagaagggtatctagataacctacaagccccaaacgtgtttggttttcaatgggttgaggaaatgtttctctgccacttgcttttggatgtggtagaaacaagtgttctagagcagaagttggggtcagttgcagacatctgaggagcagaggttggggaataaaaattgtaactccaagtatgctgctccagaaacaaacaaaaaaaatcattcctcttctttttgtacttcccttcctatcttactttacagtgaggaggtggggaaagtagttcagaataagcctcctccagcccttaggtaccctcattaccacggaggattctttgtgttctgtggttggtgctgccctaattctttccttcctgagttgtgacactagaggccaaatatccttttgctgctatttggtctgtgtttgaagcccagcttttctgagggtgtgaaaactcgcagtgtatataaaaggcataggctttctatttttttatttctcctttcactttatccgtttcacattcacttgcctctggctagtgcctttctcagtagcaggatgaagacttggaaatagaaggatactccaggccaggtgtggtggcccatgcctgtaatcctagcactttgggaggctgacgggggtgaatctcctgagctcaggagtttgagaccagcctgggcaacatggtgaaaccccgtctctaccaaaacttttaccaaaaatagttgggtgtggtggcatacagctgtggtcccagttattcgggaggctgaggtgagaggattgcttgagcctgggaggcgggggttgcagtgaaccgagattgcaccattgcactccaacctgagtgacagagtgagactccgtctcaaaaaagaaaaataaaaaatagaatgatattccagcatcactggttctatctaccccatttctctatggcatgaagcatctttatcaagactgccatcttttgtccttatggaaagccaggccctgtatacctcctagatttccactgccatggcctgagagatggggtggaattaagttgtattttcctgaagtgttttttggatgctcacagcacagactccatagaaactatttctttgtagaggaaggtataagtacaaatactaatttgtttgtacatagaatcctttaaaatttgctagggagacaagggtttaaatctttgcaaactgaattactctctaatttgttttttttttctttctttttttttttttttaggagaaagggagttaggaagtgctttgcagaaaggtaatctagattgtcacagctcaagtttgaaaaagacacctgtaatcagtcaaagataagtttagcctcaaatgttagtcctaggctggagatctggaaatgcaggaggtagctaagaaggctccctaaaaggttcagtatgttttgcttgataatgttctagtaactgcaaggtgccgcagcatggtttaggttggggagaggtccttgtgaataatatcacctagaccagtgctggtcaaagggtagtctttctatgagcagtagcacctgagaacatgttcactttctaggtcccattgcagagcttctgatttagtggatctggggtgagatctgagaatttacatttttgtgttagggattcttatatgtacacatcaagtttcagaaactctgccctagagaccaggtctcctctacctaattttcttcttccccaaatcctctcctctctatgaatgctttttctctagctgatcctcatctctctctaggctagtgattttgcatcatattggatcccactggtgcattatcatgtatgatatgcatggcaaatgatttgttaccaacagcaattaagtactatagaccagcggtccccaacccatttggtttcatggaagaaaatttttccatagaccaggtagcagggttggggggagacggtttggggatgaaactgttccacctcagattatgaggcattagattctcctaaggagcatgcaacctacatctctcacatgagcagttcataagagcatttgcactcctatgagaatctagtgctgctgctgatctgacaggaggcaaagctctctcccctgcagctcacctcctgctgtgcagcccagttcctaataggccccagacctgtactggtctgtggcccagggattgggaaaccttgttctagacagtggatgagttacttttttaaaaaaagtctgtagtctattttataagaatccaactcattgtatttaaactttcttgaaggagaaaaaaaaaatgtttgagttagcctgttgggaattatctataacctacagactatttgttctataccacatggtacccagacgggattgtgtcatacacatggacacaaaagtcaaactgtaggcacaaactaattacaacatctttcaacaggcacatttctggtttatactttcttttatccagtatttttcagtagggggaacattggcattctggaaggggcagttccttgggattatccttcaccttgaaggagttttggtatctctggaccctactcactaaatgccagtggtatttcccagtcactgtggcaactaaaatgatcccacagatgtttctaaatgccccagagtgtagcagttctgcccctaggtgctttaatctgtccttcacaataatcaccacagtaaaacttcctaaaatgcaaatctgataacttcactcttagctactcaaaattcttcagtggctctccatgagctgcaagataaaattcaaactccatcactctcaggctcagggtcactggtgacctggccccacctatctcagcatgatttctgatccttctggctatccaccgaatactctagcatgtgaatttcccttagaatcctaaactccttccccctgcccccatgtctctgcccttgactttcctctctacctggctggcttcttacatgtccttcatgactcagaagaagcatactgtgcagctacctaactcttggattgtcaaagaaggctttctgtaggggtgtgcttgctatatcattatacttttagcagtgtactacaattgcttagttcaatcttcatttttttaggacagtggagacattctgtgtctataccatccataccagtccaggttatggtgggggtgccctataaacacttatcacacaacccatttactatagatgtttgtcctagaaactatggcttcttctgattctaggataaggagaaggatctaagaattcttgcttcgtgtcacttacataaccttccattagaagccagagtccagacggtgtatcatatttgtcagcagccactcagaattgttagggctttcctggctccaagacaggagcattgtttttatcctgggatgctggggaagcacatggcttagagagagcaggagaaccaggagcaggagtggttctggaacattagggaatgttcatccctccctccccagcatcctggctgtggatgccctgacaatccattcttctggcataaggcttattgttatgggttgaattttgtctcacacacacacaaaaagatatgttgaagtcctaaccccttatttatcagaatgtgaccttatctggaaatagggtcttattttgtttaaaaggaagctggaaaaaagggaggtagggggtaaatgagttaaaatgaggccattagggtggaccttaatcaaatatgactggtacccctataaaaagtggcaatttggacagcaacagaccctcgcagcgggaagatgctgtgaagacacaggaagaacaccatgtgaaggcggaaggttagagtgatgcatccataagccaaggaatggcaaagattgccggtaagccaccagaaactaggaaggggcaaggaaggatttccctacaggtttcagagggagcatggcccagctgacactttgattgcaggcttccaacctccaggaatgcgagaaaataaacttccgttgctttacgccaccctgtttgtggtactttgttatggcggcctgagggaaataacacacttgggaacaaatgaagagtatgaacatgccttgcttcacaggcacatccaagacttaacagggcgactgtgcatggtccaaggccgccccaagtgtgggaaccactgccttcaaccaactggcccagctaatagggagagtatatgggccccacctgggtatagaaaagattgattctttctgttgcttccaggagctcttcttctgacagcctgcggccacgctctgtctgctcttgcagggaccttagatcctctagttcagactgaagaagagagttgcgccgctcagccacagccacctgctccttcagatcactgttcagttgtgtgctgtcatccagctgcatttgaaggtcctgggagagaaaagatgggtctggagtacagatccctctgagttcaacatagactatgcacctacacatgcatgatctgactatatatttagacataagcatgctccttctctctggaaagattagatttgttgtcctcatctttactgctgaacacaatctgttgcttagtttgcttccataagcagaaacattttccacccctccctaccccatcttacagttttaaaataccttgatttgaatctgaagctggcccagggatttggttgcttctgacacctgccggttggcacagctaagctggagttccatctcattgaggtcctcttccatcttcttcttcagccgggtaacctcaattctgctcttagcttcagaatccagactagactgcagggagtcaatggtacactgctgcttcctcctaatttgaaataacatttggagtgggggaaatgacacatccaaattaatcaaattcacctgctatgtttaaaacagtacaagaaacagaaaaagaataaaatccaagataaattttaagtaactaacaaaatgagtctaagtgcttttattttaaaaacagagagaatgagaagttaggttagtgagtatatgtccaccataatggactacgtagggtttccagaccaacttccctgaagaattcaggaaaatacaagaagcttttcaaggtcctgtgaggcagctttagtcttatctgatatcccataaaggatgacctagggcaagcacctgggtttcctgtggtggctaaggatgaaggaaggatgctctttcagacagccgtaatatttcaactactttcaatgatgaaaaatgtctgaacaaggcaggaaaaagccactcaggttggaacaattcttgagatgcagcaatactgctatagtagcctggagacacaactctcctagaataaaatggttatctttctctaggagtttgagagtacacccaaggattggctgagacaaccaattgtgtgatattgaattactttaacactttaaattccttcctaagaaaaaaaactagaactaaaaacgtatttgcaaagtgacagaagacaatagctatgtgtttaggaaggccataaaaaataaaaaattgggagaatccatgggaatttgtatttcccaaactgtttgtagttagtttgggactatgtgactagattctggtaaatgcactgtggagaataatgaagtttaccattccagggctggcccatagaaatgttcacttgtgagatcctgcactctcccttccccctttctaccaaacttgatggccacatacagaaggtcatggagtcacaagatggaaagaacctgggtctttcaatgactttgaatgttattgaccgactcttcatcctacctcacaatggcctcaaacataggcaaaaataaacttctatttgttttaagtcaccaagatttggtgattgttaggacagtttaactgctgtaattgacacatgacctgttaagctcaattcatgaaacagggacctggtgctggacagataatagagaacagagaaggcaaaaacctttctattcttctttctcatagagcctatctccacaaatcagattagatcagaattagattccatgttgaattgtcatcaagccagtgtcctaagctctgtgaggtcgattaagaaggcatacaggccgggcgcagtggctcacacctgtaatcccagcactttgggaggccgaggtgggcagatcgagaccagcctggccaacacggtgaaatcccatccctactaaaaatacaaatattagccaggcgtggtggcatgtgtctgtagtcccagctacttgggaggctgaggcaggagaatcacttgaacccagaaggcagaggttgcagtgagccaagtttgcaccactgcactccagcctgggcaacaaagcgagactcttgtctcaaaaaaagaaaaaaagaaggcatacggcctacagggggaagagagaggtcagagcttgaaattggttgacaggtggaggtgctacttttcgtgacccccattctgcccactggtgagggaggcctcagaagcaattatggaaatgtatagaaaataactctgtctggctccagagcccaatgtgagcacctatcctctgccaaccccatctccctggtcctcacaagctgaggttggtatctcatgcctgtccttaggctctgggcttttgtccagcttccagatcagaatcctgtagggatcccactaggtaaagttaatatggacttttaggaactgcattatgtccccaccaaaatttacacgttcttgccgtaacccccaagacttcagaatatgactatatttggagatagggcctttaaagatgtaattaagattaaatgaggctgttaggatggggccctaatccaatgggactagttagcatccttataagaagaggaagagacacagggatgcatgtgcgcagaggaaagcacagatgaggatgcagtgaaaatgtgaccgtctgcaagccaaggaggatcatcaggagaaaccaaacctgccaacactttgatcttgaagctttagtctccagagctgtaaggaaatacatttctgctgttgaagccacccatctgtgcattttgttatgacagccatagtaaaccaatacagggatgctcacactcacatcaccaaaatctgtcagacacttatctgtcctacattgggaaactctcatttttgccacagctggctctccttacacaggaacactgaagcatccccagcctggtgtcaaaatcctctgtacagaaatacattctacttaagcagacaaactgcatgtttcaaactgcacttttcccacagttgtttatgaaacttcatgagtgcctgcagacaagtaaaaagtgagatggtttaaaaggcatgggtataatacagtcctgtagaatggctgctgaacaatcaacatgtttcatacagagtcaagaaatctttaaaatgaaaactccctcaagtacattctttaagaaacatgatgcattcaggaccaagggcaatataggaagaagtaccttctttttcctaaaatgtgaaatacaatttaaaaaacaaatgcaaagaaaaatcaagatgatagaacttggaagagctaatgatttaaaatcattagctcagcatttaaatcattgacaatgcagtaggtcatttatttcccttacgatattgctaatctatgtatgagaaataagagatttttttttcttaatccaaatacatatgagccagctttaaaataattaacaagctattttgctaccatgtctgagtttgaggttctaattttcaaagacactcgaaaatattttacttagaagtgagaaaagatttgagcatattctggcagagattcactcagacaataaaagaaaccaagtcagatggtgtatataaattaagaccacgtggcaaagtttgacatgactgagttcagaggagtggactttacagaaggaacattactatatacctggggctgtagaccagggttgggaaaactatgggctgtgggccaaatcccaccatgcccatttatttcctattgtctatggctgtttccaacctacaactacagtgttaagtagttgccacatctctgtggcaaacaaaacatgtagctagcaaagcatttaacatctgaccctttagagaaaaagcttgcctagcctttcaatcagtgatcaacccaaaacaaacaagcacagtatgatagaataaagaagttcagtgcctcattcccaaaaacacctctctgggtgtgtctgggagagcagaatacagctcagaaagaccatggctgtggaccagtgtgatgactctcacatttcaacatttcctccaatcagagaattccctgaagatgcaggatgcacctgaccaacctgttgtcagctcagtcttgggccatgcagtagggcttgactaacatggcaattatggcaatgatttggccttcaagctagccttgtttcctgtctaataagatgggaagatcaaagccagctaccagctcttcttctccttccatcagtgactgcaccgtcacctccctacctctacctgtgtcaactataacattatttatttattatagaaataaatggaataccctatcatccaaaaatgtctatgaagccctgactagaatatgaggcacagtgtctggtgaacattaagcactccaatatctgttgaacaagtgaaacatatcacatacataccagctgcttgtacttttcacccccaacaggcctccaggctgggctcattcagaatcaggcctcaccagagtggaagacatggcttggcagcagagaattagttgaatgagttacccagtttgctgtactatcaaggttttgcctttgcctgtgggtctctttctcttgctttcctggtccctttaacttacttaccaggtcctgtcttcctgggcaccttctgtttctgtggagttaatgatgggttatatgggcataggaccttgaacctgatcttgccctcaggcaatattttccttgttctataacttccctggcttatcgttgattgcttggaatcttgtgtttggctttttttttttttttttcctcctggcattctattcagtttccttaagatgcccttgctagccccaaagtgaaactatcagattaaaccttggcagtttggtacaatctgtgctcagagcagaaagggtctgggctggtatttgtgatattttgtaagataagctcatcttttctttctggatctacctattatagttattatgaatcattaactaaaatttatgaatagctcacccccctgcctccagtccaccccttcttttctcagctcctcatggctcatgcttatccttcagttctttcttcttccagccctagctctttggatctctggctttttttcgcactaagattattataattggtgaactgctctacgacattcagatgtagctgacgagacacaggctctctgaggattcatttctcctcagctgggtttatttataggcacaggtctgatattacttgaaatcagtgttatttgttgctttttttttttttatctgcacaaggagacattcatttttattccttgtggaaagaagtagggcaaatatcaaggcccagggtttttgcccttcatcaaaaaaattcttttagacactgactcagaacctcttaagtagatcagaattcctcgccacagtcagtcctgtagaagaaaatgccagtgagtgagagcaaagataactcaaagcacatagaaggccaaatttggcttgacaccctcattaaaaaattgacccccttgagagttttgtctaaaaatgggctgtgggaaagaggtcagttcaattgaacatgttaacagggttttttttctttttcttaaaaaaagactgtttaacaaatacattgaaagtaagttgccagttgaatctcaggctcaaatgatttttcttgctgacatatggcattgacttaagggaacagattagataatataatcatcgttaattccatgtgtttataattgtgcctttgatctacagcgtgtgaagtgctttgccaacatcagcctactgatcttcctcaccaccttctgtgacatgtagggactgcttttatcccctcacttcactgagaagctaagaagtggaatgtctaaagtcatcagcttgttatgacaaagctaagaaaacattctgcaacccatgagtcctgtctaattcagtttcctgactattaagactcagctgctttaacaaggattcaataagcagcttagctcttggcttctgctcctcttcaaacaaatggctacaggtacaggcagggggtatgtgaaaacttcactctggtctgaaagtacagcactgaattttttaattttttaatttttttctccatggctcagcattttcagtcaatttcttaatgcccaagaacgtggcattatagggacacgcagacagtatgcacagtccttatacatataatcatttatttggtgttgtcttgagtctcacatgacagtagaagctcctcaaatataagaaaattataaaatctggcaataatcgtatatagatagctagtaagctcaccactattgatataaaggaatatctgtacacaattgtgtataaagggatatctaattgtgtataaaggaatatctatacacaattgtgtataaaaggatatctaattgtgtataaaggaatatctatacacgattatagatattgtatataaaagaaaataatatagagttacactaagtttctttggtaatgctccaacaggggccataaaagcagccagacataatgagctctgtttagtcaaggattcagaaatacataattgttacacatcaaaatcatcttaaatacctaaaattttctatttcttcatctttctctgaaagctttctttcaagttctgctttagcttccaagagttcaagctggaaatgaagaatcttgctttcattacgttccagggctccctggaatacataaataaaaagcattaaatgaagtccacttttagacaaaattgtattttttacccaaaacatatgtcgctaatgtagctctcttagagttactgggagagatataggttcaagccaggtccctagagattgcaacacagtgagacaagcaactgctttcatttgtcatttcacttatagatttgacattcttaggtctttcagctgtagctccagaactagaattttaaagcctattttaaaatagaaaatttcactcttgtctgtgactatatttaaactttttaatgtattacccttgactttttctaacatattccaactttgggataaattttaaaaagtatcagagctagaacaaggaaggtgataactcctacctggaatcttctattaaattctggacatcacgaggggatagaggaaaagttggatgtattcagagaacaaacaacagggtagtgtccaaatattgtcatatgaagaacaaataaaggaatttacaatgtacctgacatgtaacactcagtgtgagccattaacaccataattggtaccactactgcaaatgaatttctttgacaggcagaagattccttgcccctttgtgtattcaaatatagttaaggcaattatttgcagggatgttataaaggcaattcaattctaaaagcataggtttggctaaatctttaaaacccgtcctgaagctaaaaatgtatataaaagaagaaatccaaaaaacacttacagaataccaaggatataagggcataaggggtgatgcaattttgtggtcagttagctacaggcagtcctaagggcagaagtaattttttcatagcctcttttgaggcgtgcttagcagatatgacaaaatgtaaaaaagtaaaactgagttgcaattttaaaataaaaataaaaagatgatgggaattttaataagacctcccttgatgttatcttgatactaccttcaatataaaagaaaataaaattgctaacgcacactcaaaaacaaatgcttggataacaatttcctcagagggaatagtgtagtagttccttcaagaggaaactgtcacctctaaccctctaaaatgcactgagaaagtgaatctttagggaacatgacctgggataatgtgagttttatggctttaaaaaaatctgataaagtttctcataaaggctcacccaggaaaataaataacgcaatgttacaaatacatgtccaagttgatgaagtatttatggatgtggctgaggacagaagtggagaaaatgcgaatagaatgtgttgccatctagtggtactaagtggtttgagcattatggccttcctgtcattctcacccttgacccacgtgatgatcgactgaatacacaaagatgcctctgtgttatacaggacataaatggcccgtgccagttgtatttttcattggcttgtcatagtacttgaaatttctatcataaaatttacttctttcagttaaggtggtggcttcaaaaagtcccttgccaggatagccagagaaccaaagggaacgagtaaacaaaacaaagttcaccaactgtgtaaggaccagctgtgctacagggcaccacactgccaacgaaaaggagtctgtataaagttagatagcctcaggaaacatttatgtataacagggtgagagctgctgcctgacaactctatacagagggtaatatggacacatttgcttggaagtttcttctggaatcacaacggtgaggtaaatttaacagacaatgcttggcacagagtggtcctttggggtcttgttttccatcgccataccttccaagagacccctgcctaacactgactgccacacctttcaaaaatcttttttctttttctactggtgggaggatcagggctgtattttaatgtgtctgaatacttgttcaaaggctgagtcaggaagatgaagttcagctctgagaagaggctgcacagggcttcttaaccacctaagaatcatgataagatgacttccttgttagtttaccttctttggcgaaatgtcttcttagaggtcctttcaattgctaatgcacacccagagatacagccagagacttttcctgaactgtgaatccataacactgaaaaccctcctgtcaatctgcacaaagatgagctttcagaaacaaatgtttgacaacatcactttgaatcttatttctgaaactaccgaaagtttttggggaaaaaaaattgaaaagcttttgtgactgactctttaaagagggggcagctatgagaatatttattcattcaacatttgacaaatatttactgagcctctactacatgccaggcaatgttctaggccagtgcttctcaaatattaatgtgcatatgaaccaccaagggatcttgttaaaatgcagatcctgattcaacagagatgggcagagggctgagattctgaatttctaacagcctcccaagcgatgtccatgggccacatgttgagtagtgagggtctgggcactggggataaactggtgaacaagatagatagttcctgtttttactacaatcaggagatttgcattcactgttgtgtatcctgctctctgagtctcaatttcctcttttataaaatggggacagtagtttcctacggtgattatattaaaattatgcatttggcagagtgcctagcatatagtaaataaacatttgaatacgtgtccttttgttggtgctgctgttattgctgaatgcagatcttctgccttgtcacagtgaaaactttcttttctccctggtgataatacctctgtttcttccagtgtcacctggacttctgtcttctcttcttcaattagtttcttgaccttttccatttcagttaagttcttggtcccttctctaacctggtttgtcagattagaaatctcttctggagacagaggtaagaaaaacaaagttagtgaatgggctcagtctcaaaccaatgataccaggcacaacagattcttccagcccactggaacagtgacctcatgccacccttggtaacttgatgacctatcctatatgggaccgagaaattttaaaagggtattcattttttcatatagtcttttgccatctgaaaattgaaaattgtctacaacaaatggtgagggtggtgcttcagagtattgtacactggacaacttttgcaacttttacatgacagtcctgctcattagagccattccaggttccacctggaggaacacagacctggagtccctacccttccagtgtaagtgcttagctatcaacattagtggctgccattgtttcagccaccactcaacactgcgacaggaacttaaagtaaaagctggatcaatatctgccagcattcaaggcatggccccagataggccagagaatcagaaggggcccaaggaagacagtggctttagctcaagcacttgagtgttttttcctagcctctcatgaacataagcctttgacaaacagaatagggcatccagaagtcacaaaacctcttccacctgatattgttatggtcagttctgcctttagtacctaagaggtgtggtatagggccaagtagctcagagaattacccagttcagaggtggtggaaggagctcaataggtcacctgctcctctggttctgagatcctgggctgtgatgtgatatgatgagaatttttagaagttacaaagacaaatatgttagatggaaattttcattgcataataaattcttctctgagaagtgctctcctaaagatgggttatcaagaagaaaatcagggaagaggttctcaactctgaccgcaccttagaatcacctggagagctttggaaaaagctcactcaatattcaaaccccgccccagtccaaaggtggtgcccagatcagcagcaccggcctcacctggaaaactgtcagaaatacaaatccttcagacctactgagtcagaaactctgggggtgggccccagccatctgtgctttaacaagccctccagctggtttggacgtagctaaagttttctaaccactgttttagcacccgtcacgtctccatctagtgccttgatcatagactatgtaggtcaacagaaagtaagcttcatttacgcctccaacagtaatgaacttgcttccagggcatctcagggttttcatgcacattgctgttggtgctgggataagttggcagcctctttgaagggctgtttggcagtaaatcaaaatttaaaaattcatttcattaccccagcaatttcttttccagggatccattctactgaaatatttttacatgtgcataaatacatgtatagggatatataatgtaggattattcatatttgtgaataattggatctaaaatgaataaagtctagttaaatgatagccatctttattacaaaacactatgtagctattaaaaagcttatggtaggtctccatgtacaggcatgcaaagacccacaaggtacgtgggaaggttgcacagctcagtagttaagtgcgtatatgctggagccgtgctggctgggctcaaatcccagatctgcgacttatcaaatgtgaatttgaacaagttactcaacttatgacctatataaccttcattttacagatgagaaaactaacactagactattctgaaaatttaacaataaatagttaaacagtgcctggtacgtagtatgggctatagaaatattcattaaatcgggaaatatattcatatatgaaaaaaaggtgtagaacaatatgcaatttgggtaaaaactacacacttgagtatagcacacatggaaaatcttggtacggttgtggatatcaagaaattttcagcactggcttcctttacagaggggaactgaagttaaaggtaggaaactagtcttacttttagaattaatttaatacaaacagcatctaaagtaaaaaaaaaataagtcaaacagaagtataaaaattgaaaagttaaaacatgttgggaatgtgaaaatgctgaagacagccttgcctgtagccagggctcttcctgagctacccgctctggctttggctctgagcccagctcggtgtaccttggaggttcttgttctccctcctgagtgtctcctggcccacgatgctctcctcataggtgttcttgagcttgaggagctctgtactgagagcctgaacttccttctgagaggcatccagcaacgcctgggactcctcgtgcttctgcttccagtcggcaagggccttgccagactgcagctgcttctggtccagcctggctgctgcagagcggaccttcccgaggtcagacagggcgtccccgagctccagctgcagctggtgcctggctctctccaaggaggcatttctggcattggccacccccatggcttcggctgcctcctgcaatctaattgccagttccttcctgagaaaggaggacacccaaagagtgagtgaggcaataactctcagagagctcatcaagtctgccctggattaaagatagagcttgggtgcaaagtaagatggcgcctctgcagtggacttagtggtataaagcaacagcagctcctatctgaaagtgacctcactgtctatgaccaccatcctctgcctcctgtgtgcatggggtctttattttccccctttgccaacctgcacttggaactcagaatctctttgaattcctacaaatatttgcttatcctaaagctctaataagcaatactgacttgattatttcctaagaagggggagaaaaggaagattgtactgaacaccctaccaacagtaagcaccttacaaatctgtagccatatgtagtcactaaagagctccttggctgtgttgcttctaaagaacactctcttgctttttcctgcttattttctctcatcatgtggctcctcaacatgacacaattctttcttctctccgagtttgttctccacctcagctcctctctccagatttatattcccaaacccatctcattatgctcacttaacaggtcctactgttcttatggggttttttagcccccatctgctgttccttgggcatctctgagatggagtaatttattacagtgcttctttctccaccacccccgtaatatgctactattaggaattctaatggatgaaatgtgttctgtttcttacatctcctgcagggttgctggcagtcccattcttactcattcattatacttcttagatgaaaagtactgtatgtaccaaagctttttctcatctactgctattaaacagaaaaaaaggttctccggaattaataggactgcataactagcccaacagaggaatgtggtaataaagtccccttttggtggaatcctgcaaaaacccctatgtgctcaggatccaggaagcatctaggctctaacaacactctgcccccggcttcctagccatactcacttcacttttctgcttcatgtttcttaaacgttaagaggatattctgatgctttacctgacttaaggcagtaggagtcaagtgaaataattacatatattttaactactttagaaatgcttgttgataaaataggagtttcactttgggtgactgatcatactggactgcctgggactgaggggtttcaccaggtgatatggtttggctgtgtccccaccaaaatctcatcttgtagttcccataatccccacatgtcatgggagggactagtgggaggtaatttaatcatcgaggcggtaaccttcatgttgttctcatgacagcgagtaagttctcatgagatctgatggttttataaggggctttccccttttttattcactcacttctcttcctgccaccatgtgaagaaggacctatttgcttccccttccaccaggattgtaagtttcctgaggtcgccccagccatggtgaactgtgagtcaattaaatctctttccattataaattacccagtcttgggtatgtctttattagcagtgtgagaacagactaatacaccaggacatgagactttcaaagctaaaacaggaaacatccagggcaaactggacaaactggttacccttgttttaccaataactttgttctacgtttaatatcaactactattttgctccttaacttgccaaccataagcacctacttagttatctcgaatatgtaaagggatattggaaattaagaaactaaatccttatccttggggaacttagaattcagaagcagtacaatgggtcttagataagcttgagtctgctaaactaactcatcatttgaaccccagcctggaaatcaaagcaggcaaatctttaactttaataataacaaaagaaaccaggaccctagattgttttgtagctgcctacctccctgaggtgatttagaggaaaagcataatacagacaaagttttatttattctatgtcccaccaatttgaaagtaaaaaattgtcttcacagagtaccatgtttgccctttattttctttagttattacatactacagaactagttccaacaaacccatgtggtcataaagtaatctatattcttttgctctttcctacccaatcccaaaagaaaccatcaaacagaatgatagataggcaatttcacctgaattcttcaatcattagaagggggaaaaatcttacttcagaagtaaataccatatttggatataagagggcatctcagttcaaagccaaaactttctgtggtccagagttttgataaaacatctactgcaggtatttttagtatctgtcattctaaagccctttttaagttactgtgggtacagagatggatcacttggtaccccttctgggacaaaacacagcagctgttcagcaattgcacagcaatgcctctcaaagatttaggtgaagaactgaaaaacattatttctggttgaagctaaagagaaatgtattgatcttccctggatttttgccaagctaccaagccagggacacattcttttgagtaaaccttgaatgattataagctggggtttgacaatttctcttaaaggtacagtttcctggcctctaagcaaaatgcttcagttctataccctggtactgagtctcaattcagctgtgccccaaacttgtgtaactcctaaaaacttttaaaacctttacatagaaatggctataaaattgatattctaatcttaggggtggcctggggatgatttcttttcaaagcaacctttgtcctagaagacatgacgacagatcctaacatttttttccagcttccctgtccatcttcacagactactttgtagtctacaagttgtagaccagggacacaacgactttgatggagacacgtacacacatggactcaattattatggcgttacaaatgaaatacagggttttaaacgatagcctattttcacaccacggctcaaagtcacatcttttatgaaaacttcccttgtgcccctagaaagagcctcctttctctccccaggacctctttatagtctctgtcactttgtattatactttttatatttttagtccctctacagagtgtgcttcttaccagcagtgcacgtttcagctttggttttgggcttgttcctgcactcggcaaggatttgttaagtgcataccatgaggccttggagacagagtcattattctcatactgctccatgtgagtaactccaggttaaggatagccttgccctactcacttggcatcctccaagtcttctgttctctggatgacattgttttcatacttcattctccattgcaccatttcagcattgactttggataaggtccggtgcagctcagccttgacctcttgttcttcctcatactgctctcgtagaaggtcacagtcacgctgagccttctgcagggcatgggccagggcactctgggactgtaggggacacacattaacaaaaaggtcatgaccaccatgagcaacacaagtcttgaaagtaagctaattttttttttaggtaagattaataacaacctgccacaaattcaagccgaacctgaacctagtaagataacactagggagagaatttgagacaagagaaaggatagatagtatctaattgctgccattaaaacagggaagggaattctatttagagaaatgccagcttggctctgtggacttagacaggcctggaattctagaaatagtggagaatgcaaggatagcaaagagaacattcactatcatttaggcaataagatttatatttagcaatatattagactcagagcttgtttgaaccagaaagaaccactaaaatttagcctttttattccactgatgaagaaaataaaatcttttatttcacactgaaatctctaaaaacctcagctcctaatacttcaaaatagtactactgcccaacagaactttctgtaatggtgaaaatgttctctatgtacactgtccaatatggtaaacacctagccacatgtggctactgaacattcaaaatatgcctagtacaatgtgtgatcaaaactgaattcttaattttatttaactttaatataaatttaaatagttacctgtagtgtagtagaggcttctatatgtattggacggccctgctgggtttaataaacatttttatcatttaaatggtgatctggctaacctagcagcattattccccagagataatctagtgtggaaagaacactagatcctgacgggtcctcaagtgtcctttatgcaaattaggaaaaaagcacattttcaggaagatacagctctgagggcacaaggtttagttaatggcagcctcagccagacccctttgggtggtaaatgaggagccacaatacacaatgactctgaaaaggatgcaggctttggagtcagatgaacttgggttcaaactgtgacctctcctcttgtttaattttatttttctttaaaggaaaaacttttaaaacctttatgtggcatttacatggcatatatttaattatagaagtaaacaagacaaagacaaaatccctgccctaaagagcccaaaagaaataaggggatacacaaaatacacaggcaaatacattaataaataaaatttctaatagcagtaaaacaaacacagcagataaacacgatctagaatgtttggctccttctcatcatccctctaagacttcggtgaagggcctttaagcaacgggaagggcagttataaaagtcctaaggcaggagtgatggtgcctggtttaagaggcagaagggaagccagggcagctggaggggagtaaatgagggaagcagatgtaggaagtaggtcacagaaggaggctggagccagatcaggggggcttgtaggccaattggaagtcactgggaaggcagccagagagatcttctaaaatataactcatttcactatgcgtttaagttccttcacagtacatcactaggtgtatgaccttggacatgatatttttcttctcagagccttggttttttcatatataaggatgcaattctatctgcttcatttgactgatatgaagattgagataacatgacagaagtatctggtacaatgtctgatgcacaaacaatgatacatttttaaatttgtatataatatagaaagtatggagagttaagggaataaaatggtacaatattttaaaacagactcaactacctgtgttttcacagtatacgccttcatagtatggtcatgtacaagtaagatagtttggggtcttagtaataagatgccttgactatgaactaagaattcatttaaatatcagggctcaaagaattcatatctcatgttagtcactatgctttcatcttccagaatcacttccactggagtcaccttctagcaacattatacactcataggaagaaatgactaatttctataatttattgacaatttaaaagtaatattgagctaacccagtcccacttattttattctaggcttttatttaatttcacttttttatgagcagtttcaaaatcaaaatcctgaaagagccttgctgcccttctgttcaagtacttatacaagatgggaacacacactttgcttgctctaaacctgcaacgaagcaatttgaatcaccgaggaagatccttcagtcatcagggttcttcctggcatggtttttcccccataacttctagggcattttcccttcttcttttacaaaacatcttcaggctgattcatcaagcactattttttaaaaaaaaaaacacacagtcaagaaactagtgagaaataatagatacattactttggtctccttttccagctgccctctcaggtcttcaatctgccgagtgaagttgctcttttccctggaaagttggtttatcagagcctccttctcttcaagcctccgtaggaactcgcctacagaaagatttcacaaaactacataattacagtcttcctatctattgcctccttcacttgacttactgactttaagggtagccagaatgactcctacccacatatttttgatatttaggaagggtctgagagtcctattattcagcaaaaccgtggcaatgatcctttccaggactcagaagagagtcctaaaaatgagctgatttttagtaataagtatgaatcgataacagatgatattagttaccatttattgagaaacttctatgctctaggtacttaacgtatgttatctagtttaattttcataactccttgatagtgtaggtattatactaaccattttgcagaggaggaaacagagcaacttaaatatgactgaaacagaaacatacacagttcgtaattggtgaaggtagattcaaatgaagttcttgaagaccacattcttctataccatactcccttgtttattatatgtggctttgtacacttctgtctatataatttttagataattataacttttattacctcacttgtaagatgaagataacaataagattcttaatgaaaactaaattagtgtgaatatattttatagactgaaatgctaaataaatattagcagtagtcactaaatggtaggaaatgtgacgatgagagggagaaattctatcatactctagtctatcgtccctgcttaacttatcctattaattatagtcgggccttccatatctgtaagttctgctttgtgaattcaacctaccgaggtcctacaatttaactcaattctgacactattttcctggagacagtgtcagatacacacacacacgtacaggtatgtatatatatatacacacacacacacacacacacacacacacatatacacacttaaacacacacatatatacacacctatatgtacatgcatatatctttttataaatcacatcgcatacaatattttaaaaatcatatttgttaacatcactgctgagctcatcagaaaagtccaagagttgagagccatcaacctaatgatggcatatacatgttttctaaaatataatttttacctaaaagctcctattttgttattggcaacaaatgttgtcagttgctttccttgaagtgacaggtttcctttgttcatttttgagaaatcatctgccaaacatgtaagcctaaataagcctagtttgtttgtcagtcattctttcaagtaaaagtgatactccctgaaaaaactactagctcagctcagagcttaatcacacatcttactccagtatgaaacaggaattctttatgcatacttcttgttttgtcacacagaatagtaaaaagatatatactcaagttgagatgtaataaaattcatttttcctgcttcttaaggacatccttaagtgaaactgactttttaaaaaaccgtgagtacatattagcgaatacaatttttaccagtatgttttagtgctactaccttgacttgtgatcaggctgcagcaattttaatcatcgttgcttttgcaccatcaatacaaatggcaaaataatttaagttgcaaatagtatcttagtactatactaaaatagcttcaacctcatagaccccctataggctcctgagaatcacttgggatatttaaatcaaactttaagggtatttggatgaaaacatcttgtggctttttttttttttgacagagttttactcttgttgcccaggctggagtgcaatggtgcgatctcagctcactgcaacctccacctcccaggttcaagcgattctcctgtctcagcctcccgtgttgttgttgttttgttttttgagacagagtctcactctgttgcccaggctggagtacagtggttagctgcaacctccgcctccagggttcaagtgattctcctgcctcagcctcccaaatggctgggactacagatgcctgccaccacgcctggctaatttttgtatttttctggtagagacagagttttgccatgttggccaagctggtctcaaactccttgcctcaagtgatccgcctacctcggcctcccaaaattctgggattacaggcatgagccactctgctggtccaaaaacatcttatttaaaaggattctgaagaaatataaatccactagctggttgagactaatacatcacgtatatatcacatttactattggtttcctctgaaagcagagtatggtaagctgacagaacagggcatgagaaagaaactttggtgatagccaccaacaaaaaaacaaaaaacaaaaacaaataaacaatctggaacgtggacccagtgaggggaggataggcttgaataaatttgtacttctaatttaatttacacaaaagccaaccaaaaggtaaagttaaaaaaaggaagaaaaaaatcctgcagcctaagcagaattatcatctcagacccacttttattttactcgctacccactaatttcctcatcaaaaaagtgagtagaaaattaatgccaataactaggggtagacagccaatgcctatcaaaatagattttacacagcacttcctttagggccagacatccaggtattctccagctttgtgtctggactgtggagtctacataccaactaaatcctaaatagcacagatcaaactgggggcttggtagcaaggccaggtgtcacacaccctgtgggcagtataagaagagtcctattcagagtccttaatagaaccaaaaacatttccttcttctagatttccaggtttttagttttatcaactaatttttatttagctctcaccctagatttagcatctggaaatagaggtgtctactggaggaattgtgttatatgtagcccaaatgtgttcattctctttttaaaactgtgtgcctcttaagcatcaagaatacattgtttattttcattgacctaagaattctatctctcagaatatattactaaaactgattttagttatagataaacatctagccacatgctattcatagcagagaggcaagtcaagttgcaggcaaggttaggtttagtcaatctcaatgaattagaagcagtcattataaatgaccgagtatgcaaaatacaaaagcttatgataaattgaaaaagaaaaacccccaacagattgctacaatgtaatagattggaaaaacagaaaaaaaaaatccatagtggttgataataatgaataaactatgggacatttttctacttttaatttatttatcaaatgtttatggaggatcaataaatgccaggcagtgttctagatgattgacatacatcaatgagcaaagacccttgacctcatggagcttatattctgacagatggagacaaacatatttattgtgtcaaatatgtagttagtttgaacttaataaatagtatgaaaagagaagctcttgaggaaatgagttgacagtattcaaatgtcaccttctcagcagggcctatcctgactttgcccagatctccacttgattaacccttatccccaagtctttccagaattaataaggtgttccaggcagagtaaacagctagggcaagactctagggtgggagtatgcccggggtgtacaaagcacagcatagaggtcgacgtggccaacgcagattgagagttcaagggcaagtaggaaaagaggtcagagagaatggggtccaatcatacaggctcaggtagccggctgtacagaccattggttttaccaggtgtaaagagagatgtagattcattatccaaacattaaaaattttaaaaaatttaaatattcaatgaggtagaaattgtaaaaatgtcatgactagtagactgtggattgcccctcccatcctttgatcttgagagttgcttctactgatggcatattattataattttctacttcttggaagggaactaggcaggggttcccaagtggcacagaggtaacacttcctagacaagaggcatgtgtgtggcaaagctgtctcagaggctgcattcctcccctaggatcttcagatgcccactcagcctcagtgggtagttcattatctcagttgtgccttcatgagtctgctgggattgagaattgcctatgagtcaagcagcatacttacttaccactctcactccacagctttgtcttttgtgctgccaggtcatttgccaactgagtcaccttatctagctttgcagttgcttcatgcaagcgctcttcatatagagtacagagtttctcagcatttgcctataagttgagaaagaagggctggtcagggctcacagaggatactctgaatcagctgcacaaaggaagaggggaggagtggctccagggatccgcatgctctcttctgtagtaaagagctcagccagcattgggagatcacatcttctgatttcagcaagcacaattaactctagggtctggaccccaagaggcctaaactttgcagagtataggtgtcacgggagacacccaacttcctgggtattaggatcctttctagaattatttacttttctggagaaggaaacatgtcaaacgctaatgagatacatgatccttttctgacagtacatatttaactgtctttttcactagaatataactctcatgagggtagagatccagtttaaagatataccccctattgtatagaatagtgcctggcacataggagagcaatatgcaagggtggagaggcagacgaaggggaaggaagagaggtaagaaggggaaggaggaggaaggaaatctagaaggctgcccaagcaggatagaagaaagggatggatctaagccgcaacagcctaataacaaaatgtgagctgccaaagcaactgtaccctcctgatcactatggctacaatctcaagatgaccctgttgggttaacacttcaatccccaaacccaacttctcagaattggcttttcatgcctggagaaaaagatatgacattggcctttgcacttttacccaattaaagtaaccagtctaatcgccagactcttgccacactctgagaactcatgctagtggttttgagacccaagatcctcagacgggactaagagttgccaaatgtaagatgaggtatccccttcacatacaaattaactatagtttgcattcttattatttatatggtcagaaacagtaaaattacattggtggtggtcttccatggttctacagattttacatagctgttttgatgaaactcatgtataaattatctttttattatcttttttttttttttttgagacagaggctcactctgtcaccaggctggagtgcaatggcacgatcttggctcactgtaacctccacttcccaggttcaagcgattctcctgcctcagccccctgagtaggtgggattataggcatgcgccaccatgcccagctaatttttgtatttttagtaaagatggggtttcaccattttggtcaggctggtctcgaactcctgaccttgtgatccacccgcctcagcttcccaaagtgctgggattataggcgatctttgaatgccttccatctgccccatcgtgggtgatgatgatgatgacactattaatgataatagcagcagcagttaatttattgggtgcttgttacatacccagctctcttctgagctctatgttttaaatctcaattaatacagcagtccatgaggcctttgtctgtacaaagaaagtatgctatggaaatggaagaactgggagacaaagaagagattacaccaatgaaattttgagaaaacagtgaggtctggtgagatgatgaaagctgatggtgagcctaatagttttcagtgttaacctaattgttatgatagagcaatggccaaaggaccaggaatatttcaaaggtgatgccaggtttagtcctctggaaaacttctgtatcagccaaaacctaggccatctctagctggaacctacgctctgtttaagattgcttccttcatgctatgttgcaggacttttccttagttcagctaaagatggggttctttgtccccggccacaaaaaatcaggctcacagacaatttgaatggtgagtaagacagggtttgattaggtgaaaaggaagaaaagggggaaacagggactctcacaaggccagagtccctgcttgagcgcttgccgcccgcagcttgaatcccaggttccacacaggaagaggaggggccaggcttcaacccaatgcaaatggcgtgaagtttccgaggctccactccagtgggcaggctggttggagtttctccagggaccccctcccacctggctgtctcacttactaatggctattctctgaaagactactgaattatgtcttcttatatctccaatgcagtgttatgtagttccagttcacagatgtcctacagcacacccaagcttggtagaaacagacttaacagagattcaatggccagtttctcgaacgatgccatcaacctcacataggttagagcattaatgttaaatgccagacatgctcaattgtccccactctccactcctaactagaagaaagctatagtagtgatcaatgtgacaatttttaggttgtctgcacagtttctaattatatgttgaatttgtttgctctcacttctgaaaatgactttgacagtcaaagttggcatgctcattttcttcctcacgatatctctcaaaagttcagattgcctctttctacaaatgagaaaactgagcaccagagaggctaaataactagcccaaattcacacagctattaaatgtcagaattggaattcgaactgaaactgcctgtgcagatgcacacacacacagaaaatgtcaaatattagatttctaaacatctgttgtatgaagtggtgataaaggaaatattaaggattaatcgacttgatgtcctaggtggcccaaattgtcatgaatcctgggttccagaggaaaatggataaaaataggatgattatgaaaaccatttttattttatgatgtctccaatagtaaatgacctgttaactgagccaggaggaacatatccaggtgtgaaaaatggcatctgtttagggccctgaatatgctgtgctatgcacctgtgtgcttagggtgaaaaagcacggatctctacaagacaacttagtcaatggtgcgtggaaatggtaagaaaaagagccaaagacttcccagtttttcaagagaggtctccacgtggtgaaggccagctgggctgtgtgtatctgtagagtgggcagcccacttggacagatagaaaaggcacttgcccttaggtatagcttcacatggtaggtatccacataggcactgctaaccactggtatagtgtttccatgtataaagtattttcataaacaggatctgcaaaaagacaattagattgtttatctaacagtggcctatatggggatatagcatgcaaaagagttgtaccctcaaaagaatttttaatttaagcataaggataagcggtatgttttgataccagggatgagaaggttaatagaataaggcacatttatcttatagctgattcttaaaatgatgcataaaaatgctgcctcccagaaatgcagggaccaatgggaattcaaaataatcaagataattgtgaaatttcctataacttctaaattgccctgagcctctctgtcagcataacatgcttttgaaaatgcttcagtctccactgtaccactcagcattggcattcttgccattataattcataaaatgataaagtaaacaattcaaggaacagtttagcctaatgtatatgcctatgagagttaacagaaacaatttatcatgccaacaaatatttaaagcagtaacaggacatgctcaccaacagacatacacaggatttggaattggagttcatctcttccatagaattgtgtgaccttggacaagtcactgaatctatgagctccaagaggtatacgtaaaagttgatgctagtaattgagtgcagagactctacaaagcactgtagtaaacatgaaaaatgagacctagtttctgctttcaatgttagcaaggttaaaagactagataatgcataagtataaagagggaccccaaaagtgctacaggaactcaaaaacaggtaagtctttaatgcaggaggttgaacttgagcattccaaagagaataattagtttggaaaaggcagattggtgtaaaaatgaatatttgtttaaaggcaacctgaaatggaaggtccatgaaacaaagcaatgggatctaaaactggcaagactggttgactctgatcaaaggttacaaggtaccttgaaagcagaagtttggagttcatttttaagcagggacataattcaataaatccgtgctttatgaatattctaaatactttacaaatattaatttgggcatataaatataggatggtttgaaaaaaggaagactagaagcaaaaaagataatttaggaaaccactgcagtaatctacttaaaaagtagacagacctacatgggaatgggaatggaaaactatgagatggtaaaaactgacctgctgcgataattgactgaaaagcaaatagggaggaaagaagtggttgagacttagaacgtgagttataaaaagaaaccaggtgccagtgacagagatgttcagaggaagtgccagcttcaggagaaacaaagacacatggcagggattaaagagtaaggaggtagtgagatacacacctactgctagaaaaagcctatattcccatgaatggaacattaagaatccttctgatgaggactcacaagaagaggagagctgtagagagagaattaatcttcttagagatagttggatggctgtgattacaatgctggtagtaaaacagacagtaaaggcaattctgctgaggtcttaaatggaaatggggaatatcctattggaaactggaagacagaccatccttgttacaaaatgccaaagaacttggctgaactatgccctggtcccttgtggaaggcaaaatttaagagtgataaactaggatatttggtggaagaaatccttaaagaaagtgttcagggctccatggcttctcttgattgcttaaaacaaaatatgaagagagagaaataaagatgaaatgtataatcaaagagaagcagaattgaaagatttagaaaattctcagcctggccagattgtgaagaataaaaaagtattttcagaaaaaaaaaaaaaaccctaaggacatagacaaccaaacatttgataaggaaattagtagggatagaaagaagacaggtgctattcatcaggaggatggactaatgaccctgaaggcatttctgagacctttgtggctgccccacccacaaaggcccagaaggccagggccttgatggaaacgtgatttcaagagaggattcccttgagacctcagagcttgctgcccagggctgcctcaagtctttgctccccacatgccagttcagtgctcctctgccactcaggcaggcccaggttcagctcaggtcaccactctggaaggcacatgctgtaaaccatagcagcatccatacagtgctaactctgcaggagatatggaagcatagctcttccacctagatttcaaaggatattttggagagccttggggttcaggcagagaattgccatggaagcaggaccaccacagacagcccccactatggcagtggtggtactgtgagggcagagctgcccccaacaccccagacttgtagagccaccagcatgcaacactaacctgggagagccacaagcacccaacttcaattcctgagagctcctgccaggggggggcagtgctacatggggccctggggacccaaactccaccccagtatgtccagaaggtcagacatggagtcaaaaagattattccccactttcaagatttaatgttgtttgctgtgttttctgttgggcttttccctttgtcacctcttttttctttctgatttctctgtttttcggaatgggaatgtctatgctatgcctgttccactattttattgtggaaacacataacttgtttgatttcacaagctcacagttggaggaggaatttgcctcaagatgaatcatgccttgagtttcactcctatatgatttagatgagactttagacttttgagttgacgctgaaatgacttaagtctttggaacctattgaggtagaatgaatgtattttgcttatgtgaaggacataaatttggggggccagaggtagaatgctatggactgaatatgtccccctaaaattcatgttgaaagaatggccagtgtgatagtgttagatggggcctttaggaggtgatgaagtcatgaggataggagccttcatcaatgggactggtacaagggagcatctgtccctttcccctttttgctcttctgcaatgtgaggatgcagcaagaggcaccatcttagaagcagagagacctcaccagacaataaacctgctgctaccttgatcttggactttccagcctccagaactgtgaaaaataaatttctattatttgtaaattacccagtctgtggtatttcattacagcagcaggaatggactaagacacacacacacacacacaacacacacacacacacacagagagagagagagagagagaaagagagagagagagactgtttctttctactcagtatggtatttaaaaggaattaatattaaatatttcagaaaccactccatatcactgaagatattctacatttttctaaccatagtccatggagatcaagctttattgtcaggccatgtctttcccagatgactttataaaatctgctcacaaggagagaaggttgcagcaactagccatttgctctgcttaatctaaagcaaagctcctctcaactaccaaaagacagggtcgctgatttcgatgatctcatagtaaccatttgacatgacagcttgcagcatataggctaatgggctcagtaaagaaagaacatgtgatgaacctttcttatagtactggctgattaaaaagatgccagaggacttgagggagaaaaagttccctcctctcagcaaagctgtttgtgtacaccattcattcagataggttctaggagtatccaggccatcactgaggagcacttataacaaaagtcattcttcaagacagacatagatagtggcctcagatttccagctcacttacttgtgcaatcactaaaaaaatccataaggaacatggatttgaattctgttaaaaccagaggccactgtcaggtcacattctggtgatggctgtgtgaccttaacaatgaccactaaggtcaggcctgatctattccgtccaaaggactatagtcttcattagaaaatacactgagtcactaagctggcttatttttcttttccctcccctcccatttcttcccctccctacttccatgttcagaagaccacgaggatggcatgggagtatctaccttagctcttgtcatctgctcaacacgggtcaggaggtcatctacttctagctgcaagtcactcttgtctttttccagtttctgcttgacctgctgtagattttctacctggccctcgagctcagccaggctgtctgcatgtctcttcttcaaagatgcagaagttgtctcaaagtgcagagtggcctcttccatgtctcggtgcagcttctggaatttggtttcctgtttcttagttatttccagctgagccaaactggatcctcctacctcctccagcctctcattcaagtcagccaggtcttgggtgaggtcagctctctccctttccatcttggctcgagtggtcctttcagcttctagtttctctttcaaatcctttatttgagtctgtagcaagaaataattttgacttttactaagcacttgtagcaagagctttactctatttttttttaatcacaaagctaacatgaaacttttggttcccaatttacaactaaagaaaacagaatacacagaagttaagtgatttgccccaattcagtaccaagaccagaattagaatttgcagttctgccaaattgctcagcccctgatgatgggcaagctcattaaattatatagatggaggggaaagcttagtaaagagcacttcccaaagaaacaggaaaatatctttcatacgaccaaaaaaactgtttaagagcatttataaaaattggaatggtaaattttatatacaaaaatcttcctcatttgaaattcgtttatctgatctcaactatctaggacttgggcaaaaatctgatcaataaaatgaacatcttcaagttcaagcaatttaattgtaagaaatagcatcaatttaattttacacacaattctaaaaaacttggttacttggttttctagtctgcaggagatttcaaggaagagatttgaaataacaaacgagagctggtgaaggaatgtggactactaaagcgagtagagatacagtatcatcagaggcaggattattggaaaaaaaaggtgataacaactctcagagccccaagcccttttagtataggccaaacaggtctacaaatcctgagaacattactgtattacagtacaatgaagccactgatgttattatcatcaccttaagtaattaggcatagattaggataggggagaaaacaagatagaaactgttttagaatatgttttcctttccattaaataagactactgtggcttagaaaaaactaatttctagattatatcaaataagtagtctatcagttctatagatgaggtatgacagaaaaggtgcttaaagaaagtatgatttccacattcaagtaaccatgatcctcttccaactggttatcatgggatccaagaaaatatttatcccaaataataccaccattgaaccaaacatttctgaaatgttttgtcagaaataatctttagagaactttttgagtcatcaaggtaaggaaatttgtcttttggatatatagaaaagtttgtgtttttttactttattttggataaagtcaagagtcatttgaagacaagcccaatgaatatgataaccacttggagattaatagtgtgtctgaaactaaaatgtttacaaaacattgagactggttttcttatttggctcaaaatatctcagaagataaatatcagaaagatgttccaaaattattttgagtcatggttatattactaagatatttatttagcttcaaagggaaattatccatctaaatgtgtatgtgtgcaattgtgtgtaaaattactttacaacatggtcatatgctataaaactcacatggtctaaaacttataaatagctatccattatcaaataatgttttgaggccacaagtacctatagaacttactgattttcaatcgccttctaatcacaaagaataatcatcataaaaattaaattgctaacactgaatgcataccatgggtcaggcactgtgcttactacttaaatatattgttgcatttagtaatatgagctcaatcgttgccagaaggattcatgagtgaaaaaacaagttttggattttagcacaatgcctggttcacagcaaacagtcaaccaattagctattcatttttattattctcataaggaaatttaagcttaactctatctgtggaatgccacagtttcccttcttaaccactgttcttttctgcctctgcctgtggttggctaagggtatgaataccttggcagagaattagtcattgaaccaccagtcatcacccatggatctaaatataaatacacaggcatatttgataattgattacctgaagctctttaaccgtcttctgaagctgagctaccaggcctttctcattctccacttttgaattcatctgactcaattctaattcttttctgtttagaaaaagatatcaaatacaattgttcagaataataacattttgtttaaagtagttagaattgtaatattcctaacacaaagaaaagataaatgtttgaggtgatagatatcccaattaccctgatttactcattgtacattgtatacaggcatcaaaatagcacatgcactccaaaaatatgtacaattattatatatcaataaaaaaacacaaccaggctttaaccaaaagtaaaaaataccattttgtttaattatgttttaaattatagatataacacaataattcattctcattttaaaacttcaatgattatacctacatctgaagttttcttggctatgatacctgataaggtttggctgtgtccacccgaatctcatcttgaatttccacatgttgtaggggggacccagcaggaggtaattgaatcatgggggcaagtctttgctgtgctgttcttgtggtagtgactaagtctatctaacaagatctaacgttttataaagaggagttctcctgcacaagttctctctttttgcctgcagcatccacgttagatgtgacttgctcctccttgccttccaccatgattgtgaggcctccccagccacatggaactgtaagtctgttaaaccctttttcctgtataaattacccagtctcaggtaacttttttatcagcagtgtgaaaacggactaatatagaaattggtaccagtagagtggggtgctgatgaaaagatacccaaaaatgtggaagcgactttggaactgggtaataggcagaggttggaacagtttggagggctcagaagaagaaaggaaaatgcggaaagtttgaaactccctagagatttgttgaatagcttcgaccaaaatgctgataatgaaatggacaatgaaatccaggctaaggtagtctcagatggagatgaggaacttgggaaccagagcaaaggtgactcttgttatgttttagcaaagagactggtggcattttgcctccgctctagaactttgtggaactttgaacttcagagatatgacttagggtacctggtggaaggaatttctaagcagcaaagcattcaagagatgacttgggtgctgttaaatgcattcagttttgttttgttttgttttcagactgagtcttgctctgtcacccaggctggattgcagtggtacaatcttggctcactgcaacctccacctcccaggttcaagcaattctcctgcctcagcctcctgagtagctgagactacaggctcatgctgccctgcccagcaaattttttgtcttttagtagaggaagggtttcactgtgttgcccaggctggtctctaagtcctgagctcaggcaatctggccgccttggcctccagagtgctaggattacaggcatgagccactgcaccctgcctgcattcagtcttataaggaaagcagaacataaaagtttggaaaatttgcagcctgacagtgtgatagaaaaaaaaaaatcccattttctgagaaaaaattcaagccagctgcagaaatttgcataagttacaaggaaccaaatgttaatacccaagacaactggaaaaatgtctccaggccatgtcagaggtcttcactacagaccctcctatcacaggcctagaggcccaggaggaaaaattggtttcgtgggctgggcccagggtccccgtgctgcgtgcagcctagggacttggtgccctgcgtcccagctgctccagccatggctgaaaggggtcaacatagagcttgggtcatggcttcagagggtgcaagccccaagccttggcaacttccacctggtatggagcctacgagtacacagaagtcatgaattggggtttgggaaattccacctaaatttcagatgtatggaaatgcctggatgcccaagcagaagtttgctgcaggagcggggccctcatggagaacctctgctatagcagtgtggaagggaaatgtggggtcagggctcccacacagagtccctgctggggcactgcctagtggaagtgtaagaagagggccactgtcctccagataccagaatggtagatccactgacagtttgcaccacgcacctggaaaagctgcagacattcaacaccagcccatgaaggcagctgggagggaggctttaccctgcaaagccgcaggggaggatctgcccaagacaatgggaacctacctcttgcatcggtgtgccctggatgtgagacacggagatcattttggagatttaggatttgactgctctgctggatttcagacttggatagggcctgtagcccctttgtttgggccaatttctcccatttggaatggctgtatttacccagtgcctgtacccccattgtgtctaggaaataactaacttgcttttgatttcacaggctattaggcagaagggacttgccttgtcttggataagactttggattgtggacttttgagttaaagccgaaatgagttaagactttaggtgactgtggggaaggcatgattggttttgaaatgtgaggacatgagatttgagaggggccaggggcagaattatatggtttggctgtgtccccatccaaatctcatcttgaatttccaggtgttgtgggagggaacctgtgggaggtaattgaatcatgggggcaagtctttcccatgctgttctcatgatagtgagtaagtctcttgagatctgatggttttataaggaggagtccccctgcacaagttctctctgtttttgcctgccgccatccatataagatgtgacttcctcctccttgtcttctgccatgactgtgaggcctcccaagacatgtggaactgtaaatccattaaaccctttttcctgtataaattacccaatcttgggtatgtctttatcagcaacatgaaaacaaactaatgtcatacccaatccctgctttcccactagaggaaactaccattatccatttagtgtaaatccttccagaaatttaagtactgacatatgtttgtgcttacatgtgtacatgtagctgtagagtttcattttccttactgtgatagaatatcacatacatttgcatgtatagattaacaacttgattgatattaatatattattacattaagatattgataatagcatttatattaaatatgtatttaatattaaatattgttgtatttaatattaaatattgttgtatttaatattttaaatatattattgaattgagaatggtttttttttttttttgagtttcactcttgttgcccaggctggagtgcaatggtgtgatctcagctcagctcaatctctgcctcccaggttcaagcaattctcctgcctcagcgttctgagcagctgggattacaggcatgtgccaccaagcctgactaattttgtatttttagtagagacagggtttatccatgttggccaggctggtctcgaactcccaacctcaggtgatctgcccaccttcgcctcccacagtgctgggattacaggcatgagccaccacacccagcctgagaatgtattcttatcaatatattaagcttaaaaatcttaagctattatattttaagctaattattatattaataacatattaattcaatatttttctacacaagcctacacagagtactccatttaaaaattaactatgacataatatttcacgatttagacattccttagtttgaatttcacaattaataagcacttaggttttccttaatattttgcttttacaaatcaaactattcataatcatgccccttgtatacatgagagtgttcctctagagtggacactgagcaggaaattactgggtaatgtataggtgagtgctaaaaaaataagatagccctgtcccttgctctccattagcagtgtgagatcattgcttctctacatttattcttaatatcatacttctgaaattttcttagaaaatagattactatttcattgttttattttgaatgccctcgtttactagtaatgactgcatcttgtcaactattagtatttttaaatggccagtaaaccaaatggaccgcctgtgtatgttctttgcccatttttctgttaggtttgttcatctaattattgagttatagattttccttggattcttgacattttttatatttgttacaaatttttatctcactttataacttgtctccattttatttgtgttggcgtttgccacatgtttaaaattttgatgtcaaatatataatgccttccttttgtctttggctttttgtgacttgttcaagaagacttatcctgtcaatttcctaagaattattgactgtattttattctaattttttaaaaattgtggtaagaacacttaacatgagctctactctcttaaatttttaagtacaaaatgtagtattgttaactacaggcaaaatgttgtaaagcagatctctagaacttaatcatcttacataatcaactttatactcattgaacagaaactctccattatttctccctcctcccagcccttggcaaccacttttctatgaatttgtttctatgaattcgattattttagatacctctatcagtggaatcatgcagtctttttcctttttgtgactggcttatttcccttagtataatgtcctccaaattcatccatgtttttccacatggcaggggtttcttttcaaggctcaataatagtccactgtgtatgtatattttatatacatatatatatatatatatgtatgtatacagatgtatgtatgaatgtatgtatgtgtgtgtttgggattttttttcatttttaagtttattttttatttcaataggtttttgtgtatatgtatatatacatatatgtatatgtatacacacacacacacacacacacacatcacattttctttatccattcatgtatcagtgaatatttaggttgcttctatatattggctattgtgaataatgtggcatcttctaatggttttatggctttgttttgacattgagttcattagtgcaactgaagtttgtgtttataaattgtatgaggtagcaatttctctcacctcaggaaattaatagctaataattccaataccatttaagtctcttgtcatcgctaatttgaaatgccacctttatcgcttattgtttcagatatacataggtctatttaggggaaaagttttataataaagttacaactttttgaaaatatggatttctaaaatgctaaaactcttgacctgtggcctacacgacatacagtatcatttacactttgctggttatcatttgcactgaaacacaacttcaaaattgaatgctaagggaactctatcatcattttgctttaattattccattccattcataaggtcgcttgtttcatcgtttctaaacacctattaagcccagtaacttgttagcagaatatgagtcaagcctcaccaagagcatgtataatagcatatgtatataccaacaagaaagccagatgctcacagctggtcactggactctcttccctctttcactgtgggcctcaaccattgatatactactatctttaatgtggccttttttgagacagagtctcgctctgtcgccaggctggagtacagtggcatgatctcagctcactgcaacctccgactcctgggttcaagcgattctcctgcctcagcctcccaagtagctgggactatgggcacatgccatcacgcccagctaatttttgtatttttagtagagatggggtttcaccatgttgcccaggatggtctcaatctcttgacctcgtgatccacccacctcggaaacctgacccatcttactcttcatcctcactgttttcttctcttatttggtataatctaaataaattgaaaatccctaatggttaaaagaaaaaaaaaagtctagttaaacagaggaagatgacaaaagggagaaggtgagaaaatccatgtcactgactagtagaactaaactgagaaagccaagttgccctgagttctttggggtgtaaggaatccagatgaattgaaagtttccctaattttgatcattttcatggcttgttttagattttaaggtttaatatttatatagtaaattatttcaccaaattcctatataaatattaagttatgtctggcaaacatatattatttaagtaatctgagtatgtaagtcttcacatcaggatcaatttttttttttttttttacattttatgccattggtctcgtcatgagtaaaaagaagagtgtcatttttatttttttgacgtatagctgcaagttcccaaaagtttacatctcatataccttacaccattctttctcatttgctagtcaggtattttctgttacgtccttctagattatgcatctggtctctttacaactataaaataaagtccagtaaagaaaaaaaaaattgtttcctaggcttgttatccttgccttgggtcttgagctatctggccctggagtcctaaggataaatgaaatgagaaagctgttccttctaatataaggtctccagcaatctcatgtcaacagaaaggtggcttacttcctcagctcttctgccaggtgtcgctggctgctttccaggttctccatactttcccgattcagctttaaattgccctccagtttgtgcagttccctttcacagttcattctcgcttttctctcctgctcaagggcaccctcaagctgacaaaaggaaacattatttagctaaataaataggtagagtttatacttcactagatgtgttcattaaccacttaccttctggaaaaagaaagacacaagcacaaattctataaatgatgcccagtaacatagatatttccaaataaatattgcatatgtcaataggttaacaaaagaatccagaaatcacagggatggaagaaaactagaaataacagaatatgagttctgtcttagggaaggaaccaacaagaaatggccagtgagcccttgattgatcgttttccaatgataggaagctcacttcttcacatggcggctcatttcacgggtggataagtccatttacttgggagtgcttcttcataagaagccaaaatattccctgtaaattctatccacaagtacaagctctgctccctggagcaacaccaagcaaatcagtttccgcatgatcatccttaataatttgcaagaaccccctggcatcactggcccattcaaacacattctcacatgtcatgatttccaagccccgtcaccaccttggtaccctcttccagttcataacattatgtcatattctggttcctcactaaatgttccccatcagaacattccagttttgtatggattagtattgccaggaattatatagaggttaattttccaggaagctagataacagtcacaatatggctttttatttattgatatgtttactttaaaacaatggaagatatcctctgtaaccagccaaagagatgaaattcaaattgggaaggagggagaaattctggaaaggattccaaattcatacgctgaaatcctaattcccagtatgatggtgttgggaggtgggccctttaggaagtgatgaggtcatgaaggtagagcccccatgaatggaattagtccttataaaagagatcctggagagctcccttgttccttgtgtgatgtgaggacacagggagaagtcaccctccataaaccaggaaatgagttctcactagacaccaactctgctggtactttgatcatggacttcccagcctccagaactgtaggaaataaactgctatttatttgccacccagtttatggtattttattatagcagcctgaatggactaagacaccaggagagaataagtgtgtgggtgggtgtgtgggtgtgggtaggtgtgtgtgatgtgcatatataagcacacatataaacacccaaaaatccttatgctgaggctttgtgagatatgttattattggaaataggaacaaatgtaacacaacgaatagataatagaagaaatttatatagaggcaggaagaaagagcagcagataagaagaaaaaaaaaaaacctaaccactcttgtcaacaattttataaaggctacactttggggactactgtgagcataaatgcatacactatgtcagctggggtgggaaaaaggaagaattatgaacccacacattgaaactggtgtgaaacagctttatttcacagggcatttagaggcaaaataggggcatcatctctagaatcttaaaagtattttccaatagtgtaggtagaacacaacttgtggctcacatatctttcaaccataaataaatctcagcacaccactggaaacacacatggcctttaaaactaatccttcaacactagtggtaaatagagtaccagcatatctgtggggcaaaataccaggttctgtgggagatatggggaaaagccagtcacctagagtgataaccctttaccattcatcttaatgttctttttccattgcccagggttgaatgaaaattgcatttaaaaaccgacagattatatgcagagacctctcttatactatcgtggttttgtgtataagaaaaagaacccttttattctcaataatcaggaaaacaaactatgctactaggtttttctgaaactgtcaagataaattaatgaagtaaaaactggagttatgtgtatatgtagacagatagataactaaccagatacaccgttactgacctcatcaacttgctgttccagcttcagatttgctttgctcaggctgctgagcttctcctcctccatgtgcaggtcatccagggtctgctgatgggcctcctgcacaaccttggctgctctgttaagtttgctgatatcctcatttagaaactctacttcctcagtcaagttcttgacctgtgggaagaagatgacagcttcattaaagccactgctggaaagttgggcataacactgagggtcatttctcttctgtcgtccaaaactacgcatgaggtatccaatgtcacaaaaagctgtatttagccaaattcctgatacgctttctaaagctacatttagtttttctcccacaaaaatgatctgttatctgtcatggtgaggaaatggagtattctgtttaaacattaatatgggtaaataattaacattatttataattatttaacattattaatatgaactaaattggatggccaatttaattcacattattatataacagtaacaacactaaaagcaattgcaatttcttttgaggagtcatggcatgtactgattgtgttgtgcctcagtatcccaagaaagtggcagttaaagaaaggttccagctgataaaacatgcaaacatggaagttgactgtatcaggcccatgtgctttttatgaaagggaatcaataaaaataagagtgctacttaatagcctgccaaaattacggtgtcactttggagattgtgtatcagaggcttgatgcggactcctcactgtcctcaatccacacacagatgcgcaagttaaaaccctcaaacaaactctcagccaaaacaaaacatgaaagcccttaactagaattaaagtgacatcttcaaggtcaaactccaaatcaatgacacagctggggactcaggcacatcccaaattatcttttagcaaaccatatcatgctccctctccttccaaaaaaaaaaaaaagggttcttacaggcccgatgaaaccattttactctattacagagttcagatgcaataggattgaaacaaatgaaaatgtttcatttgggagattaaataaggttccataagttcaaattggaaatctgaattgggacagcatagtttatcagactctatattttgtgccagttctgactctcaatgctgtaaagttgcaggccactgtgttaattaacttgaatagagcaagtcagataccaaaacctgatttgagagtggaattctggctgctaggccttcttaactaacattatggaaaaagtaccttgtgctctgtagtacgcttctccttctctgacttcaccaacattgtttccaggtcatcgatttctttcttcaactcaaaacattcatcttcgagtttccgccccctggcagtcagctcagaatttatctcctcttcttcctccaccctctccgacagctcctttactctggcctccagctggatcttggatttaatcagccactcgcactgctcttcaacatttgccagtgtctcttgctcctgccatgatgaggagaaaattgttgccaacagctggaagtaatttatcagctaggcgaaaatgctgcttaacacacagcaaagagataattgcctgccctctgcccagcactttcacctacctttcctaaacagctgcaataatattcccaggtccctgatccgatcactgagaagtggagaagttgcttgtgtttggaggtgctttcaatctctcaggccaattcagtagattagattacttcttctaaagcacttaatagaatcctggtggcctaaaggagctagcatgcctccaaaaatcagtggtgtgctgcttaaaccacagcttctggaaatatccatgtaggcacagagtttgaggttgataactgctcaggaaatcatcttttaagaaagcagagttccctctgaatattgcactgtaactgttataagtgcatggatgtacgtgtttaatatacatctcttctaataaattgagctgagtcatatgttttttaaattcataggctaaatttagaattcataaggttatttgcaagtcactaactagagttcactgttatttccaactaaaatttttgcctcaatgattctgccagcacggagttacacaaagagcatgtggtactctttcatttatcctttcacaggcactgcctccagctcttactgggtgacccattgtttctgtgttatgggtcaagtaaaaagcaaaggggctttttactacagagcacctttcataactttagacccctctaatttgtcttctttattggctaaataaaacctcttcttcatgagcaagttcttaattgttgcgggtcttgctgtaatataactttacatacattttcaccttccatctcgagacctcacctatccttcataatatgccagtttgggcaacatattaatgatccatttgcctcacttaacttgtgtctgctaattagatcaagagtggggggctggggggaggtaaaaatccaggctattggcctctgagtagctcctggctggagaatggctgcctacccagcaaacggggctcaaagaagcacagatggagagaggtatagaataataaatgtacaacttcactgaaaaccccagaacaggggctaaatagaaagaagtatcaggacatttaggaagggtcaatgcaaatcagagaagcttccaatgtatgggaaataatggggacattttatcttagttcaccccaggttgacaagcagaacagtttttgctgcattccattcagcctgtatacaagacctgtcaccatcactgaacaaagaggacagtccaatcgaccatcattgatctcttcattaaacatgacagcaggatttgggggctgagcaatggtgtggcagtttagcagtaggaagattctttccccaatggcagctctctgacatactcacaatgttaattgaaatggggtcactcagttctgctggaattttgactaagcaaagaaggatttcaaaatatttcttttttttttttttggattcttttgtgtttagctttctcccttaaaataatcataaatagatattatatataataatatataatgatagctctgtcaacttcttaatcacagttacaatctgaactcatctcagccttcttgggtttgctctagagtttgcttccatgtgtttcccatgctccctacaatgacctttgacatgcatatcaagcttttgtctaccatgccctacacaagctgggtccatttctatctcctgcatcaccccaggtagcactggctactttccatcagtaggaagaatgatagaaactgggaggcgaggtctcaaccaaagttacctattccctaaaccaaaatattttacaaattgtgattcttacagtttcttacagtagctttgaaatggggcccaggaatttgtatttttaacaagcataccaggtaagactgtatacattgaagttgtagaatcactgctatgttaaatacgtatcagaaatgggggtttgggtgtaaagtcttacataaaatacagcctgttggcatgctggtagataatacagctccaaaatattaaaaagtaataataataaaagaataacttgtgtcagtctgaaagcactaaattttctgtttttagtagagtttaaaaacaagaaaaactgttgtttcttgtttaaaaagcaagataaattatatttgaacacagcatttttcaacttaatgctgtgctaagtagagaggaaagtattataaaggtggttaaaatttcatcctggccctttgggctgtttcaggatcacagtagtccgagggctagggaggagtaacatgaaagagagtgagtaatgacacgttagcatcatactgtagacagaggcttgaatgccaaaaccaggtgtttggaatctaaaaatgtatgtattatatgatctgagggttgctcacccataaagcgacatgatgcttttttaaagacaatggttcttaatctggactggatatcagagtcacccatagagattatttggacccacacagagtctgcttaatcaaaatatctgagagtggagtctaggcatctttatttttttttttttaatgtttcacaaataaatttgatacaaagccaaggttaagaactgttttaaaaactcagctcattgaacaatgagaacacatggacacaggaaggggaacatcacactctggggactgttgtggggtgggggaggggggagggatagcattaggagatatacctaatgctaaatgatgagttaatgggtgcagcacaccagcatggcacgtgtatacatatgtaactaacctgcatattgtgcacatgtaccctaaaacttaaagtataataataataaaattaattaattaattaatttttttaaaaaaagctcattagtaatgttgatttggacccaggaaggggaagcagggagaccaaaatcaggatatccgactagaagcacactgcagcattcctgaagatctcagtcaagcttttcttgggacctactaaaatcctgtctgctgatttgctaatgggtcatgggctacatagaaactttaaattaagacccagagcttcctggcctccatgatgtgctattatacagtaaaaacccatctgataatttgtccctttttaaaagacatcttgccaattaaatcacttcactatgaaacagggtatctctttgttttcattgtctttggttttataaaatcctttggtatttgaaaaccacatgcatctatttttttgtttccgtgtcaacactgcctgcttaacaagggagtctaattaaaaacttgatttaaagaacaaatggtggggctactcacagcctgaagctgaagaatcaggtcatttttttcctgagtgagggatacttgctttgctttcagttcctccctctgaaactctgatttctccaaggctttctgtaattgtgcacactcttccttcagtccagctacttcttctcctacttctgaagatttaacaagaggcttgatcttgaagaagagcctcatccagggccagttcttcacagccatgaaagctcttatgttccattggatcaaaataagtgcatccctaaatcaagaaagaaaaaagaaaagcaagttagccctgactataggagaattagttcccaaattaagatcctcaataaacacatatttttaggagtcataaaaaattcttattagtcttcaaagcacttttatatctggactttcacttgattctggcaaaaactctccaagggatatctggggttagcagtattatggactagatatcctaaaaatgttcctaccacaaacattctttgaatgagagctgaacctaaagagagtaagacatatagaaggcaccaaaaacttgaacaataagtgaatgcatgcatagcttggccatctttatggaaggaggaaacaagtcttggtattgtaagagtttgtattttcatattcacatggataaaaaggcaaggcagaaaccttcaaagaatcttacccttaataaaaaggaggactgaaaaatccacctaccagcaaagagagatatcaaattaaagcacatctgatttggtgtgagtgaagacaaatcctgcttcagatttttttttaatgatccagtaccactgaagtatttaaggtctaaattatactgcctgaatgatacacaaatatccaagaaattagcacagtgatttttttactgataataaataccttttcaacccttggggtaggaaaatacaaaattacactgaaaaaaaaataccttaaacccaagcaccagaagttctcctacataaggccccctgaagagggcttacaatccaaagttacaaaccacatataggaaaatgaagttgagtgcatataataaaaagtttgatgaaacccccaagattttcagataattgaactatctgatggagactatcaaataattatgttaaaaattattaaaggtataaaggaaagaactttagaaacaatgaaccactatgacaaaaggacacacagatttgaaagaagaccaaataaaatgtctaaaactaaaaaacatagcagttggaatcaaatactcagtggaaaaattaagcaggttattagaaatactggggaaaaaaaactagtgaattgagaaaagaataaacccccacagctccagactccaggatgacccttacaacctcaggttccaggcctgccccagtgccagtccagacatgcagccccagactgcaagcctacccccagtgacccagactctaggaccatcccaataatcagtccagtccccacagacccaggccccagacctatccccatgaacccagtcaacaagggtgttccagtagatcctaaccacagactgattctcatggccccaggatccagacataccctcactaagtccactaccatggacttagacaccaaggcctgcccatgtggatctaagatctagtgtatacagcctccaggctaatcttcatggacccaggaactgggcctgaatgtgcactgaaactaccaccaggccatcatgccccaagactccagcagcattcctgccagtggacaatgccagctgggctgccaagaatctctgaccaagcttactgctgaagaggttttcctgttgaagccagcctataaagaccaaaaggtgtactacttcaaacgcacaaacactaatgtaaggccacaaggatcatgaataatcaaaaaaatgacaccaccaaaggaacaaaacaaagcaccagtaaccatccctaaaaaaatggagatctacaaagtaacaactggagaaagcaagaaattacaggcttctgaaacaaatgcacaaacaaactggacacctggagcggttagcaacaacgtcctaaaatctctagccaagatgtctggtgaagattttgcccagtcaaagccagtccataaacatggaggaggggggatgctgtttcttcaaatgtacagacatttatgcaaagctataataaacatgaagaatcaggaacacacaaaagaataaaaagaataaaataaatccctaaaaatccaacctaaatggagatctatgaattgctgacaaagaattcaaaacaatgatcttaaaaaaaagtttagtgagctacaagagaacaactaaacaaagtgagaaaaataatacatgaacaaaaggggaagttcaacaaggaaataaaaaccataaaaaagaaccacatagaaattctggaattgaagaacaaaatggctggactgaaaaaattccatggaaagtataaatgcaatcaaggggaagaatcagtgagctcaaagacaggtcacttgaaattactcatttagaggaacaaaaatgaaaaacaaatgaaaagaatgaagaatgcctacagcacttgtaggacatcggcaagcttaccaatatacacattatgggagttacagaaggagcagagaaagagaaacagaaagcttatttaaagaaacaatgacagaaagcttttaaatctggagaggaaaacgaacaactagattcattaagcccaaagaaccccaagtagatcaaatataaagagatcttcaccaatgcacattataatgaaattctcaaaagtcaaagagagaattttgaatgcagcaaaacaaaagtaacttgtcacatataatgaaaccctcatgagactatgagcagatttctcagcaaaaaccttgcagaccagaagagagtggtgtgatataaccaaagtgctaaaagaaaaaaaaaaaactaaaaaccaccaaccagaaatactgtatccagcaaggctgcctttcagaaatggagagataacagactgccacacaaataaaagctgtgggagtttatcgtcactacttgccttacaagaaatgctaaagggtgttcttcaagttgaaacaaaaggatgctaactaaccacacaaaaatatataaaagtgtaaaactcactgaaaagaatatagtcaaattcagaataatactgtaataatggtgcataaatcacctttaactctaaaattagttaatgtacaaaattattttaaaaaactatagctataataactgattaatagatatacaatactaaaaaatattaaattgtgacataaataacataaaatgtggggacaagataagttaaaattaagagtttttatatgtagttgaagttaaactattgccagcttaaaataagatgttgtcagccttaagataaacatataactacaagatgttttatgtaagcctcatagtaaccacaaagaaaaaacttctagtaagtattcagaagataaagagaaaggaatacctagcattacaaaatattatcacatcacaaaggaagacagaaagaaacaatttttttaaaaagttgtaaaacaattaacaaaatggcagtaagtctgtatctattaataattactttaaatataaatgaaataagttcaccaatcaaaagacagagtggctgaatagaaaaaccaaacccaactatatgctgccaacaggagacatactttagctttgagaacatacacaggttgaaagtgagaaatggaaaaaggtattctatgcaaatggaaattgaaaaagagcagggatacctatagttacatcagataaaatatatataagtcaaaaactgtaacaagagataaagaaagttattacctaatgaaaaatgtgtcagttcatcaagatgatataaatatctttatatttgacaagatttaacatccatccattcatccatcataaaaattctcaacaatgtaggtatagaaggaaagtactgcaacataataaaggccatatatgacaagcccacagctaacatcatacttaatggtgaaaaactgaaagcttttcctctaaggtcaggaacaagacaagaatgctcactctcaatagtttttttcaatatagtactgaaagtcctagccagagtaattagcaaaaagaggaaacaaaagtcattcaaattagaaacaaagaagttaaagtatctcatgtagaaaaccctaaaaaccaccaaaaaaacagaattaacacgcttgtaaagttgcaggataaaaaaatcaacataaaaaattagtaacatttctatatactaacaatggactatccaaaaaagaagtcaattcataatagcatcaaaaattaaaataaaatagataagaataaatcttaccaaggaggtaaaagagctgcatgttgaaaactataaaacattgataaaagaaattgaagacacaaacaaatgcaaaaatatcttgtgttcatgaattggaagaacacaggatatttttggttaaaagtccatagtccccaaagttatctacagattcaatgcaaacccttttaaaattccaatggcattttttacagaactaggaaaaattcctaaaatttatatggaaccacaaaagacctcaaatagccaagacattagaaacaaagctggaagaatcacattacctaatttcaaaatatgctacaaactatagcaatcaaaacagcatggtattagcataaaaacaaacatatagtccaatggaacagatcagagaacccagaaatcaatctatgcatttatggttaattgatcttcaataaagttgccaaaaacacacagtatggaaaggacagtcttttcaataaatggggttagtaaattagatatccacatgcagaagactaagtggatcctcatctcacaccatatacaaatatgaactcaaaatgaactaaagacttaaatgtaagatctgaaactgtaaaattaccagaagaacacttggggaaaaagtttctgacattggttttggcaaatttttttaatgtgaccccaaaatcaaaggcaacacaagcaaaaatagacaatgggattacatcaaactaaaaagcttctgcatagcaaaagaaactataaacaaggagaagacaacctatggaatgggagaaaatatttgcaaactatacatgaaataaaggggtaatattcaaaatttattaggaattcaactctatagcatgaaaacaaccccattaaaaatcagcaatgacctgatagacatttctcaaaagactacaaatggccaataatatatgaaaaaatgttcaacatcactaattatcagggaaatacaaatcaaaaccacaatgagatatcatctcacacctgttagaatggctactaaaaaacaaaagataagagttggcaagtatgtggaaaaagggaacccttgtacactgttgatgggaatgtaaattggtacagccattatggaaaacagtatgaaggctcctcaaaaaattaaaaatggaactaccataggatctatcaatcccattaatatttcaaaatactaatgaaattagaattttgaagacatatctgcactactatgttcattgtactattatttgcaatagccaagatatggaatcaacctaagtgttcattgacaaataaataaagaaaatgtgtcataaatatacaatgaaatattattcaaccttaaaaaagaaaacattgtcatttgtgacaacatgggttaacctagaggacattatgctaaatataataagccaggcacttaaagacaaatacagcataatctcactcatatgtgggatattaaaaaagtcaaactcacagaagtagagagtggaatggtggttaccagcagccagggcatggggaaaatgaggagatgttgctcaaaggacacaacgtttcacttatgcaagatgagtaagttctgaggatctaatatacagcatggtaaccacagttaataatactgtattgtatactggaaatttgcttagagagtagaccttaaatgctctcaccacacacacaaaagataactttgtaaggtgatgattaatcagtttgattgtggtaatcatttcacaatacctacatatatcaaaacatcagattatacgccatatatacaatttttgtcaatgataactgaataaagttagaaaaaggaaaaaaataaacacaaagaaagtagaagaaaagaaagaataaaggtaagatcagaaattaatgatctagaaaaaagtttaagtgatttattaaatagactaaataaagatgtggcatgaatgttcaagaaaaaggagagaagccacaaaaaaatactagaaatgataatactctagaaatataaataatttaggattatgctctaggaatagaattagagatacagtagagatttaaaaataataaggccaggtacagtggctcatgcctgtaatcccaacactttgggaggccaaggcaggcagatcacgtgaggccaagagtttgagaccatcctgctcaaaatggtgaaaccttatctctactaaaaatataacatttagccaggtgtggaggcacacgcctgtaatcccagctgctcaggaggctgaagcacaataatcacttgaaccagggaggcagaggttgcagtgacccgatatcatgccactgccctccagcctgggcgatagagagagactctgtctcaaaaaataaaataaaataaaaaataaaataaaaattgatcaaattgaaaaattcaaaagaaatgtaaaatttttttaataaaagaaagctttcctgcactaattcaagaagaaaatatctcattagacatgtaaccaataaataaattgaatcaaaatataaaatctatcacaaaagaaacaccagatccagatgattttactggcaatgtctaccaaagattcaaagaccagttataaactggttcatgttttgaagagagaaaacattcttcaactgttttatgaggttaagataaccttgattcaaattcagataacatagcagatgaaaagaaaattacaggccaatcttattcatgaatattgatgcaaaaatctcatggtgatattacaatcaaacccatcaatgtatgaaaatatttcttaaccaaagtaagtttaacatttttaaaaatctgttaatatatttccacacatttatagattaattcagaaaaaccatgtgattgtttcaatagatgcagataaatgattaaataatttcctgataaaaatgcttaacaaaataaaatagagggaatgtccttcatataataagtcatttctacaaaaaaaaaaaaaacctacagaaaacatcatttgttaaagggaaatgatagctttccccaaagtcagaaatatgaagacatttggcaaaagtttttaaaggctgatataccacaagtgggtgagaacatgggacaaggggactctcatacattgctggtggagagtatgatatattagaaagcaatttggcaacatcttgcaaaattgcagttgtgtgtgacctacaacctattattaattcatgccctagagaagtgccactcaaagtgtgtgcctcagaccagctgctatccacaaattgttatcagaaaatggagtattttgagtaatgatgccctcaagaaactcttatgtatatgaatggggagacatttacaaaaatatcactgcagaagttagtagcaacaaaaaaaaaggaaataacaaatatttactttagctggaaaattgataaataaattatgatatatttatataatggaatactatacagcagttaaaatcaataatctagccctagattcattaacattgatatatttcaaagaataatactgaatataaaagacaaacttcaggacaatatatacaaaatattatttacatgaagactaagcacatgtaaaatcatgtcacattttaaggatatctgcatatcgagtaagtaaaggtatgaaaacatacttttatataacatatataaaacatggaatgagaaacacaaactcaggatctgagaaggaaaaggtaagacttggattacagcagaactatatggaggcttcaactatatatgttaattttttttaatgttgttagcaattacagaaaaaaaatattgagttggctgggtgccatggcccatgcctgtaatctcagcaatttgggaggctgaggcaagaggattgttgagcccaggagttcgagaccagcctgggcaacatagggagaccctgtttctacaaaaataagaaattaataataataatgttaagaattgatatatcttcatgatggctccatgagtatgcattatagtattttctgtattttttatttacttgagagctttcacaataacttttgaagtcatgatttagagagaatggatcataaaggcttcactttagacatgaagaaagtaaactatggagaaattcagaatcttactcaagtttacacaactggtcctagaagccatgttctgtgacccccaaactcccataccacattgaccactatatgagagtcacagaagacccttaagagtcatctctctaatatctttgacatcaccatgtaataatctttttctcttgggaaaaaacagaattaacaaattgtcaattaaacaagttacaccaagatctgtagacctttcttcagaagacaatatatgctaacgaaaaagtaaatacaacttcagcatcccttgctcacagtccctttgtttggagattttgctagcttgcttttcatgattctattaaacaatagacaaaaccaatgcctaagaatgtacaagcatggtgataaatgtccctagtgaacctgtctgaaataaagtaagaaagttatgattacatgtcaacaagagccacagtttctgacccaggggaggtaacaaaggggtcagaacacctcggtctttgaagcacacttccccaaagagttggctgtgggatatatgcaaacctttccaggtctgcttctgatataaattgtgagtcacaccactctcagagatccagacttctcagaacataaaaatctctctcaaagggaagcctgaaagcatgacaagaaatatctgaattatgcttatatttggttgaatagggcaataaaagccctttgcactctgtccttttgttatctcatgatttaaaaatgtttaagacccagcctaagcagaggaggcagctcttgacctactataaggcaatgagattagttgcactggttgaggcacactattaccctagcagttggggagcagggtgggcatataatacctttcttccagaatcttctggaatttgattcgcatcagtttgccctgtgctctggcttggaacaatgtgaagactttagatagtctctcatctcttattgcttccagttggcccagaaacccagctttaaaaaacacctaaaggaaaagtcagatgttagctccactgataatgggtattcagcaaatgtttattaaatgatcctgtgagcaactgttgtgttcctagggataactgtatcaattccatttcttgtaagttttatttaatgtgtaaaatctacttcttagaaagtttgattttataaatctaaaatgtgaaaaaaaaaacgttattaaatcatgtggttctattgtttgcctaagaacttaaactattcttccccttatctattaataatgtctcaattgtttagggaacctggtttaagttttaagatgggctcaggcatgcagtgtgccaaagtaccaggtagggttctgcaaacattttctgtgaaggatcagatagtaaatatttttaggctttatgggctatacacaatctctgtaggatattcttgtttttttaaacaattcgtgaaccatctaaaaccatttttagctagtgggccatatattaaaaaaacagtccatggacatggctcttgggccatagtttgctgacctctgttctagagtaaggcacttttgtctaggcatcaaataatccacaaaagtattttttcaagaatgattactaacaaacaaggtgaaatgagtgaggtgcctaaagcacacattttatggaggcactaagtgtgagagtgccctgagagtgtgtgcctttcaacctcacttgcccaaccctgagaatgagagcctctttgaaatttgtgccttaggagtttcacttgcctcaggtcaatcttggcccagatgaatagtatacagtaaaaataactaaacacacaaggaaggaaggcatcatcagtgaaaatcagcagaaacaataaacagcagaaactgattctcaggtactcaaaatatgggagtcaacattttataaccatatcctacagagttctaattctatgaggtctttatcctgaattttttaactctccttcaaataatttgttccttatatgaatgtcattaggaacaaactgatgttgactgccagataacaccaaatctattgataagttagaagtttcccaaaatatgtgagtcatgccaatatcatctaagatgaagtagaatttagggaatcacatttaaggaagttggttttggattaattttttgatagtgggttaactttaaagttttaaattactcagaaaaattagtccctaagagaatactgtccctgaaagaatatggtggatgaatcagttcacacacagacaagccattagctccaggaagctgattcactttttctagctctgatatatacacattttctcataacatcaggttgattcagtattttatatcttgacacaaatttgcttagttgactaattataaaaatgtaaatgtagtcaaaactgaggtttaaaaaacattgaatatttttctcaaacagcaccgaagttttcaccttcagctaagatctgtttgtgatatttatggtcatgagagctgaagaatgccttataattgagcattcacaggtattttaagatacacagtcttccccccattcgtctccaaatgcattctttgcagttttctggttaccttagtgattccaaatcggtactgggtatggtctatctccaaggagccaagtaattcttcagctgcttttctgctgctcacaaacttgctctttggaaaggtccttggattcagaatgcagtacctaatttaaaataaagaaaaaatcatgagtttgggaaatcatattattcaaataaagactaatctagacaaatgaggtgaaaggagacatagatttttatctctgttactaatatgttcaattttcacaagattcttagtaacaataatgagggtacaagcaataatcccttgcattggtataatagtttgtacttttcatattgctttagaggcaacctcatttgattgattgctcaattaggcaggggcaggattggaagaggaaagagagggagggaggaaagcataagtatctctactgtatagataaggaaactgaaaagcagagacattaaatgtcttttccaggattcctttaccctgttggtgagttggtggaaaacaagaaatatgcctcctaattctaaagcaagaaatatgcccctttttactctaccaaactttgctcaaattgatttgatgacctataatttaaacttctagaatccaagaaatagaaaagatgccactcctgcctcctgccatacaccctgctggcttccttcctttcaggggcttgctagtaaagccacagcctgcttggatagcagctacgattaagtatacacaacatttcagagattcaattcagcctccatatgtttcttctgtatatatttcttctatatgtgggtctattatctttgttaatagagatttaaggatattacagttacatggatgttggatttaaggggaaataataatggaactctgtcatcatatatcttcccaccaccaaaacacatcgatttgtagtctggaggacatcaaccaaacaaacaatgcatgcctaaacactcggaaagggaggaaaacagaatgaactgcctcaggcttcttggatcctagaatgtaggtttacctttgtttaaaatcagcatactgcagtcggtttggaaaaccttcacggcatatcctagtcccttccaagacaccattacagcgcaactgctgtagaaccaagtaagggtccagtatacctggaaaaaaaaaagagtcatggtggatctgtgcctgaaaaaaaattattgggacagattttgaaccaattgctgcatcttgggttaaaaagaaagtctgaattggatagtttccacatgataggtcatagatgttcactcacttatggcctgatagtactcacagtaatcatcctattatgtaggcatctccaaatatgatttccctgaaattcctttaacatggaacaagccccttaattcacagtcagatgagatgtttataagcaaatattcttggaaggcaaaaagattacattttttgctagaatgtaaatggctgctctacgttcatttgccaaccaaaaccagccagaaagggtgataagaacacaaaagagaactgccttctccgtgcaggagggggaagggataagaacaaggaagaataaaaggaaaggggaagatagacacaaccacaacattctgtttacagttttgcttaggaaggacctgtccacatcccagacttcattctccccttattttcatgagagtgcctaaattctattctgtagtataagcatccttctgtcaccttctcgttcatcaaaagaagctctactgcagctgtcagctgcaacgtccaatagaagcctttgaaaaaccatccaagaagccactgtccctgccctcagcaagtcttctgaaagaagccaaggaccacatctcctaacacaaattcctactatggtattacatgaaaaataaaaaaaaaaaaggactccatgcccaaggtcacagaaataaacttaaatcatatacccatatttctatactcgaatccctttcacagatagaaacagatgatgtataagaaggcacaagtaggctggcacagcggctcatgcctgtaatcacggcactttcagaggctgaggcgggcaggtcacttgaggccaggagttcgagaccagcctgaccaacttggtgaaaccccatctctactaaaaatataaaaattagccaggcgtggtggtacatgcctgtagtcccagctacacaggaggctgaggtacaagaattgcttgaacccagaaggcagagattgtggtgagccaagatcataccactgcacttcagccactgcactctagtctcagcaacagagcaagactctgtctcaaattattttttttaaaaaagggaggggtacagggagtagaatcctatgacaccttaacatcagactcactcattctctttaagtacatatgaataactgttttgattagatcatgaagcttttcttatgactttgtcttatgactttaagaaaaaaaccaaacctgctgaaatccaagttgactcgatgggaagcaactctaataggtaacagaattgctccaaaatagaactcagctaattagattccttgatagatggaagcagtgtccctagacacatccagaaacccagctgataggaaacaatgaggcacaaacatacagccgtgaatgaacatgaaagtatttgtatcgcagaaactcaaactgcagcatcattgttttgtatcacactttcccaaaataggccatagactgtcaggattggggtcttaattacaggaggttaataaaaatgcaagctactatggaacctcagagatcagaaccagcaacatctggctatgtattataagggtggttagtgctctgaagacatagggcttgtcatatacattccttggaggctgacagcctccaaaccaagctccagaggggccagtaactccaaagaggtggctgggaatcttcaagctcatgaagtaaggaaagcaatccatgtagttaattttggtaaaacccttgtttggggaattgaaaacattaaaaaaaaaaatcactaccatccacctatcacatcatccccctaccactattcactgatcaaaagatagccactacccagagttacataactaaaaaaaaaaatgaatgctattagaaagagggaagaagatgttggcattggcaaggaggactagagggtgttctcaacaattagaaatggatttaggaagtgtctttatggtcaatttagataactcagaccaaataacttcctttatgctgaaatatctaccttaatcccctaattgattattcaattccatttttattatagtttgtccttgtagacaatggcatgggagctcactcatgttcagcataaaattcaaggaagaatttaaatagtaatatcaaacattctaatgttgcccaattgagaccgctttgtgaaacccttctgtacatccatttcaatggcaatattgaggaggttccaaagacctcatttttaacatattttcatttttctatatgaaattctacccttatataaaaggcaccaataaatatttctttaaaagatattcaatatagctaatatcaaatctatttcctagtgtgaattacaaagaaatctagttcttacctggtattttgttcacattgggatttatgcatctcacaaaatgaggtgctgttgatttcagattagtcatcaatttattcaggttttcctaaaatggagaccataataaacacaaaatcactttgcaaatcactaaaaacaccaatccacctcacaaatgtctccaaatctatcaacttaatctcacagccaagatgtattctaacagtaaaataatgaattcaacattctttactgcctaccaaatgcacattatttctttcctatggcaagtcaatatttatttgacagacatagttaaattgtgaatcatctctacctattttgaatttgatagcaatatcaaagttatggctgggctataaaatggcttgaaaaaagaaattgtttctcaagttctctctctgtggaaaacctttatcttaggtcagattctctagaagccaaacctgagatgggaattctggttcaagagatttttagggagtgaagaaagctgggaacagcaggggaagagaaaagcaatgattcagactcagctttagtctgatccttgcaagcaagagctgtaaacacgaatgcaccaattgcagcataggtggtctcccttgaggcaagggagaggctaaagtctggagaggagggcaaagaggcagcttagtttcccctttggctaagtgcaattctgacaactcagagttgttatgagccaatatgcacatcagctggaagatgggtgcaggcatgataaaggggatgtaagtgggaacaaacagtgtcctctaaagcccttgataataacagcataaacttcaacttttccaacttgctagctcctgatactttatccttatttgaagatgtgaaatgtcaactaaataataacatatgcagattgtgaggcaattaatatatgaatagacgcaattaaaaattactttatgcagagatgcaaccgtttggaatgaagctcctttctttcgtttcttctccccaaatggtatagctagcaaaaaaaaaaaaagaaaaagatgaaaacatgtaaaaagctcatttttatcacattatcctaccccactgatggaagcataaattcaccagagttctagaacaatatggcaatatctaccaaaagcttcaaaatatttatgtcttttatcacaaaatgtatatttttagtgtttttccttaaggatataatcaggcaactgtgcaatgatactcactgaagcattatttagtcattgcaaaaaaattaagcaaaaataaaattcatcaacaaatgcacatcataggagattaatttatgagagaatatgcatacagtgaaacactgtaagcttttaaaatgatgatgtggatccatataacttatatggaaagatttctaggatgtttttagataaaaagttagtttacaaagcctaaattttatatatgatgaccctgagtatgtatacatgtttttttaagtgcagctgtgttataggtgactataaacatgaaaaatgttgggaggtgtaaataccaaaatgtaaacagtttgttaatctatatgagattacagataatttttatgttcttctttcagtttttctatattgtctgtgtttttagcaacattcatgtatttattttcatgatttataaaaaataataagtctatttccattttcttgaagaaaaagaacctgtgctaggccaaccagctttacaaacatttgaatagtgctaagttactaagatgtgcaacacagcaacaacaaaatccataggcaagctggacagaatagggtagctgtcaatatggaaaactaataaaatattctctgcgcctgagtagcaactgtgcgatggcagatgtcatgaagctcaatcactaatgttcttttgaaacaccccaggtctctcagtgaaacacttgacttctttgtacttcagtttttccatctatgaaaagggaataacactacctttcattaattttttaaaaagaattataaccctggtttaaattatttggattccccaggagaaagtatggttatcacaagcaatttaatgttcagatccgtcagaaacttggaggcaagtattttcagagggtgcttaaagaattatttaaaaaaaaggccattctgaacaattcttgtcttttagttccaaagaacacagtacacaacctgaagagttagaagacgatttctcctctaattctctgcccaaaccattctctgatctcttatgatcagagaattactcaaatgggagtcataagcttatgtggctactatcaaacagacttctcagaggtactttagcagctattagaatcaggcaaatgtactgcctgaagattagccgggtccagtcacaatagcttccatctcttcttgaggcaggcccagaggatttcaggcatgttccagaattatgtcatcatgtgctgatgaagccagaaagtgctaaattttctctccattccctatgtcagtcgagagaaccaatcagcctgataggggctgggagttaacatgcagctgggtgtaagataacagcagggtatgttcgaaagtgagagtacacaccccatttaaagaacagttggtgtactgttgccatggggaaatcagaacccaggctggctagattatctatttccccagaatttccatttttcaaaagaaaacggaaactcaaatgtgcatgtgaaatctgatttttttagcttgtgtggaccaaacaaaacgtgtttgaaggccagtttctgctcagaggctgtcgatctgtgacttttgctgtaaatcatggagagcttccctctgtatgtagttagcatttcgttcagtgaggctggtgttaacaactttggctcagtatcttcaaatccatcacatgatggtgcagaagttttcactgcatcgtaaatgcatgtagcctgtctgtctctgttttgttcattcctgggagacagtgagtagaataggcactaaactagaaaacagaagtctatctttctacctagccttttgccatatagtagatttgtaaaatcagggatgctacttaacttctctatatttgttcctgtgagaagttaagtaggatccctgattttataaatctacgacatggcaaaggctaggtggaaagacaggaacattctgtatatatcttaaagtgtcaggtaagaaatgagtaagataatgtatctaacagtactttgtaaattacaaactactaaacaagattagttgtcagaatagaatgcctgttaaacaggtatttgctgcatgctagaggctacagttgaataaatcagacataatccctgccctcgtgaagcttctaataaccctaagtgcacagagtgctgtgaaagagaatattctaagatatttggggcaataactataattatatatatatagttatatagatatttgggacaataagttattgccccaaaatcattcatcaaaacatgttttttgttttccctttgtagctaggtgaagtagaagacaaaagcaggccaggaacagacttcttgaatctatcttagagcactagtaccatctccctgaagaacccccagcctgaagacagaaagactaataagaggggacgactcagaccacagggagcagaaacatatcacaggaaagaagcaagaatttttgcaaaagctgaggcagccatgggttccattctgaggctgaaaaatcaaggaagattgtatgactcaccactgtcagtactcatgtaattttcaaaaaggctcgccaggagtctgttggaagacttctgaaatacagctaccactgtttcattaaggaggtctttgttcttttccagccaaccactgatattataaggtacctttggaaaggcatgcatttcaggttaaaaaaagaaaaaaaactgcataagttaacatggaaggctgtgcattacccctttttttttttgagacagggtctcattctgttatccaggctagaatgcagtggcatagtcacagttcactgtagcctcgacctcctggtctcaatcaatccttccccctcagcctccagagtagctgggactataggcacatgccaccatgcctggctaattttttttgtatttttatttattttgtgtatgtgtggagatttggtttccacatgttgctcggtttggtctcaaactcctagggctcaagcaatccacccatctcagcctcccaaagtgctgggattacagggagccaccatgcccagcctttgcattacttttaataaatcacaaattatatgggtcctttacctttaaatcagtttaatgtaatagtacagaataacctccaaaagcccattgtgcagcccagaaagattctcaagattcttatcattaacattgtcaaaagaaaggaacagacaggaagggaagaagggagagagataggggaagaagtagaagagaggagagaaaagaaaggggggagagagcaacagagaggaaggaaggattgaatggcatttcacaccagcagtcctttaaaggcaagaatggtgaaataatccaactgtctctgacatacagtgaacattcaaaaaaaaaaccagcaattgcaatggtattttactgtatatatcattataattaatatgccaggatatcaaagaagagaactataaacatatctgtgtacagctggcaggccatttttaggtcgaagtattattttatcttttatcaattctctttttgttccaccagagtcaccagccagaagtagaaatgcagaaaaaggggcatatacactggtgaggaaatgaggagaggtagcaagggtcattagaaaccgtttttggccatagtttggagaccattacttcacattgactatttctttacgggagaataaaaaaatcttcaacaaaaagatcaactgaaatcattcattcacacaacgttaagttaaaaggaaggacaaatgggggaaaaccatgactttgatggtctccatgcctttctgaagctgccttgctttgagttgaggttgacagagtccatttggagatttttgacctctgtgcacatggaatgctattgttcatttcctgagtgctaaaaggctacactaccttttttgtggaactgagatgtattttgttcttctcttcatttaatctaaacattacttaaatatcatctaaggactttggctgagcgcatttgaaacaaagtcaggaaaattcaagaccgggggtccagaggtaactcaccactcctgcataatggacaagttcaaaatgagcttcaaatttcttcttatcaggcttgggcttctggagatgaaccgactttccaaaatggttgtcaaagagtttggtcttgaaagtcaggtctgtagccttaggaaacatacactcttcttcaaggatggaaaggatgcccattggctgttgaagagacataagagcagcagatttctttaaaaacaccggcactttcagtagggggtcagtataaattctttcccaggaacctaatcagttgacaaagggaagaatattcactgcataaaactagcaatcatccattcaacaaatattaattaaatatctgctacttaataacgataccaatagccgctggtgattgatgcagctgtgagccacatatacaaagtgcctgtcctcagggtgcgtacatttagtggagtggcagacagtaggcaagtaaacaaagaaataactccaaaaaacaaatgacttagtttcatataaatgctctgaggaaaacactcaaagtaaagaagtagagaatgacagggggtaaggaggttttagatagagtcattgggtaagacacctctcctgaatgagaacaacaagctgagaagatctgtgcacaagtattccaggcagaaaaatgaagaatgcaaaggccccgaggccagagcccacttggcaagtctgaggtcctgccagaggccagtgtgggcagagaaaagctagcttgacggaacacattttaagagataatgtcaaaggggtaaggagcagctggagctcaaaggccttataggctgtagtaagacatgtggctttcattttaaatgtaataggaagcctttggaggctttttaaatgaagtgctgtgatttgatatatgcttaaagaggatcattggtttagaaagtagggctcatgggctcagtcctgcctgcactctgtactggaaagccagtgagctaagaatggcttttacatttttaaagagttttaaaaaacaaacagattgggtgaggtggctcacgccagcactttgggaggctgaggcgggcagatcacctgagatcaggagttcgagaccagcctggccaacacggtaaaatcctgtctctagtaaaaatacaaaaattagccaggaatggtggtgtgtgcctgtaatcccagctacccgggaggctgaggcaggagaatcgcttgaatctgggaggcacaggttgcagtgagcccaaatcacaccattgcactccagcttgagcaacagagagagactctgtctcaaaaaacaaaaaaacaaacaaaaaatgttactgcaaatctcatgacctccattagcacactttttctctaaaggaccatatagtttctgtcagacccttgccatccacttagtcattgaaacactgaaagcagcatgcaacaacatgtaaacaaaatgagtgtggccatgctcccatcaaacttgatttacctaaacaggctgcaggctagattgggtccacaaagtcagtttgctgacccctggtctagaatagtggtagtgttggagcttatgagaagtcattaaaaataagatatgcgtcaaatttagagctgagtgccaacttgctgatggagagaatgtggtgtgtaggaaaattttattgcatttatatagcgcataatttttaaatgcatttttacttttattagacttacaaatcctttacttgactgcaaatttcctgaaggcaaaaactatttataaaaaatgcttacatttttctacagcattttacgcagagtcttatacacagtagtgtggtagaaggcctaaaattaaggcccaacattatgtgtgccttgacatctgggaaaaaccaggaggggctcaaaagttccctttctgttgtgctcccatgtgttagatcccttagccaaacaccttccttatggcagggaccatacatagtgcctgcttatacctgagtaacgggtttcatttctctatcagcccatgaaattattcaaacaagcctgttgcatccttctgtaggattctattgtcacgtcacctataattactacaaagcctgcctcctaaagcccccgcttgttcactctattctcagcataaccctctcatggccccgcatggttcaaggtgtcccccctgcaggctgtgagcataagtggctaataaaatgctggtctcatctgtctagtgttggatgtcatatgttcagcctttcccataaacctagggcaggatttcctccttcagcaatggggtgaacaggaagcaaccaaaacaaatagttgcaaaatagacttacttattggtttaataaaaaataaaagcctctgttttaaggcttatttccaataatactagaagttcctggagtgccaggatgatgccttctggggtttgtacatcataacccttatcatagtaggttccgaggtaactaaagtgtaggccctcagcacatttctgctgagtaattaattgacaggtgaaccctgagacatacaggtctgagttctgggaacttgactgctttgctgtgatcaattatcaaacaaaatgtaagagttgccaatcaaaaaaaggatggagttatgtgtttaaagagaatactcatgtgcatacaagatacaactagatattaatatgattcattttatattaaaaacacaagaattaacacatctgaaaagcttcttttgggaggtgataacacataatgccaagatgctgccagtatttaaaatattttagaactttctttgggatacctgatactattgactactaacatgaaaaattcctgttgtctgatggtatatcattacatgctaggtagtatagtttggactcaaaaaccagtgaatgaaaagtattgaagccaattttctcttgaggctggtaaaattctaaaatctatcctaatcccaatatcgtgagaaattttccaaagagctaaattattggaagaagtatgttgccttctagggtgtttacaccaaatgaatagtaagtttttaaatgtataacttggagagtatttattaggaaataatagggaaaatctctttaccaatgccttatgtataaccataaatatgtaatcatatattaatactttaatatgtaaattattgatgtacaagttctaaacaaactagaatatttcaagtaataaaataagtatgagcaaatcctataataaatttgttcacagcacaaatgtgaaaggaggtcacggtaaacttgaagaccaaattaacaattaaagtttgtgttagaatacattttttactttagtttgatataaactttttttttttttttgagatagaatctcactctgttgcccaggctggagtgcagtggtgcgatctcagctcactacaacctccacctcccaggttctagctattctcctgcctcagcctccctagtagctgtgactacaggcatgcgccaccacatctggctaatttttgtattttgagtagagacagggtttcaccatgttagccaggctggtgtcaaactcctgacctcaagtgatccactcaccttggcctcccaaagtgctgggattacaggcataagccactgcacccagctgatatagacttttttgtaaacttacaaatatgaaacttttatgtaatgaaaatccttttttcttatacgtatacagagatgcatgttatacaacattttatatatattgatgtgttttagtactttcaaattttaaaaacatcccattatgcattttatttcaaggactgagtttgatcattaatatttgctacaaatcttcttcagatagccccaacgaacataatgggtcttttcaaaatttagaatcttttcaaggaaggctttggtattttcatttgcctgacctggatcctgttaaaattgtttgtagaaaaccaaagacttatcttttccttttatcatttggtcagtaattttttctcattttattatatcagtagaaaatacaacaggaaattacatccgtgatgctagtgtgttatttggaataaccaagactggcataaatgaggcaacagacttcagatcaactaaaaatcagtaacattcacagaacttgtcaggatctgaacaatgtctatgtcccacgttcctgcctgaaaacagtatcttgtcataatcaaagtgagtatatattataggtgacaatcgccagaagataaatctgttcctctgaggacctccagttcttttgtttcatttctaatgagacaactacggctcttataaggccagaatacataccacatcatagttggttcatctttatcactgtttttaatcagctcatgtttgattcattattaatatgttttaatcagcctgtctttcccccaggaagttcacttgttataaaataaataaaatcaacgggatatctactcctgttggaaataatagttattttcaagaagatctaaagcctaataaatgaaattgataggacacggattgataaaacccagggcttgcaaaggacagggagaggtcagttgccctagctccttcctagcaggattgttgagaatcaactgtgacagcatagctagagtattcaggaaatgaaaggcttcagactgcccagatccatcttgaagattcactgcaatccacgattatggcgaggcccaagaggcatgtaactgctaacatgccgccatgcttgctcccatggagaaagccacagaaaggaccatacgtaatcccccagcaaaccttgctcatctttcccagaacatgcagaaagatttcagagtattgggacatcaccaaattcagaaactgtacactgcagctaatttactaataagccatgaagtattgtcataaattacttaaactaactggtacttgtccaattaaatgaacaaactacatcctgcaaggtagtggccttgaggattgatggcagttgtttgtttgcatgctaatttgccaaattttgttaagctgctctgggtctactcattcaccttatgttaatcagttaggccctacagtgctcatatttttagctctgtgtttttccagtcaagagcatgaccatttttaaactcaacaagtttccgctcacgttaacagtggaggccatgcattagcatcaaatgtgcagtgaaagcctgcattagagatgatggagtggggcaactgacaagagagtttcgtttggatgccacaggtgatgcacacaaacaccattaagataaaatgtgcagggctttccgcccccatttcccatcctctgatagggcctaagtcctgacatggatcaacatagcaggcagggacaattctcccgaaatgaaaatggacaaagagaaaaacatatattaccttctcaatgagatctatgcaagcttgcaaatccagaccaaagccaatagacacccattcaatgctttctttcttatattcctcttgctccagaacaaacatgtgccaattgaagaattgttgtaatttttcattggtaaaattaatgcaaagttgctcaaggctattatacttcaaggatatgaataggtaagaagaagagataaaaataaaattgaggtccactttcaagaatgtccagtaaagaaaaaaccataaccattattatatgatcagaaatagacccaacaagtaacaaatgctcaattaacttaattaattgtaattttgaattgtaatatcattaagtacaattttctaaagattattacaataatatagcacttaatggtattaaaatttaaaatcataattaattcctttacctccatttacctttatgtaagccagaattaagaaatcaataaatacttaataccattaagtataacaataattattattgatattaattatagctcttttccaaacaaggtagcccttaaggtttgcatagaatgatccccatgctttgaccatattttcccatcttcaagtaacgttttctaatcttcttataaatatgcattgacttccttcttaccagatacacttacctcaaggatttcaaaaccagtgatgtcaagaatgccaatgaagaactgccttgacagcttggcatccagggccctgttgatccgtgccactagccacttaaacatcctttcatacattgacttggacagggcaccgacagcacaggttacctagaaatcacattgaaaacactccttcatctgactgaagtgttcattttaatcccgggcattctctatcagcaactgccttctagtcaaattaggatgtctttattgaccttctgtgcttccaacattctgctgaatacaatgagaaaaggaagaaaagaaagagagagagagagaaaaagaaagaaagaaagaaaaggagaaagaggaaggaagggagggagggaggaaggaaggaaggaaagaagggagggagggagggggaaaatgaaggggagaggaagggaagaaaaaggaggaaaggagatgggtaggagaaaggagtaagctagcctggtgcctctttatgaaaacacagatgagaggaatcatgttcctattattaaaggactaactatcccggggtatggtgtggtgatgtgtcccaaagccttgctattcaaagtgtgatcctaagaccagcagcagcaccacctaagagtttgttaaaaatgcaaactctcaggcccagtcccagacctactgaatcagaatctgtaagctaacaatccccagctgattcctattgacaaagactctctccttgaccaaactttaatgaggatcctctgaccccttgcctccaccttacctgtcctgtcttcagcctgtctagcccagctgcaggaagaagtctgctgaatcactcacccttgatctctgattaaattccttatccctcacctttgatgtatatgttcttggcctgcctttagcaagaatcctgttaggtcaatttaaaaaaatcctcctaccccctgttagtaattttccatccactgatcccctccttctggtcttgggctgtaaatccccacttatccttgttttacttgcagctgagcccagtatctctcccctgttgcaatatatctattgcagcagtcctgaatgaagtcttccttaccatcttaataagattcagaatatttgtaatactatgcacaatagtttgaaaagtagtggtatagtacattagaaatttataatccctaacccttgttctgccactgctgtagctgctataaattgtgtaacctttggcaagtgatctaacctttctggaaagcaacatcttcatctgaaaaacactcttaaaggatcttcctagccttagcttccaactctttattatattagttcccagttttgctctcaacaacctggacagagaatagccatttgtgaatcattctgactcagattctcctgctgtaaaactgaggctgccttttccttccctggaggggtgtggaaaaggttctaaagtaacctactggggagagcgccaacctttgtgcctggatgatgctctacaaatgcagatcctacttccataactccaatagcgctgctgtagtagcaggtttctgacatactccaaggaagggagaattttagctggccattctccaagcctggaaacagaacgtgctccaatcacttaacatttaaaatagacctatcacatccatccttctgcccaggagagagcacacagcaggagccagttggtgtctggtggtgatttagttatgagtcacccactccctgatcagttatcttgagtcatttccacagtaatccataagccggatggcatcacagttttttattatcagcatcaagagcacacacgtacaaataaagcatcaagaatgattttcatcctctgtaacactgaagaaatcactctgtctacagcagtcactctgaaactttaaaaagaacatgactaacttgctcacccccttttaattccctaaatacttgagaagtgggagtgggagagacactgttaggtcaggtgtggcaagtagtggagaaacacaagaagaaagcctggaaatgtaggcagtaggataaatggatggtaaaggtctgctgaatgaattcatgaaacagatcaatatgttgctcactaattaatcattttcatcattttctgtccaatggagaggaaatgaggtggctaaatctatatttccacttttcaagggttaaatgcacccatttcttagctctttttaaaataacctcacagaaggctttggttactggggggcaatagtgcatatagaaaacaacaacagaaaaaaaataacaaagtcaaatagttaatcttttttgtttgtttttgagacagagtgttgctctgttgcccaggctggagtacaatggcacgatctcagctcactgcaacctccgcctccaaggttcaaacgattctcttgcctcagcctcccaagtggctgggattacaagcacacaccacaatgcccggctaattttttgtatttttagtagagacaaggtttcaccatgttggccaggctggtctcaaactcctgacctcaggtgatccacccgcctcggcctcccaaagtgctggaattatgggcgtgagccaccgtgcccagccaaaatttttaactatgttgatccctctctttctcatctgtaaaataataataatgaaatatgtgtagctcagggttgttgtgagatatccagtgagacagaggatataaactgacagcatatttgacgcttagtatccaataaatgttaatcctcccttttccaccccttttctgcttttatcactttctcatcctcaccccagtatttacttactagttgtgtcaccttgagtggttaatctttctaagggtcactatctgtagctgtaaaatagaaataacaagacctacttcataggcttgttattcgattaaatgagataatccatacaaagcacttagtacatcacctatagttagtactcagtggacattattattattttattattaatcataaagtaacttatttctaggtgacatagttagaaatatcatggaatcataaaatactagacctgaagatccttagttcttgatagtcatatatagcagctttcaccttgggatggtatctcctcaaaggaggaatgcatttagaaatgcaagtggcattttctggttgtcacagtgactaagaatgctactggcattcagttacctgggggccaggaatcccaaacatctacagtgtgcaggacactctcatccataaagaactgtcccatcttaaatgccaattaccattgagaaatacaaagttgttcaaccacttcactgtggggctcagagagatgaagacaattaaccaaggtatcagagttagttagcattatagctagaactaaattttgtatagaatgttaacgttgcaaaaatttttcccatcttttgcaattgtcatcaacagagcatacatgtctctatttttagcaatggcaattgtctctataaaatcagaaaaattcctaagggaaaaaaaaaagccttagagcatgctttcttactatgtctccaggagagagagagagagcgagaggaggaggattttttattttaatgttgaataataatatattagcttgtttcactggtcctattatagtaaaggctggagtccttactataatattgtgtctttaattcctcagaacacaatattagagagctgaagacttgttctcagccctcctaggggctccttatttttttttttattttttatttttgcttttttttgtttttattattattttaattgataaataattatatatatttatgaggtacagaatgatattttgatacatgtatacaatgtggtaatgatcaaatcagggttatcagcacatctatacctcaaacactgatcatttctttatattagaaacattccaaatctgctcttcttgctatttgggctcattagttttatacagagaaaaaccctgttctataaacatagcatgtcatgcatgcatgttgtggtgaatgtctaagaaggtatgaaactgctgaacaactctaaccccctgccaagaaatagctcagttatgtgtcctgctgatcgtgattcaagtttagctcaatgtagtctattttaacatgcgtggagcacttacggcttacagggcattgttttagatgcttggagtactaagatgaattagacacagttcatgcttcaaagaggttagaagacaaaaatctaagcagattatttcaatatagtatagttagtattatagtagaggtagaattatccatttatagagtaagctaaattaataaattgattttgatcagtcatttaaatgttttaaataacacagacacatcagttaccttaatataccaagggaaacacatctattctagtcatcatatataagatgactgtcttatattacaaatttgtacatttgtctatctctttttcagagttagggtgtatactgagtaagacaatcagtatcacctgagtactagctatatatcctttggaatgttacttaacattctctttgactcagtttcctcaactaggaaaaacataaattatgcatttctgccctacttagctctgagtattattgtaagaatagaaggcaataatactgtgaatgctttatccatactatgtgtgacaccacttcctctttccagaaaggctacatttctcagcccctttctgtagctaaaggtattattttactaattcttaccaatggactgttagtgaaagtgatattacttctagcccaagcagttaaaggtggttgtactttctctgcaaatgatcttttctccttgtgcagtcacttgggaggccgtgtgtcccagatggcatagaactacaaagaactacatagaactacaaaacagagaaggctgtatactctgtattgcacttgatgtaagaaatattttgttgtcactgagattttagtgtgtgtgcattactgcagcccagcttatctcatattttcccttacacactacagatataaattattatttttgaaacatactagcatgcttagatggtctcattacccagtggccctgggaatatttactgcattaaggcaaagcctcaaagaatttgttattctctactataacattctcctggatgctaaacaaaatctgcatggcgttccatctctcatttctgttttcaacacacacctcctttcaaatattgatttttagcatatgtcctaaaactgtttctcaactaacgtgtcaccatgtgtcttttatgccaaaggagccaatatgccaaatacgtgaagcatgccaatttgccaattttatccatgttaggaatgaacagctttgaaagcttcctcgctggatgacaaagatgttgatcacaacaagtggagggtttgtctgcatctgcaaagatacttgctacctaagggaaaactttcaaaatgtatgtttcagacaagagcatttactgtggtgtgcatcacaagtaaaaacatttggaatagtcatcccaagagctcttttttgcttatttatagaagctttcattattgcaaacatccttagtagttgaaaaatatacagtacaatatatatacaattattggaagatcatagaataataatgctcttgaaatatcaccttacctgttctatagtttgacctctggtaacatattcgttaccaactttgattctaggatggatcaagcactttaccaactcagaggagttaatgcccatgaggaaagcagctttgtcagcatctggtcatcagaaatagaagaaaaggaaggagagaggaaaacactgttaagattcattccattatagccaaactaactacccagaggacagaaagatagtgtgtttacatcagcgtagcaaagtagattgtagttttcaaataaatgcctgaatcctaaaagtttaaaggaaattatttcttcgaaatacaagtcaaagccacattgaaatctcacttcttcagtttgttggcattaaggaaaaagaaaatataatgccactcacagccactagaatgactataatcaaaacggcagacaataacaagtgttgacaaggatgtggaaaaatgtgaaccctcatgcattgtgggtgggaatgcaaaatggtgtgtatttgccgtgagaaacagtttgacagttactctgaagttaatcatagagttactatggaacccagcaatatcacttttaggtacacacccaagataaatgaaaacatatgttcacacaaaaaattgtacacaaatgtttctagcagcattattcacaatagtcaaaaggtgggaaaaagtgaaatgtccatcactgatgaatggattaaaaaatgtggtatactcatataatacgatattgctagtcattttacaaaaatgaagtattgatgtgcactacaacatggctgaaacttgaaaacattatgctaagtgaaaggagtcagacacgaaaggccacatattgcaggattccatttctatgaactgttcagaacaggcaatccataaggacagaaagtcgattttggttgccacaggctgaggagaagcaaaaatcaaaataactactaatagttgctactaaaagtttatttttgtgataataaaatgttccggaattagatagtggtggttgcacagccttgagaatatactaatacccaataactatacagtttaaaaggtgaatattatggtgtatgaatcttctaaaagaggactagtatcaagaaacagaatcttttaaaaattgagatataatttgtctgaaggacatggaaaatgccatctttataatttgttttctctttctatgtatgtacttgtggactctttcaacaaaacacggacttgggccatgtaatctgataattatagacaagcaccaatcaacagaagccaggacacttgccagctatctgtaaaacacccttcctttcccggcaaggtctctgtttgctccgtagtgccctctgctgcccaacaataatacttacaccccacaaaattgttttatgaaacaaagcttccatttcctcaagaagtggagaataagtattatcagaaggaaaagtaaataggcatgtatcacttcaggtatgaaaaaatgacacaaaataatgacacaggcaaaaatttataagcttatttcaaattgtagattatttcagttaccaacaaaataaatattccactcatccaaaacccctctctgctttctattttaaaggaatttggagatatgctagtatgtctggcatagtcattctgttgaataatgtcttataatagaaggtaatgcagcctttctttaattcactaaagaaaaaaaaagctgcaaattttccagagcaataatcacgaacagaaaataaagtaaaaacaaaacacaattagagagctctatctcgtctgtattagcaatatcaatttccttttcacagcctttaaaatgtttacaaggcttaaaatgtttgaaatgtttgattttcttataaactaaaatcaatatatataatacatacattgctacaagttacatacctactttatgttagtttatttgcagtgataatagcctgggtacttggttgctatgaaacctttcaaaacacaaagcctatttggaaaaataaatgaaaatcaaaggtagagcagacatgcccatcctatactgagatgtgcctgctaacagtgccaggtttggcggcaaaagcttgataatttcaaattgagaatccagtatgtcaaatcatagactttttgaactgaaagagactttatagagtatctaatccaatgtgaaaatatttaaaagacgggaagaaatacaatgtgcctggcaacctgagtggagatgaacagtaaccaacaatgtgaaaaacaattttccagtatctgtccaggtttaaaaaaaaaaaaagagaaacatttgttttttctaagctttggaagcatgaagagagataatacaggtaataatagtctcaaagaatagttccccatgccgagtcttcatatatcctttttccagtgttaagcacagtcctttgagtctatttttatccatgaacaaaagaaattcagattctctgaggagtatcccaccttaagcttaacagaaatagcatctaacattacaggattatttgtcacttactccagagatagttgagtatctacagacaggactagtgtaccctggatttactccagagatttacattatacatcacatatgttctctgttttggggggaaagaggaaacaatagaggtcatcatgttccaaaaagtaaattacttcatttgcactaaatgtttacagtttgcaaccaagatgaaaatggcgtaaatctatgactaaatgcccatctgacattcaggaactactgttgtaaagatagcaatatgtgtaaacatattttaatcatattcccaaataggctttatgaaattcccacccataagcatcagttccttcaggaccttgtgaatgaacccatggacttcaattaggctgcatgatcttacctgggagaggtaacatttagctagagaggtggttctcaagcatcagtgtgtattggaatagcctggagagctaatcaaagattaaacaacaggctccctgaagcaggttaggggctgggccgctctagttttatcgtgttacccaggtgattctgatacacatacaagtttgagaacaaagttgttattgtggtagtcctcaactttgactgcacactggggtccctggcaagttgtaaaaacaaatactgatgcctgaaattcacccacagaaatctggcttgtctggcttgggtaaggcctgagcttcaggattttaaaagttccccagcgattctgttgagcagccaagtttgcaaactactgtctagagaataataaccaggtttcgtaagtttattttgaaatcaggaagatggaaagaacaaagtatgacttcacctgaaaacaggtaaaaaggtagagaaactcaaaaaggaatcttttccaaatttccaattctgtcccagttcagtcccatctgcaaataaccagatatgaaagaatgaagcaaaatccagttttgtcagtctacaggggttatgataaagatattaatctcttttatggaaggttataatacaatttttgagctgttcatatttcattaatttattaaacaaagttaactgagcatttgctatgtgtaagccctgatgctagataatgtaataagaagataaataaacaaggcaaaaatccctggcatcaagaaattataatctatgagagtaaataagacatgggaaaaaatagtatgtcagtaaaacaactgcataagagacacacaaatcgagtatcacaaaactgtgaagtagggaaagagcccttctggactgcatgactggggaaggattaaaaaagaaacaacattcaatctgagccttgaaggatgacaagagtttttgtaggcaaatatgggagaagaagagtttccttaacaatgaacagcacgacttgaagccacaggcgttgaagagtacaaggtatggtcaaagaagaggttgtaacccagagggactggactacgataccagggagtgagtgagaaactgagaaaagcgggtgacttctggtcgcagaagacatctaatgccgctataacatattaattaaagaatggggaaatgttaaaggagctgtaagcagagaaatgacataattagagtcatgctttaggatgcttaattttggaaatgtgcaagacagaccagagtaggaagttttaaagtacagagtgaacccattgcagaatgctgaagtgtgagatgctgaagctccaaatttgtaatgagaaagggagaaagagagactgagaaatatgactaggaggtttccagtctgagaagtagaaagaagaacaataccataaatatgaatagaaatgccaataggaagacatcacttaggggagaagatgatggacttttagccatgcagagtttaggatactagaaaatatgcagctgagagttggaaatatggagttggaactcaagaaagaggcaaaggctaagatgcccctttgggtttgggtgcccttccccgttccttcttctccatctgtccagctccttcaaaaccttcctaaataattaactgggaaaaatttaccaaagcttaatatattaagaacccttagaattaaagaaaaattcaacacctccatttttaaaatgagctaaaggtagaagcatactgaaaaaaactcagtatccagtaagatgcttaagttaattatggtacattcatacaatggaatattttgtagccatctaaaaagatattgcagaaaagacaaaaagatgttcacatataatttggtaaaaaaatactaggctgaaacaacatgaatatgatcacatttttattttaaaaagttatatgtgcatattcaactagaaaatgcgtaaaaaatatgtcctttggcattcacagtgattgtctctgagtaggtagggttcacttaatgaataattagccattactatgtgccaggcacattttaaaacctggaaatatagcagtgaacacaccaaatgaggtccctgctcttacaaagcttacatctggtggagattgaggggtggaggctaggacattcaataaaaactagctgtatgaatgacatgaagaaaaatatttagattagggggatagtggtggaggtagctagagaaggcttttctaataaggtaacatccaagaagttactttaataagtgagggagtaagacatgaggacaggagaaaagttccaggcagaaagaagagttagtgaaaatagtcctgcaataggagtgcttacatgctccaaaaacatccaagaggccaggacatgtgagtggagggaaatgagagacgagaaaatgatagatttcgctactaacggtagggattagagagagacagagaagtattggttggtgcaaacataattgcggtttttgctgttaaaagtaatgacaaaaaccaaaattacatttgcaccaacctaatatcatagaggttaaggaagctgtgacaggaacgtggggttttatttggagccattgttgagtttagagcagaagcaggacatggtggaacaagggctgactgacactgtgaaaggactgacagtagcttctgggtgcagagctatccacctatccatcgtaggcaaggatgcaagcagggagaccaggaaggaggctgtagtaagaaacggtggctcgggctaggtggtggcagtgggcatggccatggtgataagttgtgagcttttggatgtatttcaaaggtagagacaatgaaaaagagaggagtccaggatgattctgagatttgagtcagggcaattgggagaacctaggtggcatttttgaagaagaccgagaaatgaagagttggtagtaaaggcagggtgggatgaagagttcagttctattcatgttgagtttgagatgggcaccaaagaaatgagcatagaaagggaagaggaaagattcaaggctggagccctgagcagccctagagcaattagcagtagggaagataaggaagctccagcaaagaacctgagaagaagccaaaagggagagtggaggagattacacatttcatttgctcatctgtgttttttgatttatcagtaagtatgccttgtttttgtaataaaaaccattctttaagaaaagcctttgttttaaagcatggaaaaagcaaacaggatggcaaaaataaaataagatgccataaaagcatatgtgaatatgttaatatataagatgtttacaagatcttcataacacattgtctcacttcattcacatctgtgctgtgtcctcttctctgagggactgacttcctgaccaccctatctacaacaacctctgtatcctattattccttatttttttaactctgctttacttcctttttgtatggaacttgttacgtatttatgtatttattgtctaactcccacactagacaagacagggacaatatcttgttcacggatgtatccctagcatcaagaatagtccctagcacagactggcctccaaaattatttgttgcacaacaggccaggcatggtgtttcaggcctgtaatcccagcactttgggaggccgaggtgggtagatcacttaaggtcaggagttgagaccagcctggccaacacggcaaaaccccatctctactaaaaatataaaaattagcccagtgtagtggtgcacctgtaatcccagcttcccagctactcgggaggctgaggcacaagaatcgcttgaacctgggaagcagaagttgcagtgagctgatattgcccccctgtactccagcctaagccacagagcaagactctgtctccataaaaaaaaaaaaaaaaaaaatcacaaacttgtcaaacaacaacaaaaaaatcctaattttaaaaataggcaaaggacttaaatagacatttctcaaaagatatacaaatggccgataagcacataaaaagatgttcaacatcaccaatcagtagggaaatgcaaatcaaaaccacaataagataccactttatacccatgaagatggctactataaaaaaaaaaaaccaaaaaacagaaaacaacaaatgttggcatgggtgtgaagaaattggaaactttgtgcattgctggtgaaaatgaaaagaggtatggccactgtggaaaacaatatgatggctcctagaaaatataacagatttaccatttattctaacaattccacttctaggtatatacacaaatgaattgaaagcagagactcaaacagatatttatatactaacattcatagcagcattactcacaatagccaaaaagtggaagcaaccaagtgtccatagactgatgaaaagataagtgtgttatatgcatacactggaatattatttagccttaaaaaggaatgaaattttgatacatgctacaacatggatgaaccttgaagacattatgctaagtgaaataagccagttacaaaaggtcaaatattgtatgattacacttacataaggtgtctagagtcagaaggtaaaacagtggttaccaggagtacaggaaggggataatggggagttttggtttaataagtacatagtttattcaggctgacatgatgaaaaagttctggcagtggattacattgctaattacacaacaatgtgaatgttcttcatgccactgaactgtacactgaaacatggctaaaattgtaaattgtatgttatatatattttattcattaaaaatataaaatttaaaaaagtagttgttgaaagagttgaatgaatgggttttctctttttgtttcggttgtaaggaattttaatattaaaggtaataacaactatgctttcttcttttcataattgtggggatttattttaatgatcattctagacagatcattcattgtaagatgcctcaaatatttctggtaagcagataagagtatagatttttttaaatgtgaagaaaaaacaaggagaaataaagcctcctggtctcacccctgtgagttagttacttcccactggaattccaagggccttagttcacatctccattatgtcacttaatacattttatcataatttgctccttatttttgtatttttattttattttatttttttgagactgagtctcgctctgtcacccaggctgaagtgcagtggagcgatctcggctcactacaacctctacctcccaggttccagcgattctcatgcctcagcctcccaagtagctgggattataggcgtgcgcaaccacgcctggccaattttttgtatttttagtagagacagggtttcgctatattggccaggctggtcttgaactcctggcctcaagtgatccacccacctcggcctccccaagtgctgggattacaagcgtgagtcacggtgtccggccataatttgttcctttctctcattgttctcaataatctatgtgctaaaggcatactgtgtcttaattctccttcacccaagtttagcaaattgactggatcatcaataattattgaggagtgcttcttattctgtgataggaggattctacattagaatggtagttgacagaaccgtttttgaagaacagcaatcaagggagacactattgattaattttaagtaagagatgaagttaactgcaaggtaaaggggagcaggcttgggcccagagatttgaagtatataccatatcttcaaagtaattcttactttctgtgccatctgcttccagttgctcttctctaggtttctgtttaaatttcatatttccaaagtgcatgatggctccagtgagtttatagcatccatacttctcatcaggaagaaagcccaagatgtccatggcttgctgtaaaaagagaaacagatggccctgtcttcatttgcttaatggctgcagtgagcacctcacccccgctgtgttacacctcgggctgtgggctgaggggaatgagacagacagctctgttcaaagcaatgcaaatcagccctgttggcacttggtcacccgcagtctgctcatccctttaaaagagaattaggaaggcacaagactaggcttgtttagttcccaatagttttagaactttccttcaatgccctgcctctctcttgttccttccagcaacagatcactaactggctatatgaggtcaattattttgcctttcgtggttatggcagaaagcaccatatctgctgagttgcttgtttctgtgatcccacaggttctgactttattccagaggagacacatttcaaagactggtgaaaagaaaggtttaagaaaagccacctcaccataaaattgcatcctaagaatccactgcacaaggtgtgcattctcatacaccccaggagggaaaaaattggtacaatctttctagtggttaatttagaatatgtaccaagagactataaaaaattcataatccttagtattttcacttctaggaatctagcataaggtgaatctgatatacagaaaaagtgtttagctacagagatattcacctcagtgggagtgaaaaaaaacttgagtctaacactaagagaatagctcaataaacaacaggacaaatgcctgataaaatcttaagtatccacttaaatgtttatgaagagttcctaacgatatttgaaatgcttaaacgattaaactgagaaagcaaattctatatgccaaatgtctatgcagcataattacagtcttttggtaaaaaacaaaaaacactaacatgaccatacaaaagcagctgcaaatagataaaaacagaataaaaactgtaaagatatacaccaaataaaagagatgtttgccattgagttgaaatatctttctactttttcatagcttccaaagttactatattgacaatgtgcagttttctcataaataagtaaactttggacagaagcagccctacacccctacggaagcaagaccacttctctgggtccctaagaacagaactctaagattctgtctttcatttctcattgccattaccagattttgctttgacaactaacaagccttacttctgtggccagcaattcttcagcatcatccaagctctccacagtaactgctccacaggagcaaaagtggaagtctgagggatttgcagataccaggagcaggtctagagtgggaaaacgattcgttaaacagcttaaagaaatctgcaaggccttagaaaataattggtcaatattcgcagtttagtctacagtttatatcatacttgtaaacaagccaaaataaaatccatattttagacccaaacttctacaatcaatgtttgccctctattaacttgtcagtcatgtgttaatgcctcccaagagaagacaggctggcaaattcaaaaagcggattcaattgcagcagtttcaattggtgtaaaaaaaaacaaaaacaaacaaacaacaacaacaacaacaaaaagacacgtaatgtgtgttggcaaaactctgaaaacaggaatttggcctagatttatgactgagggctggaggataaaagtattttgtaaaattataagtagaacagacctgagcttcaaaagctacgaagcagccagaagctggggtcagcgcccagggaacattagcagggcaaccctgtcacatcacatcctcgctattagagaactgagtctgtctttcaagggatccataaatcagctgctgtgttcagtgctgcaccctgatatgtctaagagtcctgacatgattcacttagtcaggaaacataatccaggctgaagcagaggcaggctgtcagccgcgcatcatcagctgacttggcagaatcacattaacctttcactgtccaacacttgctcccagtgaagtttttttgagctgatcttatttttctatttattgctcaataaagtgaaaatcggttatcttgaactccaaatctcagaaacaaagaaattgggctacataaatgttcatagcagttttgttagaaaacaagtcaaataaccatctgcagttgaatgggttaacaaactgttgtatattcatacagtggattattattcagcaaacaaaggaataagctataaatacgtgctagaacatggaagaatttcaaaataattatgctgggtaaaataagcctgacaagaagaatatacactctatgattttgtctttaaacattctagaaaatgcaaactaatctgtggtgacagaaagcatattagtggttacttagggactggggctgggaaaggagggctccaatgagtgaaaagggacaggagggaggtattataaaagatccaaggacacttttgaaagtatacatgcattatgttgattgtggtgacagtttcatacacactcatatatatgttaacacttacctgttatatacttaaaacacgtgcagtgtactttaggtgaaaagaacatcaataaatttgttttataaaactttaaaaataaaattggcctagcttaaatccagcagaaggtgaatatgtgtattttaataaaaatatcctgtaaaaatttttacagtacttgtttttgaaatgatttttattttttaaattgacaatttaaaattgtatatatttatggtgtacaacatgatgttttgatacatgtatacattgtggaatggcttattccagctaagtaatgtatctgtcatttcacatacttttttttttgtggtgagaatatttaaaatctactctgttagccatttcaagtatataatacattgttattaactataatcactatgttgtacaatagatcttctgaacttattcaacttttttagattctacatgggtgagatcatgtggtatttgtctttctgtccctgccttatttcatttagcataatgtccttcaggttcattcatgttgccatacttgacaaaaataacaagattttctttccttttcttttgaggcagggtctcattctgtcacccaagctaaggtgcagtggcatgatcacagctcactgaagcctcaatctcccaggctcaagtgatcctcccacctcagcctccctagtagctgagaccacaggtgtatgccaccatgctcaactaatttttaaattttttgtagaaacggggtcttgctatgttgcccaggctgaccttgaactcctgggctcaagcaatcctccctcctgggcctcccaaagtgctgggattacagtcatgagctaccatacccagccaagatttccttctttttttaaaggcataatagtatcctattgtgtatatataccacattttctttatccagtcatccttcatggacacttaggttttttctctatctcggcaattgtgaacaatgctgcattgaacatggaagtacagatacctcttcaggatactgagttcatttcccttggatgtattcccagtagtagatgactggatcatatggtagttctgtttgtaatcttttgagtgactttcataccatttttcataatgactgtagtaatttacagttgactcaacagtgaaaaagggttgccttttcttcacatctttgccaacatttgttatctcttgccttctgatagtaagacaatatctcattatggtttttgctttgcatttccctgatgattattgatgttgaggcttttctcatagacctgttggccatttgcatgtcttctttggagagatgtctgtcaggtcctttatccattttttaatccagttgttttcttgctattgagttgagttctttatatattttagatattcagcccttataagatgtacagtttgcaaatattttttcctgttcattcagtagattctctcttgatgatgcacaattgttgtatactttatgaagtgaatacacagggttgaggccaaatgtcaaggattccaggacggaaggacctcttggtcacttaccatcactcctggaatttatacactagttgaatagcaagaatagacacaataaataaatagaaagaaaaaaagtcaaaagaaaaagaggagaaaagggaaaatatatgtaggaccaagctatacagacggcagtaagaactaaggattttgaatgagccctgtccaaaagaactgaagaaatgagccttagctatgcctggaacaagggtcagatataattgagagcaaaggagtgaaggggtgctcatggccatgtagaggtcaaataggggctggctctgaggtaacatgtcacctcatttccttcgctccttcagtgggtgaccagcctctctgctgtgatttccatacccaattcttttgtagtatggacaaatcctcatatttcaggatatgtggacatcatcctcatatcgttaagatatgccctcttgtattaagcctcaggatactctgaagctcttctttagcaaacatggatggtaagagttccagatcatcttttaaaatgtcccccaaaaggacaatgggtgctaaaacaggtagactgacaatacccaatttggaccaccagatgtcagactttgcacagtaatcaatctcagcaacccccaaagaccgaagaagataaatgaactcaggataagcatgcattttccatagcagcccaaaggcatcagatgcttctattagtaaacagagttgctctgaaaataatcttgcagtctctgctggtacccacattagatcttacgtgtcagttgctctataccatccagaaacacatgtcaagagtgttagatttgataggactaatcaatggaagatcaaaaaaaatcctgttccaggttgaggtggagagaaggtggggaggagaatacgtgctgcttacatgacaccaattacatctatggcaaaaataattgtctcgtttgcagagctttccccatttggtaagggtactttaaaaaccaagtagtcaaaacactgctagatttataccatacttagtctaagcataatggactgggagaattgttcccatcagtttactagcctggatctgtaatcttaccctatgtccacttctgtgggagcattgttgtcctcaaaggcttacctcaaatgcaatacctcggaaatcaaatcagcgtgtagttctccccttccaatgacttcctatgccactttaaatggtctgccatggcctgcaatgcactgcatggtctggcccctgcctattttaccctacgttaccctctctactctaccacccacagtggccattttgctattccaagaataaatcaaatgcattattgcctcaggacctttgtactcactgttccctcctcctgggattttattcctggaaatctttgcctacttgctcccttactcattgaggtgtctgcaaagaatgttgtcttttcagagaaattccctgacaatttcatctaaaatagaactatccacaaccctaccaaaccccatttctttctgtcccctcactgtactttattgttctttatagacctgccatataacctacaaagaaattagatcatggttttttttttttcttttttgagacagagtctcactctgttgcccaggctaaagtgcactggcacattctcagctcactgcaacctccgcctcctgggttcaagtgattctcctgcctcagtctcctgagtagccagaattacgagcacctgccaccatgcctggctaagttttgtatttttcgtagagactggtttttaccatgttagccaggctggtctcaaacccctgacctcaagcaatccatctgcctcagtctcccaaagtgctgggattacaggtaggagtcaccacgcccagcctagatcatgtattctttactcatttgttgcctgtcttccatactagactataagctcatatgggcagaggcctgtctacctcgttcaccactgtaccccctatgattaaaaagcagtgcctggtgtacacatagcagctccataataaatatttgttgaataaatacatgaaattcattcccttattccacattttttttcttattttatgtttatggcactatcattctcctaatcaaatcacaaaacttggggatatttttgactgactcatcactcttcctcattcttacattcagtctctaccaagacctgtctattcttccatgcatctatcccttttcccccacccttccattctcagacactctcttagatcactgtcttgtcatctcatactgggacatttgcaatcccttccatccaagtctctgcctccacaccatcctgcccattaccagcttaatcgtcccaaacactgccttcaataaatcatgacctcctattgccgcaccccccacaacacacttgctctgccaactccctgagttcagaaaccatcggaataaaatctccactattcctctgtgcaaaccttttcctttaatcaacctggtctctctgttccctgctcctgctttgccctttcccaacattgtgtacactcttcctcctaccagaagtagcctccactcttcactttgtctgactgaatccccttcccattcttcatatcccaacctaaattccccttctttataaaactccctgagccagacacggtggttcacacttgtaatcccagcactttgggaggccaaggtgggaggatttcttgaggccaggagcttgagaccagcctggccaacatggtgaaaccccatctctattaaaaaagaaaaaagagagaaaactcccattgaccaccacacactatgatgctatttccctcccctggtccttatctataccacccatgtagctctaattaaggccttaaattaatgcttttatacacacacacacacacacacacacactcactcacctctgctgggcatcctacccatttccaaatactctgcttctttttgctaccaaattgaaaaagaagtgttgctatttactgtctgtccatataaaattatacaacactagttctataattgattcaattccctaagttttaaggatgaatatactgaggtctaaataggctaagaaacttaccgaataacactttttcatcccccaaatatgacttatttttcttgttttggaataaccctaagctccagaatcctacacttaccatgaagctctttttgtccagatagaatttgatagaatatgtggtagttcctctctccagcctgctggaaaatcaccctggacttttcaagcaaatctggatgatgagaaatgaataaaaattcatacttaggcattcttgcaaaatgtagaagaaaagtaatcaggctgagcgcagtggctcacaactgtaatcccagcattttgggaggccaaggcaggagaatcacttgaggccaggagtttgaaaacagcctgtgcaacatagtgagaccccatttccacaaagaaaaatttttaaaattagctgggcatggtggcacatgcctgtagctgcagctacttgagaggctgaggtagaggattgcttgatcccaggaattcgaggctgcagtgagccatgatcatgccacggcactccagcctgaacaacagagtaagaccctgtcaagaaagaaaagaaaagaaggaaggaagggagaaaaagaacgagagagagagaaaaggaaagaaagaaagaagaaaaggaaggaaggaaggaaggaaggaaagagaagggaagggaaggaagggaagaaaagaaaaaagtaatcagacagtgcaatgactacttacagatatcaatgtccacagatgacagcatgcctctggcaccaaagtgcatcctgatgaatttgccctagtgtggacacagaacacagtcagacacaaaacacagtttcctattcacattttccaagcacttgcaatggcttcattatatgtaactctcaaaaggactacttccccagaagtaaaaaacaaacaaaaaaaaaaaagaaagaaagaaaagaaaagaagagaaaaatgcaatgtgggtttgagatgagacagcaccagctaatatctggaggaagccagaatgattgtcaggactagcagtggttctggcttgtagccccaaatctgctgattgctacctgtgtattcttgtgggcattgtgaaatctctctgggcctcactgttcttatctaaagatgagaaaaatatttcctcagcatatttgtttattcatgcaacaaacattcattgagcatctactaagatccaggtaaccttctaggcactggagataccgcacaaaaaaaatagacatggcccctaccctcatgaatcttatagtctactggataagcagctactgcaacagctctgacataaaatcacaagaaaagccaatatcttagaatttagaaagtcagagaaagggggggcataaaatggagtcgaagaggtagacaaactccatatcatctaagccatgtagaacacgggaaagggtagagttttattttatgtgtgcttgggagacattgtaaggttttaagcagaggagtgatgtgatctaatttatgtttcatagcacaccttggcataaataatagacgggcaccctttcttccttatcagtgaaaagtcataaggcaggatctagaggggcagaaatgctgtccagaggtgccagtgcccatgtcagaatgccagatgcagctgaggaggtggcaccatctggtggcagctagagcctgtgggatcaggatgctggaacagggaggaagacagcctgggggaggctggcccatgccaggaaggcatcagggcaggacagcagcctggcaagaagacgtgagtggctctgtacagggggatcaaactagtacattaaaatatgtaggacagtgggagtcacacacacaaacatacatgtatatatacccatacacacaaacatgcaagtaaatatgtatgtgtgcacatacacatatacagaagtatatgtatacatacctatttagtattaattgaaaattttaacccagatttcttgatttttttgaactcctttttctttctctcttctttctttccttccatttatccatcttcatgtttatttttctcctctacttctttccttctatctttccaacttttctctcctttctgttctctttcaattgctttcttttctttaaggcaaattcctactctgttacccagcaggagtgtagtggtatcatcatagctcattgcagcctcaaacacctgggttcaggccatccttcagcctcagccacttgagtaactgagactacaggtgcgcaccaccactccaggctaatatttttatttttagtagaaacaaagtctcactgtgttatccaggctgatcttgaacttctgggctcaagtgatccgcccacttcagcctcccaaagtgctagggttacaggcatgagccaccacacctggctatctttctttttacctgatgttcttcgctttcttccttttatttttttccttgtctttcttctttccttttttaaaatgttctttttctgtccctttattgctcccctttgcctcccttgcttttcccccagctttctatctttcatatttcagcagaaagtcctttagcattctaaaacatcccaaatctaccagttgttttatgaaccagtattagcacctgctatgaccagccagacactgtaagctcatctaaatgtggacagagaagctctaaggctttggatggaaactagccaaatcggcatgaggttattatttaattatgcccggagactcaaataggaagccttctgcaaattttcttgtaaattatacagtggctccctgccactgattcttggcataatatggatttgttaaactaggtttagaaatccaaattcttcctcttttatgggagttctagttatcaaaagctacttaaaaatactttctccccagcccgccaaaatgtctccagtgaaaaatatgcaggggttaaggaggccacaggcaacagtacaaacagtaattgtagtaagtgaattaggaagtgcctactaaactgacttgttataaggggtttaggaaatcatgaatgagaaaataattcaaatatgtaaaacataataaaatataaaacattattataattttttggatgagcttctctactgggagtggaatttgaaactattaagataaatgcttttttcttgaaattgaccaaatagaaactcctaaaatgcatatttatttataaaaatttaattgtcttaatgatatagatagtaattttttttgagaaatctaacattacagactttaatcaaagaccttctttggtgttctataattttttcatacctatgtgcttacatataagttttaccattgcttacaaattaaatactttgatattatgctaaatcatgttacttacaaaacgagaggagttgtcatttctcagggttttagcatttccaaatgcttccaagatagtattcgcttgcatgatttgatcttctaacgccccctgagacacatgcaagagaagtacagctgatgaaactattagtagaattctgtaatgcggcaagccctccatctccaggtcaaaccccattcttgctttgataaccaatggccaaaagctgcttccaaatttggttatattatcttcgaatgagaaatcagaaaaacagttggatgacagaggctaacaatatacaatacccctatgaatatgtgggagctcgtttatttgcaatgcttcttttttggttggcattggcctgagggggaaaagcaaatggtcaccaaataaaaaagaaaaacataccaaagcttatttccagacaaacatatcatatatttcccccatcattaatcttcctctcttcccatccgatctttgcacttggaaatttatcctaggataatacaacagactcttggtgttattaaactatacttttgcttgcttcttttcctaagtaatctagaggttcacatgagtagtgacttttaatagtattgatcttgaatttgaatcacgtgtgctcaggctgataggcaaaaacagatcatctacctatctaccatatctacatggctttgttgttttccagtcagcctcaaagaccaattttatgggggtaattatgtagtatatggtatttaataatttgtggatttataaatattatatcccttcttatatccctactactatataatattccccatcttatggggggacttatatagtatactgtactcaataatttatggatttataaatattatatcccttttcagtaatatgggtttactgtccttcaaataagttagagaacattatatatatatgagcaaggatttccataggagtgttatatttatgtattgtattatatattatcataaaactcaatggctagaccaaaccatttaatgcgcaccaaaaaaaaaaaaaaaccacaaacatctaaaatgcttgtaaaaacaaagttacatctagtgaataaaagagttcagtgatggccaggggcggtggctcacgcctgtaatcccagcactttggaggcctacgcgggaggatcacgaggtcaggagatcgagaccatcctggctaacacagcgaaaccccgtctctactaaaaatacaaaaaattagccgggcacggtggcgggcacctgtagtcccagctgctcagaaggctgaggcaggagaatggcgtgaacccaggaggcggaggttgcagtgagccgagacagcaccactgcagtccggcctgggcgaaagagcgagactccgtaaaaaaaaaaaaaaaaaaaaaaaaaaaaagagctcaatgatacccaaagaaatcaataatcaaattcaggaacgtggtggtaaaaaaaagaaacttctatagtttaaaaattaggtcagatggctattttaatatatttcttactttgcaaaaacagcaaacatccagtatcgaattgaaaaaagcaaaataatcattccagacatagaaaaatgagaggtctaacagctcaataactcattgattttgagttccattcagcattacctgattttattttgcataccaatgtttatggtcttagttatcctcaagttattatgatgtccattaacatgttaatggagctaaacaaagtaagctaaactaaaatgaacaaggattttttttttaatagggaaggcaaagtttttctgaatgtggtatgtgattaacattgaggggtatattcattgggcatttagaatttgatccaggagttaggtatgaatgaagaaaaattttattggtgcatatttgtgggaatctgatatctcacagtagctaaagggattcagaaatatccaagccactgatgaccctagcctttaggtaagatggtttgaatcttgaggacttaacttacaggtccaataaacaaagaccaggccagaaaatgcccctttaagcagatgtgaaattaattacataattcatgttttcatgttattgtttggagcacttgatgatcctctcaaggaccaaaggaaatatttaaaaaaatacttttctataatttgcaaattgtcctgtggtgcttgtggcctcacttcccaaaagtggtccggacacaacctccatgatccagtggatagggccacctcatcttttctaccaagctatataaacacttacctgctttttcctggattcaatcatggctgctatggtggcaaaatactggataatatgtttgctgttcacagtctttccagcaccagattctcctctgtgatttgaaattcagtgatacagttaactggttctgattatcaatgcaacgaaagttaggtaattttgattatataggctatggcaagcagggaagcttttacataaaagtagagcttcagatggaacttgaggatatattgacatttaattggttgggagaagggcaaggacatttcaggctggaaaaacagcatgagcaaaaatctggagttagaaagatcacaactttttgtaaatattaggaagcctgttccttgtggtcctaataacaagcagcaggaaagcacctcttctaactagacaagtctcctcattaccagctgttcaagagattttcatgtatgaaggctaccacacagccaagtccaaccctcttctcagaagagggctaccaatcacttcaccaggcagttgggctttaggctttaccttacctttgacaaccagctaactttgcaatgtgggaagagcacagtggcaaatttatagcctcctcaatgtaagcatcatagaatcaaggcctgcctgcctttatctatacaaaactccagaaaatagtttatcctgtctgtgaaaggctgaactcccaactgttcatgtagctctaaaattctgagacctcatgatccctcttgggataactgaagccaatggagagcccaatgtacaaggtggtaacaccatcattgcatgggaaggtaaaggactttagcacttcacagccccttgagtctcagccaccatgctgacactttacctggccagccagggctcttttcatcaaaattcacatacaataagatatcactgtgacacttccgtctatcctttttacgccctttcttatttctctaaatgtcaccatcttttagtttccactgcttcatgtactttgacctgccccaatctggctgcccacaactgcttgttatctgttccatgggcatacctattggacgttcagcccctctgcttagccagtccagaggcctttgaagatgaccatttggaacagtgtagctctcttaatcctcaagaaggtaattaagaccagcttgtgcactatttctaaaggatctctgaaaatgagggaggcagactagctgaccccatatttggagtcatcactgactaaagcactatgacaatttcctgagtatctttttcttacctcaaatgtattgcatctaaagggcaattaattcaaagatggcgaatcaaagttttattcccagtgaaatggaggtatctatttcactgaaacttacttcaggccaaaaaagaaaaacaaggcaaacacttacgtgaagagtatagactgattttctcgatctacaaaagaaagaaaaatgccagaatattcttatattcgatatttatgtattagtatgaacttactcaaaatttccctagctacaatttgaaatcagacacaagggaaaggattagcatcatttatagttagaaaaacatacccctcaaatggtacagggtaaaatcgattttctcttgcccctatgtatgccaatcataagaacatataaaggcctacttctttgcgctacatataaatggtaaccaactaatgattgagattcttgccattttaagccttttaagaatcgttgtgtaataatatctatagaataacttctttgtgccagacaatatagaagatgctgtatataataaaggctaacatctgcagggggcttactctgggccagccactgggccgagcactttaaatgcattatctcactttgatgtacaaactaatcggcccaataaccctaggaggtaggtactatttcacccacattttatccagaaggaaacagaggcttcaagtgattagctaactgtaaaggccatgctctgctcacaatgcctaagtgcctcttagggacatagagaaaaagtagatcagatatttttacttttcattttgtagggcagctactcactgtgaagcatgtcctgaaaggcgttattggcaacagcaaagatgtgagggggagcctctgatcgcctcttccctttgtaggcggccatgacttctttctgatacacgggaagccatttgtaagggtttatggtcacacagaagagacctgaatatgtctgagggaaaatcagaaaagatttcagaaactagattagaaatacttccaggtttgtcagctcttccagtgtcaagtaatatttgctcaaatattacttataaaggaactcagaggggagcttttggaatcatgtagagaagggacttctaacaagaagagacagaaccaggttagagtaacatcaggacctgggattacctttctcctgggagacctgctaattactaacaagtctgacacatgaagcttctgaagacagagaggaccctgatggcaggactgcagagatttcagtaaccagccatcaggcatttgaggccagcggggactctgcctcagcaagattaggggtttgatttttagggcactgagaaggactagctcatgtgggtcactcagtcactgaaggggttgaattgtcgcccccaaatagatatatttatgtcctattctccagagcctgtgaatgtgatcttatttggaaaaaatagtctttacaaatgtaattacaggttaagggtctcaagatgatgacatccaggtgggtcttgaatccaataacttgtgttcttataagagacacacagaggagaaggtgatgtgacaatgcaggcagagactggagtgatacaaccaaaaggaatgctagagccgctagaagctggaagagacaaggaaggattctccccaagagcctccagagggagtgcagccctgctgattggatttgattttggacttctggcctccagcattgtaagagaataatttctgttgttttaagccacccagcttgtggtagttttgttacagcatcccagggaaactaatacagttacatggtaaatcagaaagctgaggagcaagctggttgcatgccatggctcctatggccatgggtcccagatgctacatcttagcttaatctactcagcactgtttctgctgcataggttttgagtaagtcaaagaacttgagcaaccaaccatcatcaatttaaagatgatgaagaaatcatctcactcattaatcactaactaggtgacatgcattgaactacgtgctttacctacattcttttatttaatcccccaagctcccatggaaaggcagacattgttatcccactttatagataaggcaacttcaagaagttaggaaacttaacaactagtaagtgacagggctggtggctactctgtcaggctctaagcctcatgcttttaactaaggatgacctgtgggaaggcatatgaatgttgacaaaataaaattggggaaatgctaagataaggtcccttcccagtagacattgctcaaggactatccctgtgcgagcatgcttaaactcaatgtaagagatcacccaggagagattgggacatgcaatgtgactgccaacatgacagtttagcaggaaagcatattacacacatagatcatccactggccatagcgccgcttcagggtatgcagcacggatgcctcattgaggtgagtcagcattgccatgtcttcaatcatttcaaactctggaggattcatctgctggattttgtcctcctttatgctcagactctgcagagagaagaaaaatatatgatatattcccctgtctcctatgcgtattcattttcccatgaattagaaagaatattcagactcaaaaagaaaaaatgatgcctcattaggggatggggccagaagaaattaagccagccttcatggaaaaaaacaggtgttctccctgaaaaagccctctccttccctaaagatgaagtaaacatagtatttttgttatatcaagattttctatcatgcagtaccctaatcttatggcttctggctagccctgattccctctaagagtacatggatcatattatgtacaatctaacccctaactcccagcccttgatgtcccaacacaccttggagatttaaaagaagaaacttagagtggaggattaaggaggcagaccttatccttccagacctagttcaaaacctgtctcctccctcaaaccttcccaactactccagcttattagtttgtcctcttctgttaagtcttaccatttgtactatctttacattaatactcttttgtatattttaataattgactatgttagactattttctggctagattataaataccttaagaaggatttttgatgttgtcttctttaatgaagttcaaaaacttgcaatgcatgttcatttttgatgttgttgtcataataactatagttattaaatatagttattaaagcacctatcacaatgcttgggatataataaataatcaataaatattaatatattgattaatatggatgcatttctactatcaaagtttcttgggattcttctcacaggtttcctaacaccctttctatagcccttttccatgattaatacatatttgtgtcaactgattgccccatttaatcccagttggtgatggcttctttccaaggctctcacactctttacattcttgattcaatttctatccatctgtcttctttgacattgttctaacagtaatccctcttcttttgagtcccttcactttctgtatttcaaggactcatctcccctcaaacccatgcagaacgtaaacatatctcatacatcttcaaaaacctccccttttccctaattctatttttctatttttttcatttccaactttcatcaataagtagtactttacacccactagatttattgcctttgctaatgttacaaagaccattgtaacattgtgattggaagtgtagtcacttctaacatgaggaagaggaatcctggagccagggagatagtgaagctgggggaatgggaccttcattacatcaaagaaggacaagcaggacaaaataaaccaccttcagactcttctttctacctgcattaatggccttttcttcctatggttgtaaccacattatagtcacaaatcaccttaagtgctgttgaagggacagtagtttgttttggagaatgtgctcagaagagcaagcctcacatctggaggcctaataaaatttagttggtcatcattaagaaaatgaaaaaatacatagactgagagaaaatatgtacaaataatacatgtggtaagggatttgcaaccagaaagtaaaaagaactcttacaactgaataatgaagaggcaatagcccaatttaaaaaaatgggcaaagagcttgaatagacatttctctgaaggagataaacaaatggccaatatgtacatgaaaagatgctcaacatcattagtcactggggaaatgcaaataaaaatcacattaaaataccacttcatgcccaatagaatggctgtaatcaaaaagaaaataaaatgtgttagtaaggatgtggagagagtttaattcttatatgttgctggtggaaacgtaaaatggtagccactttggaaagcagtatggaaatttctcaaaatgcttagtatagagttactatatgatccagcaatacactcctagctatacacccaagagaaatgaaaacatgtgtccccacaaaaacttgcacatgcatgttcatagaaacattattcataatagacagagcatacaaacaacccagtgacaatcaactgatgaatggatgaacaacatggtatatccatataatggaatactatttatccataaaaaggaatgaaatatttattcatgtgacaatgtgagtgaacctcaaaaacattatgcttagtgaaagaagccagaaacaaaaggccaccaattatatgctcctatttatctgaaattgctagaataggcaaatctatagagttagaaagtagatcagtgattgcctggggctagtgcaggaggaaagaagggggagtgactgctaatgggcacaagatttctttgggggatcttttctaataaaatattgtcccaaggctaagtgaccctgattgagtctatttcttagtttactgatttaggactaaggaaaatttcttgctgaattttcccttgtccacctatttatgttccagttaaaaagcaccaagttcttttcttaatttcctgaagagttaaataacatctacctaatttgagatttttttacgtaacagatattgactgtcaggaagacatatgaaagcattctatgtggtagtttatgagtggcttccagaattttaaaaatcagatggcaacatgttagatcgtaaattgcctaaaaacaaagatagcattaaaaagacaaactttctcgatatcaataatatctgtttgttacaggatgtggcttgttatggatttgggaaaaggaagaatttaaaggagtttagagaagtgaatattggcagggaatcatctgtaaaatctataaggaagagttcatttaagtaggacagaaatggggcccggcttacaccacggggtggcaggtaatgtgaagtcagcaatgtaggcaaaggttctgagagtgagctgtcttctcaatgttaccctgctgctctgaatgccttggtggcagggagaaggggctggcgggtattatggcttcactacacatttcttctgtgaaccttacagtctagcttgtaccccaacacttgatataaccttttcttacaaaggtcatagatgacctcctaattctgaaatccaagactttctccaactcttaatcttcttctgtggcatttgtcattactggccattcccccatctcttggcttctgtgacactatgccatttttactcaaattatacatctcattcttgatcctacaaacacagcttgcttcgtggttccttaagtcattattcaccccacaggatacctttttttaaaaatactgacttgaaacattgatgaaaaagtagaaatggctgtgagttctagtcaataatccttgccactggcaattgttttactctgatttattcactgttcttcattaaatctttgatggtaagtggagtttttttgtttgtttgtttgtttttggtgacaggatctcactctggttgcccaggagtgcagtgatgtgatctctgctcactgcaacctcgacctccccagactcaggtgatcctcccacctcagccttccaagtagctgggactacaagcatgtaccaccacgactggtttatttttgtattttttgtagatacaggattttgccatgttgcccaggctgctctcaaactcctgggctcaagcaatctgcctgcctcggcctcccaaaatgctgagattacaggcatgagccattgtgcccactgacttaaggaggagcttcttaaaatgaatgactccgaagtgagtcagtggcatctcctaccccagatctttaattaaaatattatagaaataatatatttagttatttgatagagaacatagtcatcactgcaatgaaataaaaatttctttacctctccatctgctgtctcaacaattactgttccatcatcttcactcccttttacctcagcctcgatataagcattctcaccatcaggaatccagcatttcttcttccctgtagagcaaaaaaaaaaaaaaatggattatagctatagtacttacagaaatacatactggacactttcatactgatagatctaatctcatttctgctaaatcagcttgttgactacaggaacttgcaaagtcagataaaatcatgaaagctcattctgaagatacactcactcacataatggcactacaggaacaagaaacatctcagcaagcagcagcttgggggcaccatagaccattttgctacaagaaagttacctcccaacacccctcccaaccccaacactttcctccactcacaccccaggactttggtggttgccctggtgcttgcaccccttccagattccctcccccgagaaaactcattcagaaaaagtctgggaacaactaagtgaaaatttagattaatggttatgttcttcagggtttctttagaccttatttctaatcttggaatggaaatcagctaagtgaattacatggtggaattggcaggggggcaggttgaggagagagaatatgggttgtttttgttaaacaacataaccggctcatattatttcccccaatatgttatttttctctcttcagcgtcctcagttcctataccccatccctaagcaaagtagccctccataaactgattaaccaacaagaggtctggggtgaaatgagccagaactcttatgaacacctgaggcagcttctctttctctcccagttgaagcagatagacagtgatgatgaataaaaaatatgattttaagggcctgggtgcagtggctcatgttcataattccagaactttgggaggccaaggtgagaggatctcttgaccccaggagttcaagactagcctgggcaacatagcaagaccctttactcccccagtcctgtctctacaaaaaacaaataaggcagggcacagtggctcacgcctgtaatcccaacactttgggaggctgaggcgggcagatcacgaggtcaggagttcgagaccagcctggccaacatggtgaaaccccatttctactaaaaatacaaaaattagctgggcatggtggcgtgtgcctgtaatcccagctactcaggaggctgaggcaggagaatcacttgaaccagagagtcggaggttgcagtgagccgagatcgtgccattgcactccagcctgggtgacagagtgatactctatctcaaaaataaaaaataaagaaataaaaattaaccaggtgtgatggtgcatgactgtaatcttagctattcaggaggctgaatggggaagatcacttgaacccaggagttggctcattttcttttaaaagcatattatatatatgtgtgtctatgtatgtatatgcaatatatcatactttccttttaaaggaaaatgaatatatatatatatatatatatatatatatatatatatatatatatatatacacatatgaaaatgagccttagtagaagctcacagaagtccccaggtcacagctactcaggtacatggggaaagcctttggctgaaggagggaaaatgttagccaatggctagggaagacacaggtgaaaaccccactataaccacagcactaacaggtaatgcgaactcagtcaccaaccatcacctccaatatatgagtcacaaaagctagagagggctcactgccgcaggacaggtggtccttatttcccagaggaaggcaataagactggggaaggagtgtgtacaaaggagctgaagttgggcaccatttgccccttcttccaccatgcttgtttctgcaaagaatttggttgctcacgactttcttgctatcagtgctgccttcttcgtttccctgattacaaacaattcaccactaaaactgcttggcaagaggagtttatgttcccatctagctgattgtgcatttgctttctacttatcatttgtgttttaaatactggctttgcattgtattcattattttggtccctttttgcaaaaactgattttgctttgtgttatgtctatgaaaatatgcttgtttttgaaaagcacccagttagcatacattttgtgtgtgtgtttaaggtaaaatgctctgcattttaaaccaaatgttatcacttgaaagaaacttgaaggtcacctggcacagtctctctccctctgtctctctttctctttctttttagaaaaagaaccttgggagagagatgaagagagttgcccatagtcacatagctaattagtggcagtcactacaataatgactctagaaatgagatcatccacctcctgaatcagtgctcctgcattacagcctgcctcctctaacacattcttagctttttctcctccaattcttctctccaggagtaggctcaccacctgcctcatgatgaagtctctctcttaccacccctggaaacacttagtggggaataaaaattatcagaaatcctttctcataggagacccaaaccctgacagggacattttaaaaaatgaagtaaatgaactctgtcaattttaattcctggtgttcatgaataatgcagagctggaaatgtagatagcaatggatttgagggaggcagccaggattttaacactggctttgctggtaaaaagatataaagccacatgacttcatctcttttggccttcgtattctcatctgtaaagtaggcctttttctatatgattccattttttagacaattaaatatcttttccaatataaagctaatatgtgcttattgaagaaaacttgaagaataatgtatgaagaaaagaatgtttttaatcacccataatcaaacaactcagagataaccactgttatgtattgaagcatttcttttgaatcttttttctaggatattgattaaaacaggggtaatactatattcagtcttatagttattttaaatagatcgcttacatgttctaatataagaattatttacatttggctttcgaatggtgttttgtcctagctctacaaccacctgggcttcttcactgtcacccaggaattctagttttccttctcgggtatcataataatgcattatatttatttttcacatttatagtctcatttggtccccacagcaatggaggaaggcagaccggacaagtattattatctcctttgatacatgaggaaaccagggctcaataaagtgaagtgatttgctctaattacccagccagagatggtcaaggacagggaatttgatcccaagactacctgctaaatactcgtcatcacactacttccatttgacccgagttcaaaaaagcaaactccattgtctaccagcctgggaagatgaacaacttttgctaacacttgtctctgctgccagtgcatttctatgaggaaggattgtttggtccaaaaaattaacaggaaattatgtagattgctatgttttaagtaattatttatggtgctgattttaataaatgcatcatccaattatctctaatgcttaggctcaatttttttttcttcctggcatcactattatcttgtcctccattatctaactacctgcgataagcctctgcatgaccagttctgacctcagggatagttctgttatcgtatttgatttgatggattataattagcctaaaatccaatcacagtcatgaatccaatgactggaaactgggaactgatccaggactggtctgtgatggaaatataatatcctccataactggcttgaattataattggtcatattaaagtctaatgttgactaattctgaatactagaacgacattcagccagtccttatgttgcactgctgaataattttggattaagacatgtaggtagcttcatgttatatcatactgtgaatctgatttctaaatctccaattagctgaaattcaacacagacatgtaaaggtagcaggaaaaagaataacatttatttagagatttcaatgtagaacttagccttttttttttaaggctaaatcctcattaacctttgtccttgcctgtaactaccaaggaattatgaatcagggtgagcaagtctcctaattaccttttgcttagtgttggctgagtgaccctgctgacctagaagaccgctagaggcaaggctccaacatcaaaaaattctggagagccagagacaacttcaaagtctgcagccttaccagagtctttccctttcttcttccccacaatgtacaaaccccacccaccagtctaagtcacaggcccctctctctactgtggcattcactgataactaagaggtttctaggaaaggctttgtctggccattcctgcaggtgtctgtgttacaacaggggctccttgaagagaaaatctgtcttaggatcaagtgtgtagggcccgggcctagactgcctcccagccaccctcctcttctgtgggtacttccattcctaccctggatactcagaggccctcaattgctcagtttcctagaggctgatcataccctaagcaaataagttaggctctagaactgatggctcttctctgtcaatcaaatatcttagtcaccatcttgaaggagcaaaataaagtgaagccagcaaccaccacatgtctcaccatccaaggctgtggcctgtagtagaagcagctcagcttcacttcttctgaggaaggctgcggcttctccaaggtctgacagatccatctttattaaagcaatccaccaaaaaaaggccctaaacgtgagtaggcaagattcaacctgaaaaaaaaaaattgatacagagaagaaaaaagtggaaataaggcatcaagctctaaatgagcaaccattcacatagatagactaaagagtgttaagttttcctgtaactacctgtgccccttctttctcttcgctatgtctcaaatttatacaaaattggactcaagaatatctgactctagcagggctgacttacccactagacatagaaggcacagtgcctgaggcccacaatgcttttaggggcccatgaaaatgtttaatttatttttaaatcagaagaaaaatataaaagtaatatgaatgatacatattaatgaacagagcctggattatattcatctttaggccaacacagttatgaaatctgatttttaatatttttttgtggagaaatggtccttaaaagacagaagtgcctgtagtcagtgaaagtcataatgccaccctgcgccatggagttctgacaggtggtaggatattccagatggagaaacatcaagttgcggacactaggcctttgataggcgtggaggggggtttcgaggtatctaattacccccaagcagacagaccgttatagacagagtatggttacaaagagaagtgattcagataaatgttcagtaatagacagtaaagggataaaaagataagtatcttggcagagataagtgtctgggagcaaatgatttacaaaaatacaggcacagctgggcatttgggaggcctggccaagagcagtaatgaagaagcccaggctgaaggtggcaagcaggttacatggtgatgtgagtgaagctggaataaataaagaagttcattggctcaagcaaggcaagtatcagtcttagagggactaagttgctggacaaattaccaaggctgaagtcactgagcacccactgtataccaaacactggacatagtttatctttaattttcacactttacatttgataacagggagaagaagaaatggaaactgggccttcatgatcttaaatgagaagctattctctctatttggacaaaaaaagtcttcctcttcactcaagcatgcaaggcaagtgttactcatcacatttataggtaagaaggtagagaaggacttgccaagtttgcttagctcaggtgctgtctttgaggacagatcagcacccacttcagaatgaactgtaatcacttactatcttgcaatgaacaaatccaataaactaatgtattttactgcacttaatctgctctcttctttgtggtggcttggataggtatagtgataccacttgtaggatctagtttaaaggagtatgatttaaagcaaagcctactggttcaggctaagagttagttttatttctgccagcaaataggcatgtgacttgtgggaaatcacttagtccctgtagatgcattttcctcacctatgtaatgcaaggactagtcttaatgtataggaacatttcctaaagtggagagaagaaaagatgctcaagagaaacaacataaatgatggccctccagagatgcgactgaaggcagcatttctcagggaaaaagacaaaactgatttttctgcgggtgagcattcagattcaggttttgtaatcattataacagcaataacattgttagacatctgaatatagaagaactcaaggtaaaggaaagctctgaaaataaggcagagaaatttagaaatagatggtaggaaacatcatcaactctgtgggcaggaacatgaggaaagcagtattttgggaaaatggctctggtggcatattctgggtagatgaggatgaggaaaagctgtagtcagggagacaagttgtgagtctggatttgtctgggtcctcctcctctctgtatgtgtgacttcctagtggcttgcactcagtagacagtagagcttgggaagtatatttggaatataaaagatatccattaatacatgtgtgtacaaacttcctgaaacatacctaagaaatggatgtctgtctgagtagtgagagaaggagatgggtgggagaaggagagaactacctttcatttcattccattctagtctgtcaatgtgtgccatgtgcttatatttcataattaacagattttttacaagtagttcttattataacatcagagatgaaaagatcacagcaaaacagagcacacagctgtgtaactctccttccaagtctggagcatttaacatatttaaaggtgtacaaagaacagaatgtgtaggagcaggcactggaaagtaggaaacattaggtgccaggagtggggcgggcctggcaaccatttggagataggtaactgaagccaagagaatgattcacctgagcaaaaaaaggatcgaaatccttctatctccttggccccatccagcttccattaaccccctaatgtcctactgacctctgggtccctttaggttccagttgcacatatggctttacaattttatagaataacacacttgtcacagcccagtcctagcaacatcttaaaatagaaaatgaaagagcccgaatgcccaaaagaagtaaacaaattaaccttgccagcaaaagaatcaggaagctatattttgtgaatgacagagaaacacagatgagtatagaactgaaggtaattctcttagaggaaaagttcatctacatgttgaaaggaaattatatttgagactggtatactcacacatgtttatcggagaattctgacaccatgataaacaaacttgtatctgatactgcatatatttacaagacagaagagagcagggggcagcactggaatcctggaaggagaataggaaaggatagggcagacgggctgcatgcacaatgctgggagtacctcacttctaggacctagctctgcctttgaacattcaggagcttgatttatcaatacatactgattaggttctgggaatcacataactatgctcagaagtgtgcatacaattcatcacccaaacctggacctattttttcttactgggatttttaagaggggatgccattaatatttaaatcaggacaacaaacttaatctaagactgacccaagtgaatagggacatatggacactccactaataagagaattgaggacttgagatggcaatttctaaactgacaatgaatgtacacattttccataactgcaaagtccaggttacttgtctgcatgatccacagggcacatagacaacgtcatcactatcagaaggttggattcggagaaagacattagatcatcatgtacatgacataattcagtttgtaacacagcaaaataatgcatcctgttctgttctagagttcacctttacagggactgagcaccatataagccatccgtatcctgtttatattgatacggcacaatttccaggtgtatcttagttaccagttgataaagtaaagacaaagaatgggaagcccttactgggaagggagagctgagatgtaagcttttcctcttagccaagaaagaatcatgttggtctgacctagctgcctttcataaaaaatatgtttgaacagctgccagctgagacaagtcacgagcccagatgaccaaccatccctgtcttcccggaactgaggtatttcccagggcttgagattttcagtgtgaaaaccagaaaagtcccaggaaaactagaacaagttggtcaacctacttttaagtgtagtgcctgtagttcttttagaaattcagtcacaattttggaaattagctatttttatactggttgtatttctgcagctatccccctctccctcctcaggtattttgcaaacaccttttttgaaaacgtccttttcaaatatacgtttgaatatattcatgcaatatatatgtattgcccatctgtaattgcccatgttaggcccaggggtacaataatgggcagaataaatactgtgccctcttggagtaatagatttgaatagggatagaagtttcttctgtcttgaattattatgcattagacaaatctgtagagagaaattttcacactttggggtgggggggtggagctggtcatatggcaaagttcagaaaagaagcccagagggggactgtagcagtgaagggaagaggtaagcttatacagccacgactcctaactcactagtctgaatggaaactgtaggcagagttatgttttcttaagatgagaaaacacgttcctcacattattgtttcacaggctctttcactgtctcattctctgcccaccattccaatggaagggtctcatcctggagcctcctaatcccctaggatagaacccttggaggcatctctaattttccttctatctcatgccacattcaattcatcgtcaacttttattgataattaattttattgataattaattgtataattaccagttcttatccacttttagacgacacagtttggagtgcctgttgagcccacactcctattagaagtgcctgctctcatccacaggaatgagccgcaagtagccatgtctgtaaggtgacactggtgtcctggcccaacttataaaccaggcttcagtatctgatctgggacaatcagagacaatcagggtatccccctggaatacagatttgggatttagatgccactctccatctgggctctttgcttgaatggagtgatgcaaacttgagggttgaggttggcattgtggtgtggtcacatggtgccacatgcacgctaatcagcaaaagcatccatagagagggagtcacagggatgaggagaagcagcaataagggaccaaaggaagagagagatcactttcttatatctcaaagacccttcctggtaacagtacctcctgagacctatatttaatttctgcctttgatttccataagcgctctcaatgaccttccagtacattctaatttctttcccaactttaaataatctgaagtgagtttttgttatttgccatcaaaatatccttaactaacgcattatgtctcagtctctgtcccaacaaagtttcttagtttctctcctaagatgatgtgaagattgtgtataaaactcagcacattgtctggtgcatagtaaaacctcaatcactgttaactgttctttttactattcaacaagcatttatgcagtctttgcacactgtgctaaatatgtaagacagtagctttgctttccaaattgcttattgaatctgagatgtgcaaaatcataatggaggatggtaccatggggaagtaaagagggaaattcacatagtggcagctactagctgagtagatggaggtgagacaagggaattgtctatttagatggtgatcgctcctgaaaggtcacactttctagtcttcttactgctgaccacagtaaatctatcactcagcactcatctctttcaatcagagctagacaataaatatggggatgagggggtgcagaaattcatttcaccttggcatttcagtgccttaactataagcagaaactcaaatgatgcctatgaagtaaattgttaaaagagttaaactcttttcatgttagcagtcctgacacatttttaagtcggtttcatcataattgattagattcgcttgagttcttcatcaaggtacgttattatgcatgtttactttcaaagccttctactgctgggaagccatgatgcaagtaataagaacaaatattaatattcctttgagtaaacaaacactaagcatcttttgacatagcctcttccattattaaaattggagacaatgcctgaaaatgagaatggatttatctagatgtcaacagctgaagggaagaattatcaagcacttaaatgatcccaaacaagctgaaacatatgtcttaaggcagtaaatgaaacacatttgagttacaaggcccagtgaatgccacaaatctggggaaatgctgcaagatgctcctaattagggacactactaggtagacaaatgatgctgctgcttcctagtattcatgctgctgggataatcatgttatgtgccttaactgagcaaggtttcctccatagaaaatcttaagtggttagtctttaggcacacatctaccaccccttaaccagctacgctacctgcaatttatttatttatacgcagcttatttctctacaaaagcaggggtttaggcaggtttatcttcttcaaagaggaatgttaaacggttgaattacaaatcaagagtattgcacaaattattgattatttaaagcatttacttcaaagggtgattattattacagctataggtctccaggcaatggagtttacactcctagattctgctccccgctcccctcccactgggatgtggcttttcctcccatccctccacagaaactgttctttctaatgatctcctgaagagaaatcctaattgtgtgcttttcagtctctaatcctactcaacctctctgcagcatttgacactccctggttgctggggtcccttcttccttttcttctctttcccagttgttcatttactaatcaaaggtccatccacaatacaaattgtgagtatcattgacatttctcttttgctccctcttttcactagtttctatctcccagcgtttgctggctctttaatcctttcagaactaccttctcctacactttactacctcccaatctctgatcaaaatgctggatctctgcactgagctattcgctattgatccagagaagaacttctgattaattttttttttgagacggaattttgctcttgttgcccaggctggagtgcaatggtgcaatctcggctcaccgcaacctctgactcccgggttcaagtgattctcctgcctcagcctcccaagtacctgggattacaggtgcccaacaccatgaatggctaatttttgtatttttagtaggaatggggtttcaccatgttggccaggctggtcttgaactcctgacttcaagtgatccacccacctcgacttcccaaagtgctgggattacaggtacccaccaccatgcatggctaatttttgtatttttagtaggaatggggtttcaccatgttggccaggctggtcttgaactcctgacctcaagtgatccacccacctcgacttcccaaagtgctgggattacaggtgtgagccaccgcacccggccaccttctgattaaattctgtcatgcattcattttaaagtatgtcctcttaggatctgtggattaaaagagtaataagacctcaagaagtttccactctaatggacatggacaacagagatataatcagtgactataattcagtatgataaatgctaggtgctaggatagagcaatgtacagggccatacaggtcaaggaggcataacgctctcatctacatttgtatttttaagaataacagtttacaacttaaaggaaggaatctcaaacatccctgaaatgatacctttggaaacagtgccaatatactatttaataaaagcaaatctgagttctgagtgtgtatcacacaccaggaactaggttaagtgttttatacataataactcttttaactttacagtagctctatgaaggatatatgtaataacctttattatatgaaaacactgagtctcagagaactagcaagtgttatctctagttttaaatccagatacattaaagtcattcttgtttcctactttgttcacctttacatccaatcaattgccaagctctgctgactctttctaaatatcactcaaaaccatctccatctttccatcacccctgccaacatctggatcaaggccatcatcatttttctgggggcgtattgctgtattctctcagtctcccgacagcagccaatccagaatgaggcccccaagtagagaaacacagttactgtactatcttatttaaaatcattccgcatcctatgataaaagcccaacatgttaacagagcctatagagctctccatcctcttgcttgactgacacccacacctcatctctcttgctgtctcatccccaggcctgacctggctggggcactactagtagatgccaacagcactctctgacctctgggtgttcacacgtcatgtgacccctgccgggaacattcagccctgtccctcatctggctaattcttaatcatcctttgggtcttcagtaagcaacatttctacaagaaggtattctctaggttcgttctgtcagctagatgtgttcttagatttctttgctacttgcatcatgataattttcatcctattttattattatttgtttaattgcccatcttcctaatgaaacataagtaatctgagggcaggactaggtctgcagcactcagagaagactctagttctttgggtagagcattaataaacacgtagggaatgaaccaacaaatagagcagacccatcagtctgactcctgagtccttgctcttaagcatgatgctatacttcctccttggctgagctccagccagcaaggaggctgatgttcttggttagaaaagcatctaaccaagatgcaacatgtccatacaggcaacatgtccttggtttaaaaagcatcaccacttcatttttaagttggatgagaaaaatttagatttgtggttcaaaagaagtatgctaaggataaaaatcaactggtataccatatcaagaaaaccagactggtaaggaaagatttaaataagtagtttatttttaaaataaaggtatttaagtcaatacatctgaattgtattgctccaagatttttgaatccatggagtcttagaactaaaagttctttaataacagctggctcattgctccatattttacaggtgagtatgcagggaccagcaaaatacatgattggctcacattcaccaaccaataacaatggagcaggctgaaagtatggatagttttgagcagagttgagagaaaaatactgatgatagctctatgaagagaaactgaaggaaactaagatcgagggctatacttttgtgcttcagaattcaaggcaaatataccctcctataaaatactaggtaataccacagtcaacggaataaagattagctgaaatggaacattgtcatgataatattccttagggtcagtgacccacgatctgcataatagagtaacacttactttagaattgcaggtgctgttattcagcacaaaagacatgcattaaatatatttagtgattctaaaagatgatatataaattcaaggtattaatagcattattttcatcgatttattggtttcatattttctgaatgttcttaactcaggataattatgagttttaactaagtacaattgtagtcaacatctttgcataatagatattcagatacacttatctaaaataaaactagaatattatgtattccagttcaattaaatataacaattttttgaacattcaataagtgccaagaattgtcaaaatgcttgggatactagaataattaagatgtggcttctgtttcaagatttaagtctagcagggaccaagacttgtcaatatagttttcagtatgataagtaaaagacatacattctccaaaagattataccgaaagtaaaacaaattgctgttaaaattctcacctcagagcaactattctattctatgaatacaccatctttttcttaaaatattttgtttcgtataacaacccccatgcgaaaactatcagtaaaaatagcaaattgtttttaatacccactattcaatgtattggtggaaaagggagagatagaaacctaccttggaaagatcaaaagaaatgggcagaccagtgctgagtcaagactttatacactcttgtcaaggtcaaggatgacagcttcagtcaactttgccattgtttctaaatttgtctactggtttttaagaagttgaacccttggatctggatttggcaccccaaatgtctctgaggcaagggtatgagatgtcagaaaacgatcccatttctataaccaaaatccgcagactaatttaactcattcctcaaatgcttgctacataataggattagacaatattaaaagagaagcagcaacaccgtctctggtggcatcaattttggagtcttgggctctagtgctatctctccagtgatttggagcaattaagttaagggtctcaacattttccatatctccaagaaaatagttaatcatagatatctactatttatttaggctattctgagaatactaagaaagaatatttattaagggtggattatattccaagtgattgttccaatcaatttgcatatgtgagttaatataatcctcataacaaccttgtaagatagggtttattattcccattttacagatgtggaaacaaaggcagaggtgataagctagtcattttgggagaaaagatttgagcctagatgttgagcttcaaaatatattcttgtaataattataatatataatttttatctcatacatctcatttggttctttaatttcttcccccctcccaaaagtgtaatttttaaaagtgtcttgtctatccaaggaaatgtatttctatttgcctctttcaacattgagaaaattttcttttactgagtgtctaggtgaagcaaacagctaattgattgctacaaaaggggagattagccagtcgacccttgactttgaattactttcttaggacttataagctttttacaaaacctgaaaatgtctttctggagcaaaggactttctgaacttttttaaaatgacttttgggaaatgatgttaaaaaaaaaaaaggaaactctttgagttataggaaatagttcatgcgatcagttctcactactcatgggtcagttctgcataactatttcccagaccaatttattaaccatttcccactgagcaataaaagaatagagagacacctctcctgaagcctattacaacagcattgagggcagaagtaaactaataagaaatgctgaagcaagtactgtataattatacccaatcaatttttaccaaaatgaatcaatatggcagtctaattgagatgatctttgttgcttcatacaggaatgagatttaattagaatctccagtgattgtaaatgggtaaactgaagtcaccagtaacctcacagaaatcccaggcaatatgagatgaagcaatagatacagcgccctggctggctttttgttcacaggaaatggacattaaagtgccctacttggcctttgggagactgcaaaccattttcaggtgtgcttggggcctgagtaaaagggtgtggtattgtgtccagacatttgtaaaagattcagttcagataaagcagacaaaacagtttaacttgcatttcaaggagctctgaggattcaagatgttcagttgtggaagaaactaacaagaccggttttaagaggggtttagtttgaaataaatgagagacagctgttaatagtaataagcctgtttccatttttgaaaggttgggagggacatgcaccaatagactcggagggcaggtggtggggagcaataggagatgtatgtggtgaagatggtggaaagacagagggggactgtggttctatcaacaacaacaaaaaaatcccaagaaagggcatgaggcatgatcagggagattctgatgtggcttagtgggtatttggtagttgacaaatctaaagggtagataggtgtggtgaccctggagattcaaatttttcctagggcattattataaccccagaaatgtgaggcagtgttacttcttctctgggttgaacagagaataaggatcaaaacaagggtcttaatgtaaagtaagtggtgtattttaaaacaatcaagtgagaataagctctgtcaatagttgctgtattcaaatgattgaattccatagaatctatggataattgacttgacgacaaaattaaagtaactatgcccaccatagaagcccctttgaagatttcttgcatgttgacaaccacaagttgttctgcttcacatgtagttgatctagtagtgtaattcacagaaccaaaattcaaacctgaaatcttactaattgattaataattgctaaagaggaaatgttttatagcgtttactatacagatgctacagaactatttgagggcgaaataattcatacgatggtgttttgagacacaatttaaaacatccgttattccttcctgttcctaatctcaatagaagggttgatatcataaaagatgttagaatgtattaggtgatacagggaggaaaagagggcatcttccacgcagatttgctacagatttacaaaggaaagaaaaaatcctctcacttccaaggcccccatcttcttcctttaccaattttgttggtgtgatttgagaacaagaacatttgcgaaaggacttgatgtgtggatataaagtgatagtttcatacttgttacaatgtaagatcatatgcttctgagaaggagaattcattattaaagatgtttgtgatatttaaataagaatgaattataaaacagtatttacagtatatttaagattatatgcataataaaagttccaaattggctatctctggatggtgggattatggattcttttaaaaattattttgcaactctaaattttctactcttctctttctataatgaaaatatcattttgtgcaataaagattatcttaaaataaaataaggtgatggtcagtatttctgggtataaattagggtcagaattagatatatatcatactgaaacattacagtataccctgtaaatatatgcaattattatttgtcgaataaaaataaaattgaacttccaaaaacattaaagaattatgtaaatgtttttgtatacatacatatataatacactcctgtacatatataaataacatataattaattttacatatcaagaagttaaacatgtgataaagcttggggtttttttgcttgcctttgtcctcttgctacagcccatattagatcttggattctcttacccttctactcacattatccttcttgcttttattcaccccacacataatccagattaacaatttaggatgtattcttcaatatttttctccgtgcttatgtgttcaggtaaacaaatatacagacatatcacatattgttgtaggtcatttaacaaaataagatcaattatatacaggcctctatgtcctaattcttctcactcaataatacctcattgaaaatctgccaaatcaactgctacaactcaaatgcattattttaatgattctatgatatttcacatcataccatatgtatcataatttattcaacaattcccctattgacatttccagaggttttttgccgttataaaaaaatgtaatcagcatccttgtacgtgtgtcattactcatgattttatttatttgagaaagtgtcctaggagtgggaatgttaagtcaaagaaaatacacatttaaaattctaatagatattgccagattgttttccaaaaaggcagtaacaattaacaatttcaccagtcatatatgaaagtactttttcctgcattactgacagtaataggccttttcattctttataactttttgacaatccaataggtataatgtaatatttcattgttagtttaatttcatttctctgttaaagaatttgaacatcttttcgaatactcatttggattagttcttgtctgaattgtttgttctgtctactttttatttcgtttatcttgtctacttttctatgggggtatttacttgttcttttcaatttgcaattgttctttgtacattttgtgtgctaatcctatgtcttttattattaatttaatttaccaaatctattatttttcttttgaattcacttatggtaacttttgtcatattttttacagttaaatatgcctatcttttctttttataacttaacattttttttggtccagctttggaggattataaacagttatatttagtcagtatttcttggtagtcctggtattagttgccaagggtaacaaaaacaataacaaaattgccctttgcaagtagcgtagttagaaacagaaaaacctcaaaataacaatgacttaaatacggcagaagtttatttctctcatgaagtctggaaggagttaatccagggctcctatgtataccccagtgtgagggatcaggtttcttctgtcttgatctactgttcatggctttcattccccaggtcaaggcatgattcaatattctgctagagacccagccattttgttcatttacacttgggaagaaacaagaagaagaaaagaagagccatgtcctttaaagattcttcccagaaattgtctgcccttttccattcacatcacattatcaagaacttaattacatagttacacctagttgcaaaggatgcttatgttttcctggccactactatagaaagtctattacattgtcctaatttcagctaaagattgggggttccaatctttagaagatggggaaaatggatattggtcactgcaattacttcaaaatagtaattagctgacatattttaaaactaacgatttggggtaaaatgattttgtgaagatgttatactactctaaataaaacagatagataaataatgatgaataaatgaatgaactcacttttaatatttttctagagctcctttatttattttaacctctcttttccaacacaatcactctccagtaataatcttctgtagctacatgggtacagatgttttagcagataatgcctacttatttggaaattttctgtcagccagaatgacccagcacattgcattgctcagtttcattaattgtttatctcacacatctgatgcttttagcaatctagaaacttccctcgtgaacctggtaaaatgataaatgaaagaatcaattgggccaaaaacactttccagctagaaggattaatgctactgggtgttttttaacgagtggctgtattcaaatgagtaacttctgtttagatactctcatgtctaccctatttttaataagattacacattgaaaaaaatgtaatacattttaacagataatgatggcggcaaagcagatgccatgacttataatgtgggttgttatctatctgctgtttggacccgagcaataaatttcaaaatatatttcactgatgtctgctatatattaaaaataatgcagactatttgagcaaatcagatctctaattttgaaataaatcatctgtattattaaacaaatggtctggaattagaattaagggcatatagtaggcaaacaaacatctttgattttattctttgatcatgtctagtagtgatatggaaaaaaaagaaaagggaagaaatatcctgttctgagctgctcatctataattccaatatctgtgaaaactcccaggtctgtcattcagaaggacgacttcttccctcatgattgaaactgaactcaaatgtgccaaatgggccaataaagctagactcttatacagtgatgcttcgataaacaaactcaccatgcagcactttattaatcaattcatgccaccaacaagtacattaaaatgacaacttatgcaaattagagctacctaattttccagctgtgaggcatatatttgcacatagagcttctattagtcttcactaaactgaagaagataaagttgtcaactctgaaatttattttccctgttcccagtttccctgttcgcttcctttttctatttctgttctctcacttgtgaggataatgctctctgatctattcacaggtttccagtcagttcagctcatgatctgtttattgagcctgacacagaatgagcactggtgaataaggaaggtacctgccctcagggagcttgtgctctagagcagaagtcagacctgtgttaagacccctgatagttacttgaaacaagccaataataattgcattcagatgttttccagggattttcattttaaaaagtataaattagaatagattttaaaatatccatccattaacacttactacttgccatcactcacatgttttctccagtggaagggtctggctgacactttctcataaactgcagcccatctgatcgatgttgcaagccttattaagccttgactttaatgaacatgagtcttgcatgtggctgaggaaaagggtgaggactggtgttttggttgacttatttccatcaaaaagaattgaaaaacagatcaaacgcagtgagttaaaatttatttacatttatctgtagctaatccactttgaagagctctcacctatgttcttacatttcaatattcttacttctagttgtagagctcaaaaagttttctgctttcagttgttcttaaaatttagtgtgcatcagaattatttagagggtttgttaaaacgcagattgccatgtgtcactcccagagtttctgattcagtagatcttggatggggcctgagaagttgcatttgaacaagctccctgttgatgctacttgtctgggggatctcactttgagaactactgtgctagactagaggaattttccaccacagtaagcaagcaggaggattctgtttagccaccagggattagtgaattctcatcagatctgcctacccagccagccctacaaaacagcctcaattaacctttctctggtgacccagacagacactggcattccacagcccttctccatagtccaggagaggcaaatcttgctcctcccatgcacttttcaggtctgcctaaaaacatccttcaccacctctcattgtaaaggactctcagctatagacagttacatgttttatgagacaatttatgttattctaatagagtttaattatttttttaaaaaaatcatctcctatcttacccctaagaagttatttgcaatgcatttccataactcctattttgtgttgaccatgtctctgaatttctcagtatctacactagtcagatcaattttaggtttgaaaaatatgtcaccatagaaaaaatcttatggcttatcaaggagcttagaggttaagagtgggctctgaagtcaggctgcctgagtgtgaatcataactctgttcttgtctaactaggtgatgctgagcaattctttattctctctgggctatagttttctcatctataatatgccttcatcttaatctgttttgtgctgctatagcaaaaccccagactgaataatttataaaaacagaaatttatttcttacagttttggaaactgggaagttcaaggttgaggagtctgtatctggtgagggacttcttgcataattatcccttggtaggggactgagaaaaaggtggatggggaactcaactttttgtaagaacccacttccttataacagtattaatccgttaatgagggtgaagccctcatgacctaatcgcctcttaatactgtaacaatggcaattaaatttcaacatgagttttgaaggggatgcatattcaaaccataccagtctacctcataaggttttcattttaaatacaataatatctgtaaaatattcaaaaaagcacccagaacaggttatttaataaatagaaaaaaataattattgcaaaattactgtgattatattgggggcatatataagtagaatttgattcagtttcttaataataaagaatggccatatcattggaagactaataggcagcataaggtatgatggatttctttgaatcttaaacttcttgcaatagtcttcttggtaaaacagttgagattacagacacactaaaatctggatgatggttgggtttttctgcactctgccatgggttttaaatagtttgataaggaattttgtctttaaaagccatgacctaatttaggtgtatgaacatgtatctcaattcaatccaaaagcagtaaactcccactgagtgtgcagaaagatgatctaagttcttgtgtttacacagaactctatgtgctgggtactattattgtcttctatttgtagataaggaattgaggcttggaaaagagagacgactacacaaggtcacagtgctaattaatactcagcagaaccagtactccaactcatacagtctgacactatagaccatgctcttaactattctgactttttgccttggggttggtcccagagaaaactactctcagtaaataattagaattcaggcaactctggtatcagcaaaaatagagaaggtgacacgtcatactccatcccactaagtacagagaggaaattcagtggaaaatttcagcaccatgacccttggtgtctgagaaaagggaagtgagaagttgtgtgttggggactggacacaagagcacacagaatgaaatcacatgaagtgttttaccatctggatttttaaaaagcagaccggctacatttatgtcatataatgatcactcagaaattacatcatagcctatttttatactatcatgtagtaattggtgtgctgctgattaagaccatcaagaataaaattctaggctgctactgtcaggctattcagcattctgttagacaaattaaaacatatgttgggagtccactcaccatgatctttttggtaagatgaggtaaatacaattaaaatgatcatatgaagtagaaatgacctaaattgaggatccgatgagagaatgatagccaggaaggcaacattatgttgacagcatgggaaatctgtgaataaagaggtggaaacatacaagatatatttagtcattgtgcttgggacagggaaataatttcaaaattcagactgagagcacattgtggaaggctttggctatctcgctaaggagtttagattttattctatatttcaaaacattcttttaaggcaaaacacattttttcaaacaatctccaacataggtctcttgactgagacattttcttccaacaaggtggggaaacagggaaaagatttagccccctacctaaaacaacttaagaaaaaagcacagaacatatgatacaatgggtttaaataattgattaataaacacaaaggacactgatccctgaaagaggggagcaaacaaggtgagctccatgactgcctcagcttgaagagtttccaagacataacacagggagttttcagaccatgaccagcaacctctttgagttaaggagatgaagctagcagtctgtagtggctgagatggctagagtttatagagcagagtactggataggagagagctgctcagagagagctctggggaactgcagaggatccttatcaagtcatcagtagtgtagtgatctgtgcatgtgtatgaggaaaggaccacccaaataaattagaagaaaagtccttggagccctttagaaatagtttttgttcctgcaagccagagtggaaaacttcatacttcatggggaatcaggaagtgtattcacaagggtttcatgtcaatagtggagattagccgtaaactaaacactgctcttgtcctttctagcaaaacttaaaaatccaaatggaaagaatcagtttctaagtaacttaactgcaactcaaaacaaagctcaaagatatctataggaatacaaatatatctaccacctaacaagctagaattcacaatgtctggcatctaattaaaaattaccaggcagaaaaggctatacactgtttgacaattgtatgacattcttgaaaaggcaaaacatggagacagtgaaaatatcagtgatttccagggagttgtgaagagggagagataaataggtggagcataggggattttttagggcagtgaaacttttctgagtgacactatagtggtgaatatatttgtccagacccataggatgtacaataccaagagtgaaccctaatgtgaattatggactttgagtaataataatgtgtcaacgtaggttcatcaattataagatgtgtactctggtggggatgttgataatgggtgaggctatgcatgtgtagggacaggggatatatggaaaatctctgtattttcctctcaattttgctgtgaacctaaaactgctctaaaaatacttaaaaattaccacacattcaaagaagcagaaaaatacagcttaaatgagaagaaaagtccaatcaaaatggacctagaaatgatatagatgatggaatgagtagataaaaacattacaatagttattataactgtatttaatatattcaagaaaccataggaaatattgaatacaataagtagagcatggaatagctgttctggttcaagaagtgttgacttcaagatgagcgctatcatggggttcagtgaagcacaatttgagaattattgctgtaagttattggaaactattgaaggcttttcagcaaaatttggcttaaaactagtggtattttacaaagactgaatgggtagcaggatgcaggacagaactcatgaatgagggagaatgagaccaaagatttcaggcaggtggtaaccataatacaacagagaaatgagaaacctaaaaccagtgggaatacaaagaaagatattattatttttaaaattaatgtgtatgataacatgacagatcccagagaagccggtgggaccccagggagagttctctttcctttgagaagggcagggtgtgcttgaatggcttcattccaagagagtggcctgtgcgttgtaaagtgtcatggttcctgcagcatctggtgagttctcacgggcacttgaaactctgggggagagggtgtaaatcgcctgctgggccatacccatatttgcagcaggtctccaaggtcaatggcctctgatatgctggaataacataggtaagagagaatatttctaaaatattataaaagtaaaggcagatcacgaggtcaggagatacagaccatcctagctaacatggtgaaaccctgtctctactaaaaaatacaaaaaaattagccaggcctggtgggcacccatagtcccagctacttgggaggctgaggcagaagaatggtgtgaacccgggaggcagagcttgcagtgagacgagatcgcaccactgcactccagcctgggcgacagagcgagaccccatctctaaataaataaataaataaataaataaatacataaataaaataaaaataaatactttattactaagaacacctattagcaacaggtcttgccatttgaaaaattaaaacttgacacttagagaggttacgtaattatcccaagggcacaatattacagtagaaactgaaagaggtaaaaactgaaaaacaactgtcagatttgtaggagaggtccactctcatcttagaataagtaatttttagggaagcactggaagggagggaagcatggggagaaagtagttgagcttttctcaagaaagagaaaaaagagagatcaaaattaaaatagaacattttccctatataaagatcctaaatgttgtcatctgtgacagttaaatttttgtcttgacttgagtgggccacaggatgctcaaatatttggtcaaacattattctcggtgtgtctgtgagggtgtttctggacgagattaacattcaaattggtaaactgagcaaagcagattggtctcactaatatgggtagaccttatccaatcaaaaaatctgaataggacaaaaaggctgacctcctgagaataagaaggaactcctcctgtttgactccttagagctgggacatcagtcttttctggtctttggactctgactaaaacattgtctcttcttgagtctctattcttccagctttcaaactggaacttacactgtcagatctactggttctcacactgaaactacacattggctctcttgtatttccatcttgctgactgaagatattgggacttctcagccttcataatcatgtaagccaatttcttatgagaaatctctcactcttgctctctctgtacacacatacaacacaccctattggttctgtttctctgcagaaccttgactaatatgtcatcttagaaggactttcctactattgatttaggaagtactgtagttctttaagatacgatcaagggtatggaacccttgttgtttaagagaaggcagtaaaattaaaggtcagaggtgtaccagggaataacatcaaggccatgcctatctggatgatgaactcatcaagaataagtatactgccaaaccaatgtattggctactgagcgtgtagttccactttaccaatgtttcaacaactggtaactaatgtattcagggttgaaacatgatgacagtgattatgatgatagaattaaataaggttttctatgggccagggtccttatttatgagataaatttgttgttcctagtctcaaattacgtcttttgtgactgtactttcatttgattcagatatatttttaaaaacaataaaagctttttttttttttttttttcatgagtattgagcaggaggttaggcaaaatgggcgagaccaagtttgctctgaagagcaacctgtccttgagaaggtcccaacagaatgcagtagaaagaagttcaggcagaagtgcatgccagaatttcagggaggtctggcacaaaggcggggcaataaaaacactaaattaatgcccagaagacctgatctcccctaattatcaattatttactagctctaggatcctgggcagtttacttaatccttctgagtcttagattttctgtaattaaattattgaattaaattaaaatgtgaccaccatgctcacctgataatttttgatgatcaaataagagaatgtataaaaagattaaggtggtttgttaaaggtaaagtcctatacaaatattggttatgatgatcaaccagggagagatacactggaatctccaatgggcaagcaaaaggtttcaaagtatagggtaaggtgccagactgtgaggagggagttgggactatatttcgtgaaagacttggggactgcataagaccttaatcatggaggaattggggttctgtaaaggaaaccagaatacatgtcataggtcaggaatccatttattaggacttggttttaatttaggatttgattaaaagacgaaagcctaggtaatggaatctggacatacaactacaactggctagtcagcaagttcaacaaggtgaaactgctaccctgccttcccctgcagggggtttaaatacctccagataaaagctaggactgacctgagaatattgagtgaggctgaatctatagatgaagggaaacaatgtataaccaagtagatctttaccataagcattttttaaaaaatactcttaaaacgattgacttatacatttgaagagcttttttgaaagattcctgctttccattcatgggtcactaccaggcatttcttgtcattaatctaaggagtcctgtgaaatacatgagccttctccagctgctgcacaaatgattgcactgctcagaaacagaattctaatgagatgcctaggttttatagaaagctgaatgatagtaatcactaaggctcacatcagaaaactccaattgcatattataataaaacccaatgtcagccatattatttatcttgaaaatagaaaattagaccagcctatttgatagtatattttcttctaatatttttatccctagaaggatgtctcacgaatgctctatcaaaccaatgacatttaaagctaaattaaaactatttggtctttcataagtcgaaaaagtgaagtattcaattatcattcagccagaaactggtttaattttgtctcaactttttatcataaagtaatatggtaaaaatagtctcataattgtcttctttacaagttgtttctgaagcttaagaaaaatgatacaagaaatcattaggtcagattcagtggtttatgcctgtaatctcagcactttcggagatcaaggcaggaggagcacttgaggccaggagttcaagaccagtctgggtaacatagtgggatcacatctctaaaaaaaaaaaaaaaattttttttttttagattagctgggcgtggtgggatgcacctgtagtcccagctacttgcaaggctgaggcaggaggatcacttgagcccaggaggttgaggctgcagtgagccatgatcaaaccattgcactctagccagggtgagagtgaaacattgtctcttaaaaaaatcattaaaccaagatgaaaataaaacttcactgtttctttctgagaaggtaacttttgatgatgtgcttggtatttcagttcttctgtattcccacctggtggaaatttaacataacacacagctcctcacaacatccaacaccaactggggtctattatctcaaaataggtgtggaagacaatgcagcattggtattgtaggacagcaaatttcaaaacatggttcccagatcagtgccattaacattgcctgggaacttgttagaaatgcaaattcttgagctgtcccagacctactaaattagaaactctgagtatgggtgtcttagttccatctgggctgctatagtaaaataccatgaactgggtggctcacaaacagcagaaatttatttctcacagctttggatgctgagaagtcaaagatcaaggcatcagcagatttggtgtctgatgagggctttctttctgctgcatagatggcattttctcactgtgtcctcatgtggtgggggggcataggtctctcttgagcctcttttgtaagggcactaatcccatttatgagggctccactctcatgacctagttacctcccaaaggccccacatccaaatatcatcatattgggagttaggattcaacatatgaatcttatgggaatgcaaacattcagtctatagcagtgtgtctggtgggtcccagtaatctgtagtttaacaagacctccaagattttaatatacacccaaatttgagaaccactaaggagattctaacaatgtgagagcctagtaaaagctatagagtgttttttggggggttttgtacactaaggtaagtgtattaagaaataatattaactgtttcgacttattatttgatcttcttatagttaataaaacaggccaccccccaaaagacaaaacaaacaaaaaccacacacacatccaactctggcatgagtattcgctaaacaagatgtcccctaacttgcaactcagaatagttggtaagggttatttatatgcatattgacattctctttgttgtttttgttgctgaacaaattgcattagaaaaacagttgcatgtttaggcagggcgaggtggctcatgtctgtaatcccagcactttgggaggccgaggtgggcggatcttctgaggtcagaagttcgagaccaacctggccaacatggaaaaaccccatttctaaaaatgcaaaaactagccgggggtggtggcacatgcctgtcatcccagctatttgtgaggctgaggcagaagaatcacttgaacctgggaggcggaggttgcagccagccaagattgtgctactgaactccatcctaggtgacagagtgagactttacctcaaaaaaacaaaacaaaacaaaacaaaacaattgcatgtttaagacagaaaggaggaggaaaagggggttgatgacatttgtatctattttcttttattagaaaaacagttgttcaagaacatcactccactcagcagatttctacagctcattggccaaaaccatgtcttgggacaatgcctagcatcaagggatgttggaaaagcaaatgcagaatcttatttctcacactgtaaagtttatagttctttaagaaagaactcatacaggtaaggaggggagaaaggtgctaacattgataatgggtcaatctatagaattacaaataggggatgccactcagggttctaccaagggggaatggcccaggtggccataatgaaagtaagtatacaagcagcatctttgagcttcagtgacaaaagagtaagtggggtatgtcaaatagaatctaagcccccaagtttccaataaggggccttcccatacaccttcaaagaactatattagaatgtacacttacgggatacctcagcatttatcacttgcccctcctggaagtaataacttattggcctggcaaaacttgggagactctcctatcaaagaacacagcatcctggtgacaaggttactgtttgaaaacagatagtgcagatctctcttttgaagctatttctaagtgaaacatattctccttcctcagctacttctcccacgtggcaaatacactggatagttctcttcagagtaggaatgtatttagtgctctctccctgcaattggatggggaaattcaaattgagtcaggagagaggcaggcttgccaatttgagaaatccaccctttctattataaagctaaatctatattttgactacttttgtttttaattgattataacttacagagatgggagcaggtatgatcattcctctaaatctctaacaaagaaagagtaaagtcatagggaggcctgtacaaccaaaacagccacacactctcctgagaggacacacagtcccatatatcacctcattcatgggtgatgtctattcctctttaggctcaatcattctacccctcagaaatcttgtgttatggtctaaatatgtccccaaaaattcatatgctgaaatttaattgccaatgtattaataatagtattaagagggagggccttcagggtgatgattaagacatgagagcaaagtcctcacaaatgggatacatgaaatattttacccatataaaagaggctagagggaactagctagatcttttgcccttccactttctgccacgtgaggacacagcaacaaggcagcatcttagaagagagcagccctcatcagacactgaacctgttggcactttgatcatggacttcccagattccagaacatagtttacaaattacctcgtctgttttgctgtagtagcacacgtggactaagatattctgtaacctaaatactgggctacaaagttaaccactattaatatagcttaccttagacagcagataaatgggagacggggaaaaacaaagaaaaataattaaaatgggaagaaaataatacatagcccacttcaaggttgggataaaatatgcataattactacagtcttgtttctcaaagtgggcatgtgatcatcgctgatatttctgtctccttgcactattcattctgtccctttccccttggcaaacacttcagttggtcagtttgttccttgtgggatgatccaaactgtcatttctgaaaggcctgggtccattagcagttaatgtggttttccactgatttttatcccagatctaggaatactaagaggtgctccagatgttctcctgtgtttcgggcattcttcttactgcttccgttgtgtattgtgtgggatcattcatcctagctagttgacaaactcctcctttcctgatggcttaatatcagaagctccaagttgttagatgccagactgagcttccagtttaaggaaatctttattgtatctcttggcaaaagaatttcctacttgggtaaccggaaactctaatccagcagaacctaacgtcaagaacaggaagctgaaatcctgcctgatcaatgagactagaggagctcatcctccttgcagataaagcatttgataaatattttaaattctttcaaactaagaagtaaacctctttaatttcataaggcatttctaggaaaaacttgcatcaattatacttaattgtgaaatgttaacagcatacacttcaagattgggaagaagataaaaaatgtctattcaaagcaaaattttattgcaggtcctagctgctgtaatgaagtgacagagagaaatgaaagtcatagaaatttgaaataaagaaataaaactatcactgttttgtggacaatgagatgtgtatataaaagttccctttaatttcataatttatgagattgagtttatcaagttggctggttgaggtgtcttagtctgttttgtgttgctataacagaataccagggactgggtaatttataaagaaaagacatttcttacagttctagagactaggaaatccaaggtcaaggaaaccacatcccgtgagggtcttcttgctgcacatcaccccatggcagagagtggaagggcaatggaaggtgagagaaagaaggcaagagggaactgttctcacttttgttaacaagcccactcttgcaatacttgcaagcccactttcttggtaacactaatccattcatgaaggcagagcccttatgtcctagttactttttattaggccccacctcccaacactgttgcattgtgtagtaagtttcctacacatgaactttggggaaacattcaaaccataacacaaagttaatatacaaaagtcaactgtgtttcaatttaataaatttagaaaataaaaatttaaaacagctctcatattattgagtgaaagacacaaatacatactaatgagtccatatatataaagctcaaaagcaggtgaaacaataccgccgtgttaacactaccgtacttaagt

SEQ ID NO: 367 - DNA, 252099 bp, Homo sapiens
tcatctcccacccaaaactgcactcaggaggagacagagcagcccagtaataatgatcacattgataattaagtatctaagtatccgctatgtggcaccaagctagatgctttatatatatttttgcaaaggtatattatctctattaatggggatatcagcgctcagagtggttaacttgcccaaaaggctagaacgagcccaaatctatctggctctgtaactcatgtctttctatgccatattgccagtccttaactcttaccttctacagagtgtcattatctgatcctgaaattaaatgaagtcagcccaagaaaacacctcggggacagtggaaaggatggggccaagagattagtgactagtgtcattcatacttcaatgtgttaaccagtgagtgaggaaccaggcagagggagagatcagctgggatactctggagaaccagaatttgcatcctatcaagcactagggagggaaggggagaggagagtgaagaggggagtgagtgttcaaagcgatcagataaggccaaggtaatttaacactataaactttgctttttccctcctaaaacctgctcctcctctctgttcctgccaaggaaaactcatttaattcttgtaagattaaccaataatcatgggaatgccaataagtcaaaggcagggaatagatttctagtttcatggctgcaacttgagaagactgatcaggaagttggtgagaaaaagaggcagagagggaaggaggagtgtggtttggggtcaaaggtgtaataagaggaaaaacaaacaaacaaacaaaaaatccaaagttaaattttactctgtgctgagattccactctttttggccctagccagaaaaacaacctttgtcccatggcagccaactggagggccagcgcctacattttaggttaagccaagaagtgaaaaacctaacttttagttcgagcgtgcaacattcccaagattgggttaaattcttccctggtctcctcttctctcatgcaaacaaggggaggtgggtgctcgtgctgacagaagttgggatttcatctctccctggagaccatatctgcacactgcttcttaggtccctcctttggcataatcaaaaggcaactgcaggaagccagtggtcagacggactttcccacaataccaagttagcaccatgtcaggtcagaagagttctctgaaagccaatacaaacagagccaggcttatttcccagagggacatccccttttctcgggcaatgtgatatccagattgtttctcagattggccgctgcccacacatccaggctggcaagccaagccctagggttgattttcaaatctccccaaatgacaagcctcctccctcagcagggactgagaatgacggtgatcttgggaatcagaaaaggggaaaccctccctgtcctctatccctctatccctgttgcgcaaagaaagagaaaactaatgcagtgtgatgtggaggtgatgcctgatgaaggtgcactggaggaaggaaggctggaatatggtgctaatcagagaggagtgtgagaattttaagaagctgatgtctgtttttatccccttggaagttagaaccttaggggcactaagtgtggcctcaatctatagggctgcccataaattcatctataaaaaggtcaagaggagagagatccaaaactgatcacgacaatgtctagcatcctttctggtctactacgtaccaggcataatttttttctttcttttatttatttatttatttttttttgagaccaagttttgctctaattgcccaggctggagtgcaatggcctgatcttggctcaccacaacctccgcctcccaggttcaagtgattctcctgcctcagcctctcgagtagctgggattacaggcatgcgccaccatgcccagctaattttttatttttagtagagatggggtttctccatgttggtcaggctggtctcaaactcccgacctcaggtgatccgcccaccttggcctcccaaagtgctgggattacaagcgtgagccaccatgtccgactgtaccaggcataatatatgatctcatttaattccccacaacaaactttaaggtgggtcttattgtttccttttcatagatgaagatactgaggtctcgagagtcttagtaattcacccacaaatgttggcactccttggggcatttgtcatcacttgcctcatttatttctattgaactcgtattgctctcagattctacttaaccaggaaacactcattagaagccctgccctgagccaaggaaaaagaaagcttgggccgattttgcttactcttgtgtccccagtgcaaatcctggtgctggcatagttgttgttaataagattttatcagaaaatgaaaatggtccatcttggctcctgcttaaaagtgaactatcttccctaagttggaattcaagaagcctgaaaaactgatgtccaagacactgtgtagtgccagattatatgagattcgtaagtgtttcataaacgatctttctctcaagagtgtttcaaagcaagactggactacactcctataccctgcccctttctagttggctggatgtatttccatgtctgtggcctctgcttataagcttttgatttgcaaaagtgtcaagtctgaagatgaagcttagccatgtgaaataaggcacttaacaattcctcattgaaaaatcacagaaatgtttttttcaaagatacattttaccctcttatctatatttatttcctcagaaaacaaaaaagaaagaaataggctgagtgtggtggctcacgcctgtaatcccagcactttgggaggttgaagcgggcagatcatgaggtcaagagatggagaacatcctggccaacatggtgaaaccccgcctctactacaaatacaaaaattacctgggcgtggtggtgtgtgcctgtagtcccagctactcagaaagctgaggcaggacaatcacttgaactgcaaggcggaggttgaagtgagccaagatggcaccactgccgtccagcctgggcaacagagtgagactccatctcaaaaaagaaagaaagaaaggaagaaatccaaagatgttcatgggattccttttcctcttttgcaggaaaggcaattcagatataccctctttaaaatagtaaaatacatgtaattttccacctttaagacaaacagttctccatttgtggagagacttctgaaaatagatgcatctgccccaatgccagagctttgacgctggtgtatctgtccgaactcacagatcagtttttcaatatattgtaggtagtctgctctccagcgtggccatgattaattctgtcagctctgaggaggaggccatttgagatcctgaacccccacctgggtacgcctcactgttgacttccatacctgcctagagcaatatgcgttggctttggcatgtgcagggccaggcattgccatcaatggagttcattgttttgcagcaggcacctgcacctgcacggcaggctcaaacaataagtccataccccaaacccctcctttctcctcagggcacctactgtgaaagaaaacttgttgaggcctggaagcccactttcatcataattaggcttctgggccaacagttaaccaccaacgtctcttggtgaacacatgaagctacttccaaatcttgggtacctgcaaagccatggggcaaggcagagttagtgttggctctgtgctcctcttgcctctgaagaatgttaggcttgaagaatgcagagcactgcacatgctataattctgtcctgtgacttctggatgctttagttttcacaagggcacagagcaatcttaggcattctcacaatcctcagatctgtgagaacaccatgagtaagagacctggtcacctacctgaaccaggtcttaaccagagccacaagatagcatcccacactgcagttcatggctttcatattcaggtacacctgggtttgaatcttggggccaccatattcataatgcatgaatttggagtaaattgcttcatctctgaatctctcttttttcatctgtaaaatggaaatgattatgcttatttttgagaatttaatttaaaatactggctgtaaaatattaagcacaggtcctaacccacagtaatgagtccttaataaattatagctattactctgctgtttcactaaaagcccaatgatgaattaagtttaaaaatatggtggtagaataactgacaatatattaagttttgaatgtccagccttcaccaaaatgtacggaaggtgtataattttgaaattgaaattggtgaccaaactattacacatcacgcaaatcccagaaaacagagatcaatggttgctttggtttgtaatcaaaatgtgggattaagagtattccgaaatcttcaagttctataatattaaaaaaaaaaaaagcacgtacttcattggaccaaattttaagacaaacgttaagcagtttaggtctgctagtcagatgctatttaaacctattatttcctgctatttgttgggacaaatcacttcgtctctctgtgcctcagttttctcatctgtaaaataagagtattatcagtatacttctcttttatcagtcttatgaggattaaataagataatacaagtgaaagacttagcccagggcatgactcagtaataattcaacaaatggcaactccatttactcttacattgctgccaacaaaactgtttccctcttatttgaactgtttcctgccctctagcatcctctgtgatggaccttcgttactgttaataggaaaatcttgacattggcggcttggtgatttctaacatgtgctattaatttgacttatttctcctcacaaccttcctttaaactcaacagaaaatgtgcactgaggcttctcaccagaggggcagcctgtgggaatggcactgcatcaacagagagcaagaaggggagacgcaccaaagccagggcggcccacatggatggcactggctcaggtaacacgctcacgatttgatcagtattcccagaaaggacataagctagaacctagtttgatttcaggctacccaggcaagagatcaatgtgaatattaatgtgatctctaccagaccaatgggtttgtgtcttcacaggtgagattccagaactttctggatttggtggtataccttttattccaaacctcaaaacatatttgggtatttttctgcttaaataataatcttctatgctaaatttttataaggacataaaattaaatgtgcttacaagtttaattaagttaattttacagataagagtagatataattggaacttctcaggaaaactgaagatatacgtatatgttgtatttgggaaggacacaaatgtatcagaaaaaaagtcaagaacatttaagaattgtttcatctctactgtattctgtctaatcagttattcaattagttaagagctagctataattctgtgatgattgtggagctacaactaaaatgtaaaattgataggtttataaaaaaatttgtggtcttaattatttcctactacccaagaatgttatttacatctttttttatcttttgggttttcccccctaattttaatatgattcttgctttttccaggttttgttgcacacattagaatattaatatttgggttcattaaagggggttgattaccttctagtttgtatatgtttcttccaaaagaagaaagcaaaggcgactattacttcctttcccttcatttaccctgcctatgatgtcaataggatagaaagtacaattaaaattaggtttaaccctacacttcttaatatgtgcgtttttctgaaaactctggaatggaaaagagtgcttatgtttacaaatagggcgagatatgtttaagttatcattatctaatctgaacactaatttggaactgattactttgctgggttatgaaacaatctcagcagtttcacaaataaaagtccacaataaacccatatactcccacttctgcactttcttgaaatccagtttacattgtcttgcctagaatatgctttaatagaagtcaacattttttggcatagaaaaatcaacgattctcgattcagtcagtcttctgtttaataaatcaagcaataattacaaggcagttaagaaatggggatatttaaatctactggataatttggtaaggtactggaaacaccaggttgtttatgtgatttttacaaataagacaaagaagtgaggtagaaatggatattgtgctgaaattttattttcaaatgttttaatttgaatttattatgccaaagttccaacatcgtcattcttttttttttttttttttttttttttgagacagggtcttactctgtcacccaggctggagtgcagtggtagtgaaatcttggctcactgcagtctcaacttcccaaagctcatctcccaccacagcctcctgagtagctgggactacaggcacatgtcaccacaaccagctaagttttgcattttttgtagagatggggtttccccatattgcccaggctggtcttgaaatcctgggctgaagtgatccacctgccttggcctcccaaagtgctgggactgcaggcatgagccactgctccaggcctgtcatttctgttatttctctgaataggtgtaaaggcttataagttttgcactaacatagaaaattttgattctgcaatattggataaaaatctgagaaagagtaattgggagaaacatgtgtgataagtacatggtggattcccttaaaattctgtctctttctggaaagaatctcttttccctctgtaccttgtggggtgcaggtacaggacactggtagaggtggtggggatggatccaatagagccatgggccataaaacaatgcagatcccatgcattttcctcaacagtcacatgtacgagcggcagtgagggcgttctgtaaaataacaagcctcgtatgtaaaggcagctcatgagctgcctacagctccagctgttcttgtttaacataaatgtccctttccaggtcatcacagcctctaccctcccattgttaacgctgcctgtttaacccagttatgtggcgtgccccacctcgtctgtatccaattgtgtttctaactcctacagcaaacaaaaacaacaacaaaaaaacaagcaagcaccaagaagtcttcttcatacgtacacagaggaatcatctgtcttaaaaaaatgatagtggcaataacttcatgcaaggttccccaccaccactatgcccttaagtctattattcagaccctagtgtgagtgatttcaatccaatcaaaatccaccagtacaggtaccccagagtggacattttgttgatgtggaggaaaggaccacttcggaacaagagatagtgtgagcatcatcgtagatgccaactcagagtgaaaatggcaattttggacaaaggactaaggatggaatagtggcatttgtgacctgatgaaagaggagtgaaagacaatgcagaagaggggattccacagagggaggtatcctgaaagaaacaaacaaacaaaaaaagttttgtttcctttctcggtgggaacagctggtgtgtcctgtaaagactcggtggggctccttggtgtgaagtttggaaagttcatatctcagcttatccagtctctcccagtccattgtagattccacatccttatccagtcctcaccttggaggggagaatggagtgtcagggaagggaagggaggtgagccactgccctcttgccttgcaattcctcttccccagctgcttcggtttaatacccatgactttctccatttgaatacacgtctattccttgcaaatcctaagtgtctcctataaaataaaactacttggagaattaatacacttgagaaatcaatgcttttctctcttcacaaagaaaaatactgacaacatctgaagggaaagaagggaaagtaagaccacgtatgggcatgcagtttcagaaacggtgtcttggaagaagtctgctggaatacctgtcaggaaaattctgctggctgacacagagttaaagctaaaagggaaaggaagtcatgatctctgaacagtagccattcaattattttttaatcacagtaaaacaaaacaaaacaaaaatggccaataaaaataattcatgcctttatgttcttacccccaaaaaaaacgaatgaatccattcattcctgactcatatatgtatcacattgcctaataacatgtaccagacactgtgataaaggctttacatgtgcaatcttatttatcctcttaatagtctaatgagacaggtactgtcattaatatctaattttacagatgagagaactgaggtaaagtttatttatttgctacacagctagtcagggtattttcagaatttgaaatcaggcagtttaacttaaggcatgggccttcaattgttcctgtgtattcttcctttgtaactgccatctttctttgatccctaaatatcttttttttttttttttttttttttttttttttttttttttttgagacaaggtcttgctctgtcacccaggcgctggagtgcagcggcaagatcatggctcactgcagcctcaacctcccaggctcaggtgatcctttcacctcagcctcctgagtagctggaaaaacagacatgtaccaccatgcctggctaatttttgtatgttttgtagagatgggagtgtcaccatgttgcccaggctggtcttgaactcctgggctcaagcaatccatccgcctcagcctaaatcttgatctctgccaatagagccaaacgtttttaaaaaggcaaaaatctctctataggtaaaagttttatttcaatgataatattctcaaacatttcttaagaaatgtcttcattttctaagaaatccaattactgtctcatacttccaggattctccaattttttttttccaggatattatagtccatcaatttccatacgactccacacacagtggtggaaaccagggtggtttggggacatgaaagaaacctcagccacaaatcagagttggtcggatcaggcagtcagatctgtctcagcaagtctttggttgggatagtcaaattccaggcatttttatctctattttcaatgaagcttgcattatttttgcttcatttatgcacatcactcagatggatcacaaaaccatttaagctcattccttttcaattagctattattgaactccagctgactccattcagaaatgctgctttcagtgaggctggatttgggacccggtcctcggttttagcccttgtgtatgtctccctgtgaaaagggaacatcacccctgcttgtgttgaaaagtagcactgcttcttggaaacacaagatgctgctccttttcaggcatttgcaggaagaaattgctctcctgcagtattcatgtaaccactaaacccacagccacagggtgtccccggggcttaccttttctgttcagtgtttgatgccctgtggtttttctctcacagagaccacagtccagtcatcatggcacacatcgtcttcaacgtattgctcaaaggcctttctcagagagtgaggtctgcgattctataactgcactttctttttttttttttttactgtcattgtttagaaagcttgggatgactgtatttattaggaactgcaaggaaggattatatagatatacacagatatacggttaaatattgaactgaaatattaactatcccagatgctaataattaaatcagtgctacaaaacccccaaagttaagggccaagatcaatttctgggacactactgacccaacattaatgtaggcagaacagcaaggagacgatgaggagaaaaataaaacatgaggccagagtctgtagcatagctcattttattgtttaaacagtttttgcataggaaatatatccgcttccagtaattgactgcagtatgagcagctgctagcagtataggctggatataacagtaacaatcacattaagtcaagcttgatttacaccagtttaaaacttgtggcaattgagttcatttgcaacccacaaaaagtacccaaagaacgttatcctccaaccgggcacaataaaaccttcactaacattctggcccagtctggggttgatcccagaggcctgaactctagaaattaagtaactgtcgtataatacatcctactgctaaaggtttgttacatggagattgtgcatgtgcctccttttgtaaaaaaatttaattaaaatacaaggttctgtatttatggcccatgaggacaaaatgccaaaagttttaaaatggatcaaccctggtgtgtagctagcaagcaataactgactactcgtcacctacagttgtactaaatgtatctaaagaaacacacagtcctacaaaagttgttctcagagaaatatcattgaggtgggggcagctcttcccaggatgctaaaagttctatatgatataagcacaaattaacagcttgatgaagacataatctactgcagctttgagaaacctatgcctgggatgtagttacccctcacattctacaatgttgtagagattttttttcccaagaaaatgtcatttgaaacatatttacaactgaactcaacagagactgtgaaattgaacaggcactgctcatttgtttgagttttttggtaaacattttgctggttttttttttttgtttgtttctttcttgttttgcatcaacttttatcagtccatgcaacttcaatgccctcgatgaaggatgcataaaaagccatacttcttaaaaaaaaaaaaaagaaaaaaaaagacttccttctgcataaagagatatatttgccacatcagtccctgtagcacagttttcaaaaccattctgtcaaaaatacagtaatacaagactggctttagtgtcactagcttacactgcttttcatgtatttaggccacctgttgttcctggtactgtatcatgcaataagtcatcaagggcttagtctagtgtaccggtaagctagtggcactgaagcgcttttcacaatctcaacatacatttgaattgcaacacacagatatttctagagtattaactagtgaacccttttattattaaaaaaaaaaaaaaactacttacaaccattgaagaaaaaattgcaacaaaaaatgtaaaaattgaccgtctccaacttgtcccctttactattaacaatgtgaccaacagatctgtggcacggacacagtacaaagagttgtcatggcaatgagtttggctgatgcaaaggtcattgtgcagggtcaaagggcaaaatcagtggtccatgttaccccccaactgcagggctccactccacccacacaattttagggaattagaaaaaacaggggaactaccagaaagtgcaaaatatgaagaaggcagctttcagctccttcagcatggagtagaacattcatttttgagcttttactattgaacttgaatagcctgcacattaaaaaaaaaaaaaaaaaaaaagttttctatagaaacccaatttcttaaagtccagaaagcatgcagctggttaatgttaacaaaagaccttgacaggaacatgtaaactatattgaatgtcatgcttggggcctatctgccagcaatattgtagagttgtttcattaaaaatgaatactgtacactgaatatgggataactttctgcagccttcatcatttcacacagtacatagaatttgaatctaggtaaagaacatgtcctgctgtcacaccgctgaagatgtccctgtgcaatctctttcgttgagtccttatgaagctacaagtcacaaatccaagattctgctccctgaggacacgttatgtgagacatagcactgttttagttttctgcctatcctgaatgctctgtgaaacttaaccttaaataccatcacgtaacaatcacaaaaacttttgctaaaggccgtatatactaataaaaagacagtggtgcttcgacattctgaaatgctctggaaaccaacttttccaatactaaatacaacaaaataaccttcataaaatataacttttctccatttacacttttttaaaggattagtatcctatgcttttcaagcacaggaatctgtgaaataactcctaacatggacagattttctttttaatacataacttaagagactggagagttttaactcaagtccagtctctaaacaaggaatattcttgtttactttaaaaatggaaacaacatatagttccattataattgttaaaaagttagctttacaaacatgggaattttaatttaaaaaaaattcttaacaaaactatacagtgtacaaattactgtctacaaggtaggcggttcattaagaagacctttcgctcttctcgctacttgcagcttcacagattcattcacatattttttaatggagctgcccacccgaacattacccgataactatattgctataattaagatttttgccatgtctttatgtacagtctccttcactgccttttatttttttccttagacaagcctcaaatgctcacgtcactccaggggtaacacgcttcagaggcactgtgagtggtgggtggcagggcagcacacaaaggctgaacagtgccacggaactgatggttggagacaccactccctactcatgcccttgggtgaccttcgccatcctgaagctctgcagttctgggtaagggaggggcgtgcaagacctgcaaaagtggggcccttcgtcagaatatacttcctggtacacgaggaggaggccgaaaagttgatttgagattttatatatatagtagtacttttaatagttttatctcaaaaaggaaagaagaaaaaattgatttgaaataaaaaaagcaacacttgaactaggcctttgtattcaagaggcaggcaggaatacccacagtgtgtaacttggttagctagaactgctcactggcaaaaaagagagcgagtctgcctttaaaaaatactgtgtgtcctgtgaggttcatttgttcacctaataggtcaaagatacatgaagagcttggctgagatgatctgtttgctaccagggcgagtatcacagaaatgattggacttacttttgaacttgcactgctaggatcccgctgtgctgttcagcatttgggctatcaaactgaatgggctaatcaaatacaattctccagcccataagcattgttctaaagtattcattattaaatgatatgctgtgagaacaattgacagtttattttattaggccatggcctaggggaagggggccaggggactccttaagacagcctaccatgtgtcaccaattctgaaagattttccttctagtaatgaatacactcaatgggactgggcggtgagggaaaggcaaaataaaaccagcctccattcagcctctagccctcaggggaaacgaaatcaaatatatagttaaggtaccattccttaaaaaaatcccatcagcatctaatgggtttaattcatccacaggaagattaattgcttaaaattctatatttcccttctgctctggttctcagttttaaaaggggagataaaatgaaaacaggatttacttttttgttccttaaaaattgaactttgattttaatctatcagtccaaatacattcaacaatagcaaccctctgttcaatcttctggatattaaaaaaaaatccaagtgcactgccatccatttgaagtagtaagtcacaggtaaatcatatcctatcattaatgaaatgaaatggggacgaaaagtggcagaaaaggaatacgggagactccctccaacaggtctaatgtgttttctaggagaaagaatattcatgtgttaaactctcaaaagtgttaaacatccaacatcccctatgtggacatttcaacaaatatttttgccaaatatgagacaggctcactctccactgtggatctggaactttcaagaaaaactatcaccaagccaagtctgcctttttaagccaagtctgcctccaggagaatttgttgtgtttgcttgttcttactattgtgttgttatgaaaaccagtaatgagttcagcttgcaacccaggtgggaagttagagaggggaacctgtgtaagttgaagtttgtcacagtaggcagaacagtcgctttgcagcccaggcccatctcagggtgcactgcttcacagctacactgcaaagtgttaaaaatcctcccacccaccccagaatatatatatatgtatattaaaaaaaatcccctgtccatctctcagtacacaaaaggacctcatcacactgcaaaaatagcagtacccactttggtcaattaaaacaaacaaacaaacaaaaaagcatacattattttttttttaaatctgtgtacttacctataataaccaatacagctaaaagcactacctacataggcaaaacttggtattgcataattcgtataaatttgaaacccctcccccccaaatattaattggaagatgaaaaacatgaaaggttaatagaaaaaaacaccaaaatactgaaaatattgctggtcgattacaatttttaagcggcaactatacacagccatgatatgctttataaatgtgagataaaggtataactgtctaaaaaatccatgatgtcacacatttttcttcgtctggagtacaaaatattttgtcataaaaatggtaaagatttaaaatgataataaatgcagcaaaacaagtgtagtgatgtcactttgttgtatttttttgtttttttttttttgttttttgttttttagatttcaaggcaaggcacgtaatgtggacattatatcttcgtgcaaattaggattactggaaagagtatttttaattaaaattttaagagacatagaggcaaaatgtgtctgcccatgcacactatggatctgtcaatacaagaaatttgttgaacaaggctaatgtctgaaagcaccatgcaagttttcagcaccctgattacatttgttttctcaagagtgcgtttttatatcctacaccctggcgttcccagtttgtaaactgtaagctttacccttgtgacatggatttgcctgcctctttgtctctataatgcagattttatagaaccttttgtacaccctatgggttcttgatgcaaccagtaattttaaataaataaattctacctccaaggaggctgcagctaaaccaacataagtgctgtgttttcattaattttatttttctcaagcacatgatttgtcttgatttaatgcctttttaatgccctcaaaaactgaggggaaaataaattcgttcaaaattattttaaattctttttaatcccctcaatttagagtccaagggctgaaggacttataatcatgattcccctttagatataaatttataaattgcacttgcctctgttaagtgtttcttttgtggggaaaatattatattaatttttactgttgcatgcagagagaacacttcacctacatagaggcatttcttccatagagcctttgtgttcaaactgtttttttccttttttctttttttcctttttttttcattttttctttttttaagatttcaaactgggttacacactggaaaaggctgggttaagggccgaaatttaataaatctgtactgataactaaaggctacagagatttcatatattttttttaacttttagaaatcagagtgcttataaaatggctggctcatggctctgtcacccagcacctctgacgccgcctcctagccttcgttggtgagataaccaggaatagtgattccatgcgtaaacaacaagaatactaaaccaataaaactagcttatcatgcaaatattaaggcatctagaaagtcagttaaaatatattgtcatagagacagaacatctatttcccagcggacttcatgtaacaaaggctacgttgcaggggctgcgatctaccatcagtgaaatatcatcgaccctttttatgtcattacagtttcaaccttaagggaattagtgattgtaagtgctgcaattgctggtctattatcttctttcttcagtttctttcctttctgcctttgtgttgttttgtccagtcttcctcttttcctttttttttatttaaaaaaaaaatttcttaaactattgttgtgtttctttttccctcagttgcttgtttctgcttgaaggaaaggttctccaattatgttcaaaccgtaattttggacattggccggtaagatgggtgtcctatttgacacttggaaaggaaccaagctagcccaggtaccaggactgttgagaggagagaggcagcagggagggaagaaaaaagaaaaaaatacaatgttaaaatctacaacaatatgagaaatataaattccagatgcatcaaattattgctatccctattttcaaaattacagtctaatatgagataaatgtgccaaattatacatgttacacctatctaaactctatagtctattttttaaatgaaaattaagactaaagtgaggcagaaaaatccagagtaagatatataaacaattattgaattctaaccgattgaggatattctaaaatattttacattaatcaatataaatgcaatatcattcttttttgtacaggaaaaaaaagaaaaagaaaagcagcaatctgttggtaccaatatactttgccagttacattctaatcttattttacctttaattcacaagcaattcagtggtcagatgggtttcaatttcttacctgcctattgggttgaatacaattgaaaagtacggtgaaagatatttcttttctccttacaacaggaaaaaaaactacatgtttaaggtaggcccatgcataacatacaatttgaaatgcccaattatcaaacataccttaatcagagttttttagtaaagaccgaacaaataagaatcatagaaccaaaatggaacacagctttttttgttctctacagaatacccatcgtgaggaaaaacatttacaggaggccacaaaggtctctgcttgcactgattagttctatagctctccagcagttttcttattctaaccctctttaacttacttttagagagagccacagcttttccttccaattcatggttccctacattggcttgcaacagaagcctgagcatttcctgctcctccccatcagtaatgataccacatttgagctgctctgcacttgaggagtttggagtgatagatggcgggttgggggttgggggtgttggaggcagtaaatgataagattccagccttactctcatcagttcaactttcgcctatgctgaattacaggctgttaaaaaaaaaaaaaaaagactggaaaacaattctctaattgctactagcataatctccctttaaaaagtatcatatggaggataaaaaaaatcagatctacatatcatgaaacaactctacagcacacattttgggtacacttaatctaatgtattgcctgttccaacactcaaatccgaatgaatgtcagttaagtaacagctgcataaataatcatgaaccaagaaaacatcaaactgacaattcagtactcatattagtcatggcctagcatggaaacatactttcgaggttttaaatttcactgaacatcctttgctttacttttgaaaccatgaagtgagatagcactattgttgtagctatcaatctagatatgctcatttgttcatatttgaattccaaaagtacaaaaacctttacagaatatcaacctaaaggaacaattctgaattttttttaaaacttgatacatactgtttttactctggtgatacctcgatacaaaatgttgcttgttgctacacatacatatttctgagttaacatttcaaaacaatatcacaacgaccatttgtgctcaagggattttataattagactacaaactcaatgacagcaaagtccgtctctagtaaagtacctagcacatggaagatgctcaatacctttttagacaaacaaatcaattaattgtttcaaatcacacccagctatatattttcaaaagctgtcacccaagattacatatactcatgaatatgttgtgatttgatcccctataaaaagaaaataggtatctctgaatttaaaattagatctacttagcattaacaaaaattgattaagcaggaataatcacattcaaactaaaaagacacgtcctcaaaatctgatgaaaaatcgtaactcttaagaatacttgttattgaaacttttactaagcagcttaactgttttcacatatttatcttcccacacacatcttcaacaattatttttgtgctttgcaccattgattgggaacaatgttacataatgaatcatgaaacttattttaccctcaactgtgtttccactgcactttgtacatggtcctgttacagcatttattacttcataaatatctctatctgggattatcttactaactgaaaggtgaacttcacagagaaaacgacctagtcacatctatctttatagagtctgagcatagctggtgctatttcttaacaaataaaataaattacaaaaatggttatacattatttttaacttgaagtaagaagcatgtaccaaaagcaaaaggactaggtaaagcagataatccttgacagtaaaatacaatgtcaacaagcagcaaattgctttgcaaaattaacaagagtgccaaattaagtgagctcaagaaagtcatttggagattgcatgctttagggatataaagtatattttaatgattgaaaatagatgtggctccttacatggacaagtctaccaactaatggcagaaaactcagggtttattttgcaatagctctcttactcagttctttagaagagacatatgtcattattctttggaaaatgttcaataaaaataaattgatgctagtaactaacaggactcttgctgcagaatgcctaccaaatttaatttaaatgtttatttaaatctttcaaaccgcccatcctacattatgaccatatcaaaattgcagagtgcaatatatttgtcaatactgtttatgaacctttgggggaaaataaatctcaaacattaacactatgcagaccccatatatgagttttacaagtctcttattgccaatttaagttcagaactataaggcacagacattttttagagctatttttggtagtcctgttaaaaaaaaaaacttgataaaactaattcaatgactgagataacaatgtaaataaatatatttaattaaagtaatacagattatttaatttcaaaaatgcaatgtctaaaattgcatacttactcaggtaaaaatgtaatagtgctttttatacatctaactctatataaaaatcaataatcacatgtatggataaaataaacacacaaaaacaaattagttacatgtaaaatgcttaatagttttaattcatagtgagaattactatatggataatcttatgttcattccaactatctgcattccaataaaagaaatgagaatataactgaaaggatttcaaaatattcaagctcaaattcagctacttcagcaatatatctttataagtgtgcatttcctttgttttaatcaaatttttcattaccaaatcacatttgtttaggcaaagagaagatgagcatagctgaaagttgaaagcacatctttagaaaatataaagtagatataaccatttaaaaaagaaaagatataattactttgcaaaaaaatcaagcagaaaaaaacacaaaagaatttgatagtaccttaacacaaagtacagctcatcctaatgactattactatgcatataatgagatagttcattataaaatgaatacataagagctaaatcaaaattccaaaaataaaatgtttgatatcatggatactattttcttgctattttgaccaaatgtatgacatggctccccccaaaagggaagaagcaaatgaattatttagagcttaagatgcattactggtgatggtcctgcttcattttgttattggtaagactacctctgaagtactgtatttcttctaggtagcactgtggaagaaaacctaactttatggcatttacttattgaaaaactcaccaaattatgtcattgcagaacagctaagggtagacagggaagatatagcagttgatgtggaaaggaatgtagaccgcttaagcatgcttcaggttgtagcaacagcacaaaggcaaaacttccagacgatagccatgctgaggacttaactataagcatggtaccatctttggtgttttacatatgctacaccacttaattttctcagtgagctcatgagatggccatcagtatctctgtttcacatatgaggaaactgaggcaagttaagttccttgcccaaagtctcccacttagccctcagttatgactcagatctgtctgatttccctggccatttcactatattatattgcctacacaggaagtcagatgacttaacataagaaagaacttttgaacagagtggtctgaaggcaaaattaattggcttcaggagacagtgaacttttcatgcaccatacaagctggattataacctagctaatgttgcgaaagagactagtgcacagaatatgtagctggtctaagtggtcaaatgatctgaaattctatgtattcatctcctctgaaacaaatctagttgaagttctactagggtgagttctacagcgtgaggattaaggcggaagaagatacccacttcttccttttaaaaagatgcactatttctatatgtcttatcctggataaactgggcaaaatagttcatcttcgcatctacctacaaagagtaaagagctatacctttcagtgaaagaaaggcagaaattgctctcggcagccataccaacattttctggttatgtttttttaaaattatgcattatgggagtgtgtcttctaggccaaaaagaattgggcccttaccttttagctcactaacacctaggaaccacagggtgccacattaaacatgtatgaagccattacattgagccagaaaccaaacaaagtcaaagactttacatcacctattatttatttggaggtgatgaaacaataagagctattttaagaatggcaaaaatcatttattactagcctgtgtgtatttgataatggatgagataacacactagttaaacagtttatgaaatgtctaagtatccagtatacgaatatttttcaggggaacaatagtattgtccatttagaatttatatactggtttaatcatgagaaaataccatatttacttaaaagatagtaaatactctttcaagaagcttaaaaaatattacaggaaaaaagcacaaagagttgtacatattaatacatacctcaactgtaacagtagccacattatttacagatggcaataaaaatgagcaatggcccagaaagcatggggaataaataaaataagtattttaatttaaaagaagcatttgcctttagttcctttgcaacatttcctgatctccccaagatggaaaggtttttacttccttggctaaacactctaattttattggcaaaatattaacacacaagtattagcatttcttgtaaaatgcacaataaacagttctccttattaattgctgaaaacctgttgggaaaactgtgctgccctgggttgtacatgggtgcattcggactggttgcttacttcaatataacacaaaggctgcagattacgtcttgtgaaaaaaatgctcgctcagaccagtagaaggaacaaacacttaagttgaatctatttatgtattagaacaaagaaaatagtacttgataaatataccagttgctagcacttatataatgtgtattatttgccaggtactgttctacatgcttgacctaccttaaaacttttaatcctcataacaaatctatgagaaagaccattattatcctgattttacagatgaggaaactgaagcgaggaagttaagtgtcttgcccaactcgtattgctattaaattgtagaaggcaggatttgaattcgagcaatgtcattctaggatctgtatttctacccactaaacttttctcatctccccttcctgtgaagcatagtttacttttctcactggactagaagttatattatcactgaattatgcaagagactttgtgaattgaggttcatatcacaatgaaattcctgtggaagtataattcttgagcccaaaattcagcacaaataactgtgctttattcctccaattccagttgcttttcagctgaatgcagtatttgcttttgtcttacatatgtgcagatgtggctgtatgtcaataatttgtttgttgagttccacttcagatgaggctagcctggaagtgaaatacacaaagtgttttatacaggtcttgggtttcttcgatttattttcaccgtttttagggatcattattgccgtcggaatgatcctctttgcatgcaagatgattcctaatgattattactatttgtaataatctgtatcagaaagctccctggctagctcttacctgaactgcaaagtactcttgtgggctctctgggaaacaccaaatatcataaactgcaggtggctcatggaattattctaactgcaagcaataggacttcacagtaatgaaagagaaacatatttgtttcttaactaagtaggtaaatagccttctttattgctactccttggggaccaacggttttgaaaatagcatatcaaaatggtagcccatcaaacctcattaatttatattcaattgattcagaagttttttgttcttagggcacagtggattgaatgttaactttaccatgcgtgagtgctagcactttctaagtaaaataatagcatctaccattgaaatattttatctaataaagagcacagggcaagaaaaagccactccatatgggagcactgccactaaatattaaatgtgttccttataattactgcactcgtttagtaaaaaactcttacataatacttgaagccttcgatatagcaacctacacttaaataaaaacttccttaaaatgttcggtttaaacataaataagaaaaaagctcttcctcaattggccaaattaaggacttataaaaaaattgtttgatctttttcaaattttagaactgaaaatgaaagatgaaaaattattatgaagatgactaattataaataaattacagtacacacatgcatacatatataagaactcaggtagctgtgggaggttttagccaattaaaaattatacaattatcaggctcagagcaattattttatctcctcccacagaccacagcacagtggagaagcccacatgttgatttccagcctctttctgtctgtattcctctctaccctgggcttcttttcaatgctattgttaaaagtggtactgctcctcttatttgcatatgtgatgctttaacagcagataaaattctctacaaaaatggtgcttcaaaatagtgcctttcactagagaaaatcacccaaggcatactaaatcaaatagaaatataagttttatacaaagcaaaaagagattcttttataaatgattttcagttaaaagcaaaaatcagcattatttgcacaattttacctcttaaaggtgaaacttacttgtatcagaatgctgaagcataaaattacaaatgattaaagaactgaacacattttaatatcatgcttgctactctgttcacaagggcaaaagatcttacatgggcaaaagatcttcctgtgtgtgaaacaaagtgagcaagagagaataattgtaactttctgcaatttcagaatattcaaaattcgtgttcttcaattacttgaccttaagattttgccatttcttttatcatttattatgtttattatgatatttattcattcatagtctttgttatttaagtaaatatgactaaaaaaatcatcatatccctactaacagcactagcaaaaatgagaaccaaaaaggtaagctaataaatggtgcactggctgtcgagggaactgatttcttacggacgaactacatctgtaaatatggcactttacataaaacatattcaaataaagtaggggtttaatatacttcctttcactacaaagggttaatcagcaaggtttacatttgggaattttcagaatcacgctcctccctctccagtagcgctgccaaaaatcatcgacaggaaacgtaagattaagtttgtcctacctaagcgaacaaagagtgctctgaacaggccaccggtttactgcagagcgggaacttttctaatcctgctggaatctgcagtcctgctcagaaaatatcacggaaaaaagttgttttctttcctctaacatcttgtctcaggatcatctcattttggtcacactgcagatcctgctgcttctcccataaaggttaacttaaagctccaaacataatcatgtggaaaatggacattattgattcctatggtccattgttcccccaacctaagtccctgaagttcaagttcaatctggaattacatcatgtctggtttctcctggttaccagacggcttgagacgtgaccacagctacagaaaaaacaaacagccttcttcacgcttcggctcccctatcgattcaaacgtaaactttttttctttctctcaagtacgcttcaagtatggagcatggttaatttagagattaagttccaaattagattatctaatggcatcttaatggattgctgacccatttcctgtgggatggcagcatgcaagtctggctggaatacaattaatttcttaggaagtgttctgaagagtttgcctagataaaaaggaaatgtcgtgttgtacaaatctttctttataaatggagaaagttaggcaaaactacgacaaatcccaacatattattcaaaagccagaccacagatgttgtgcgtccgtgaaaaccatatcaagatcatttttaagaatggtaatgtttttatttttgatttcataacaggtgcaaataattttgatgagaatagagtaattcctttaaaaagaatattcatatacaaagacaaaagtagttagcagcccctttaccaaacaatgatcatgtgaaattttggtttttgcaattctccaccttgaaccaaagattcttccattcatctaccatatcagcatttctatcatagtcccagagtggtgctaggggcccagaatggtgtataaaaagttgaggatttgaacacactttagagctgacagctgaaaaggaaattcagcactcggagaataaagctccccccaggaactccaggaacaacccagctgttgtactgtagttatgtgtcaagataacaaactgagagcaggaaatgctaacctagtgaattcgcggggatgttctaagtgtaatgttgaaataaaagttaactctttatattacctaaggacatactgcccttatcatacgtatgccacatatatgtggagatatacacacacactacatacacacacacatatagatgcatacacacacaaacacatatatgtaatacaaacatatggtttgcaacccattattgaaagttattttttgtttaaatattcattcttttgagagcatacattttacaaagaaaatgttatgaacaaagcaaggaaaatggctgaggtgagtgttatgcaaattaagttacatggataaaatgagagctattacccccccacactttttttttctttctttcttttttcttttttttttttttttttgccctccctctcctgaccaaccagatccaaataacctttactggctgctaaatttctcttgagaaatcaagcaactctctagaattgcagtaataaacgacaatttcttagaaaaacatgtgtaaagtaactacagaatgaagtattcaacccacagaaaggaactgctaacacatgtaacacggaaaatagctgataaaagtctctttggtgccattcaattatggcatccgcagaaacacaaaaatcctcccaattattttagtaaaatcttcatttattcattatttcagaggctgagcaaatggtttgtgtaaacatatcctttggtaacacgcgcatgtttattttagccatctgaagacttcttctatgtttacataagccatcagacacatacaaccactcacttgtggctttgcgttttcttgaaaggggtgaagggagagaagagagaatgaaacaataaattcagtttctcttttgcataaagcactccctctaatgttttaaaatagcttatgtttgtattattcttggattgtccttcagctttctttttcattcaattatattgatctttcatatctgacagtacaggctatattctgactatcactttaagaaagccagccagtcagggagtaactgctgtatatgtttatgtccacataactcacatatgcaacaaggtaatttgtccacatgagacaaagcacaaacacaacagtacctaccttaagcagttcatcacctatcatcctcctaagatcttgagcccattctgactatactagaagtgagcccttcacccaaccaatattttactctgggttaactgcagttcctgacctttcacttaggcagaaaaattgactctctcaaggtgcaagcaactcctttgcacatgtgtgtgcacacacacacagttcacaaaacagttcacaaaattttaaggtcaaaacaacaaaacatcttcagggttgtaacctaataaggctgtgaaaactttcccaaagagtcagctttggttcctaagggaatgcttaagccttggggttgcgggtggatggaggaaatcttccagctttgattatacttgcacagctcccttggcactgccattttcagttccgacaagagctgcatttgacatggaaacacctcaacagggcaattagtataaagcagaaaagagggtgaccatggaaaagtgattgtacaaagaaagtaatgacaacaaacaacaatcaatcaaaataaagcaaaaccaaaacacccgttttgctttgtccttttctacaacagtctccagggattgccttttgttaaaaggcatctaccacaacaaaaataacctgtgatattttatttattccatcgtgacaaaggcaaattatttaattctttggatgaacagacctatatttcttaaatattttcaacttattcagatgattctaaagccatagccatgccctgaagattttagatgtctattatctgccttaaaagtgctagtgttacagacatttatgacttttttcaaaattctttcaatgttttaaaaataaccacaagtcataaactaaaaaagatggataaagctatcatgccaccgacaagggctatttgtattatcaaatatgaactctgttgtgtccatttttgaaaactacaacaaagcaaagcaacctatgtcatttgaatttatttattctgaactgcatcacacctagattttaagaactgtcagcattggattcaccacagcatttagcacagctcaccataaagattcaataatatctgttcaatgtagaaatgtgatggctgccattatcaattatgtgctttctgaatcaggatagaaagagaagaaacaaaccaagatactggctgggcatggtggctcatgcctgtaatctcagtactttgggaggccaaggcgagcagatcacttaagtcaggagttccagaccagcctggccaacatggtgaaatccagtgtgtgctaaaaatacaaaagttagccgggcgtggcagtgcacgcctgtaatcccagctactctggtagctgaggcgttaagaatcacttgaacctgggaagcggaggttgcagtgagacaagatcgtgccactgcactccagcctgggtgaggaagtgagactatctaaaaaataaaaaacaaaaaaacaaaaaaaaccaagataccttttaaagagcttttaggatcattaagaccattctacatgccattacctactaatcaaaagaaaagttacaatttttgagagggaagaaacattttacctaaataaattctgtatttttttctgacttactatgacctgaaactgattaccacatcaatttttcaccaggaaggggatttgtgacagcaacaatactgccctaagaactgagtttaatcatcagattcatttcctccaatacatgtgttctgagatttattgcccactcatcttctctttccatgggctatcaagtttttatttaaaaaattactgtggccgggcgcggtggctcacgcctgtaatcccagcactttgggaggccgaggcgggcagatcacgaggttaggagatcgagaccatcctggctaacacagtgaagccccgtctctactaaaaaatacaaaaaaattagccgggcgtggtggcgggcgcctgtagtcccagctacggagggggctgaggcaggcaggagaatggcgtgaacccgggaggcggagcttgcagtgagccgagattgcgccactgcactccagcctggttgacagagcgagactccgtctcaaaacaaaaacattactaataactaggtaaagttacattttaaatctctaacaacttacaaatatgctttagaggtctatcctatttttagatttagtaagccaatcaatattccacagaattggaagttcgcatagctataggtgcatttacaaacatgagtacacgtcatctggtttgcaattgttataaatatggtaagcttgtacgcagacatgagtcattttgttaactgatagagcatgaaatataagagagttattcaataaaatatggaaatattaggttattaaattcaattaccttttattaaataacatatggaaatattaggtcattaaattcaattaaataaactttaaaatgtatattaattcagaatattttaatgagatactttcacttaattaagactattaatcattaaggctatttggataagatggttacgttgagtttatcttctttttataagcatatattgtattattttcaaaagggaggatgaatacaatcttgttaaaaaaatcacaatatgtaaaaatgtataccttttaaaagtggaggttatatcaatcttcaagaagaaaagtcacatggtagtgaattaataaaaagtcattgtttttaaaaacataatctgaattatttccttaatttttatctgaattaaagtggacatttaattattttgattctttaaaatctactcttcagcagtttctgtgaaccaatatggagataggcagacgatctacaactctatctgagtatgtacctttctatagacactttccgtaaacggaggattaacatcagagcagggttggaaaattatgtcaactctatctggtgaactccttctgggattacctcactctcttctgccaatttttatttcttattacttatgattataccatgaatctaattatttaatttgtcaatttgacacaatttgttcttaaataaaataaataatacataagcgcagctgactttgaaatacttactttctaaaggcaatgcatgaaacagtatcagaactggttttgaaaatgaagttttagaatagttttctcagccaaccaaataaggtcaatcttccatgaatcacatcagtatacaaacagaaattaaaactttaacaaattccttctttagttactgattccaacaatcttcctactccaaaatttatgggtgctgtcaataacagttaaattgactaaccaaaattttttgctattttttttccctacaacaggggaaaaaaatgaacagtgaaatggcttagaattagcagtagaggaaagagttaaaataagaaaaacctacaatgtgaaaaccaatgctttatcctcaggtagctgaaaaatcttcactaaagctgtgatttcacttttcaggtcctaaaatctaaatgtcacattccaccccctcccccaccaaaaacagtataaattgtagaaaacattttatagcatttaaaaattccaatgatcagtaagcatatactatagtcccaacttaatttgacgttccatttacataagaaataaaggaggaggacagggaaagaagaatggcatagccaaaacaactaaatttttaacatatattttctgtaaagctagttaaaaacaaacactatagctcatgtaatttttaggtgtaagtgtagggttggaaataattaaaatgttacctttgccaagtaattcccaatgtatcctcactggtactggggtataaatgcctgccgttttgattcatggtccagtcacaaatcctcagctgtcaattgaaacctagcagtcagatatggatcgagcagtactacagtttttagtatttaaatgaacacatgcaaactagtactgtacatggcattaaccttactttcccaagaggcaacttaaagaaaaaaaaaaagcaaaaaaaaatcttattcttgaaaagcaaaattcctagactcttttttagaaaaagctattgcaatatgcttctctattaattaaagcatacaagagaaacaagtgcttagaacataacaattagccattattagagcacaaattgagctggaatgaaagcaaacgttaatgttcaatagagagatatattttagaaagaaaataaaaatgctttttttctatgcatcacaccaaataatctgcactgaataaaataatcaataactttaagcatgcagtttgcaaaacacagaagacatgcagtttagaggagaaaaggcccaccttacaaacattcgccctaacttgtgtttagaagcatcaaggtcttcagttttaaccttttactaattttgttttgcttaaactggcattgtttagaaagagttgataagcatttctagttttattttaaactcagagtaatggcatttaaaatactttactacatctgaagaaagtgaggaatgcactgaatacaagctgaaacaaattcttcccagatctccgaatcatcagctctgcccttcagagattgttcgagtaaccctatccagctctgcttggttaacagctgccctacagtgctagcagatttattgaaaagatatattgcttatttttattcttaagaaagtaaacttatctgggttggggggggggaaacacagtagaaaatcatcgtttttaaccttcagatggccacactgtaaattaacagcatcttacattgaaaagatgacttcttcacagtaatccactaaaccttgtttgctgcttttcagtgagaatttccagatgatgactggaaccaaagtaccataaattatcataaacttaaaatttatgataaactattttaaacatttctgataatgttgtggccaaagaaataggctattaagaatctttactttcccttttagactatcgagcttctgcacacactaagtaatagtgattcaggagttttagaaagatagtttttgctcatttttctatcgatctatgaggctctaaaaatactagctaaaatttccaaaccacgtgttttagttatttgcatatttcaggatttcaagtaaaagtgattttatgatttaaagaactgaaaaaaattccctgcatatacatagatagatcaacagattgatagacatgtagattctgctcaggatatatgtcataaagaagtcataaatcagtaaataaattagaaagaaaaataaatattctttttttttttttgagacagtctcacttcatcacccaggctggaatgtagtggcaccatctcagttcactgcaaccttcacctcccaagttcaagcaattctcctgcctcagcttcccaagtagctgggattacaggagtgtgccaccatgcctagttaatttttgttagtagagatggggttttgccatgttggccaggctggtctcgaactcctgaccttgagtgatccgcccacctcagcctcctaaagtgctgggattacaggtgtgagccacgggtgcctggtcataaatactcttaaaatggaccaaaatactcacatgaaggaaaaaaaagtacactttgctttgttttaaatcagatgacatactttcaatatttcaaagaagtaaatgtgttcagtctagcgggaagcaatatggcaagatttcttaaaagttctcaaaatgggtcgtctaatcaaatttagtgtgatggggcaaattgtcttctgttttttttttacagttttttttactgtaaaagttttaaaagtacaatgaaaacaatcaaaaaacagttcaagaaacttggctttgtataacaagaatgttaatgatttatcacttactgattctactctagtcaatgaaaatggaagggttttgtttaatttttatttgtttgttttttgagacaggctttccctctgtggcccatgctggagttcactggtacgatcatggttcactgcagcctcaacctccagaaatcaagtgatcctcccacctcactctcctgagtagctggaattacaggttcgtgccaccatgcctggctaattaaaaaaaaaaaaaaattgtagcgataagatcttgctatgttgcccaggctggtgaaaatgctagttttgaatcaaacatttggaagaggggagatgtatatttaggcatagtacatattaattatgttaattattaacttcagattagtatctatggggctctcagcttaggttggagaagttttcagaaaaataatatgctttcacaaagccaggggaatctaaataccactcactgattgcttattgtcccacagacaactgtaggaccacatctcctcagaaggatgtgttgtaaatgagttagtttttttgttgttaatgttgctaatattttgtctgtttgtttgttttacgacccccaaaaatgtcaaatgggctatctttgaccatatgctgcacacataaaaatgaacgtatttttggacttttcttttctaaaagtagtcccaaagtggataaacctgactacagctattcattatcatctatttaagatatatgcaatagaaatattttctcccaaacagaaaaatatgcttaagtacattcaaaataaacaacaaatatatttagcaataatttaatgccaaataaattggcaatatattaattagcattgaatttccttttagttactaaaaatgtaaaatataagaaactaatttatctgtttagattgtgcactaccattacaacatttcttgaactttctgaggagacacgctataacttaagccaggttacttgagcaagagcctctctcttcatgttggtttttttcaattaataaaccttcttggtcataaagcatcttggaactaacaaaactccctgataaagtgaaattttaaagtgatggtatgggtgggggatgcaattaaatcattaaaatagaaatcacttattcaccaaagatttccatgatagtaattcctaagaaaatcaatttctaatcttatttgaccaagatattcctgaccaagcaaattgtgaacagactctatatattaaaaggttaatactacatgtatttaagcttcttttggggtcatgttacatattcttgcctttagcataattcagttttcctaataaaaaataattttacattaggctttaaataagtttaacataataggtgataatcttttttgagtttggggtggtgattccttagtttctgtcctgtgacagaatcagtgttaggtaattcagctgtaaattctctttttttattttaaaactttaattttaagtggcacataaatacatgcctttcatttatatagaatttttctaagttcaaagctttaagaatgctgtaagaatttttccaagtattttttattaagaaataggaaattgcttttttctcccaatagtaatcaaatttaaaataccaagtgccactcagtttagaaattcagtctgttagaattgtctgttttcatgtggaggtggggaacaattcttatttttgtaacaatatagactctcaaaaagaactgatcatatgcatatccttacaaaaatgcacactcatataaatcattttaatcctttaatttatatgcacataccaatatgaaattctattgtctagaaaatgcccagaatttcaaaaccaaataaaaggtgaactaagaaagtaagattatcttccaaaaaagctatcagtaaagggggaaggttggaacagtttaaacaaataagaaagatgtgaaggtgaagttttcactgcatatgttcttagggtggagttctgtggtctctggaaagagaaccttgttcctggcccagttcaaatcagattgcttcaaagaaaaaaagaaaaaggataggggccatctggttcctctcaaatggctacataaaggggaaacacctaagatttggatcattatcctttcctaaactacactcaaataatcatgtaagtagcagatagccataaagaattaatattgcttgtgacttcagactaatagtttgtttattcaaatgggggtcctcctttgttattaacagggtcttttgttaaatacacagcaattagctttgggaacaaaagaaagaaggtaagcaaaatgttctattttgctagactcagcaaacaggctgaggtactaacagttcctacgatgacaacaaatctcaactgaaccaataaaccattaaactgtgaacagaacaatcaacacaggcaaatttaccttctcacttttttttctttttacgtttacaatggccctcaggagaacatcttgaaaggtatgttttatgttttcttgtgtttcttcatttctccagaccctcaatgaaacagatttttaaggggtgaaggctctttttgcggtggaaaacagatgcttaaaaggattaacactccaatattcatactttggattaggagaattttattttattgctaatattaattacctacatggagcaaattaaatggtctctggatgaatagcatgtaacctctgaaggaatggtatgaacaagaaaaatggtcagaataaaattgtgttgtatgtttcacatacaacacatgcaaaaaaaaacaaacaaacaaaaaaaaaagatactcaagatcatcctcatatcttaaaagtcacttctagtgccaatttctgaaacccatgtttcttgatatttaatttaattagcagaagtagaattaacttaaatgagtatgcatagtccatgagcagaataaacattattaaccataaatcataagataagtattagaaaatgaaagattttgtttttaaattagaggctactacaacttgtaaattttaaggtttcaagggactttggagcttatgtagttcaacctcttcattttcctttccaaggtttaaggacttgtccaaggttagaaatgccctgtcacatcaacactaaaacccaaaccttctgactcctaatccctggttctcacccactacaccagttgcctgtcattgttcctttcctaccctgtcccttatgtgcagttcaagaatatttaatgctaaaatatctgtaaataaaaccttcagaattccctctacctccctgattcaactgagatctaagttaatattttcagaaaagaagataattttttccttgtgtttctgttgattaaagttaacgttacataaaatgtaattttacttttacattaattagaacagcttatctggatattagtctttgattcccagtaaaggtaagtgaacaaaccagggaatgacaaaagacagacaatggaaggattttttgaatttaagaactagccaaagagctaaacatttgcatagccattatttcgactgaaacttcctttaaatgtgtttcctttcaagccagcatacatgaaaagtgacctcttatccacttacatacctacccagaagtcatgtgatagcgttttacgtcaagctgtcaattatgataacagacacaataagaacagcccaagtgttgatagcctgcttcctgactgtattgaaaagtttgttcatagtccacttgtgtccttttaattgcttgcctctaataaatgactacctttccaatggtagtaccaagctttggctttgccatttgccaggacaaatattataagaagatttaaactaatatcttagtttaaaaaaatcctacagaagtaatttcttaaaaaggccattttgtgtaacagaaattttcagtgtaatgagaagtactttcaaattctagttttaaaaacaaaagtgttataagaaaagtgttgaaacaatttaaatatacactagaccagtaattgaaattcaaataatagcattatatagtcatgcaagagatgtaacatgctgaagcccaagcaccaataaaatccatgcaactgtgagaagtaatgcaaagacctgaattgatcaggccactgattcattagctcttattataggtaatatatatatagtcaggagattataattttgagattatgaaaataagaccgatttcttataaactagactttacttgactttattgtctcacttagggaaggcaaaagtgagctcctaatttattcagttgaaatctcaaatatacatcaaaggttaatatgtacttcaatggcttgtttgaatggtgaacttttatttctaaacaagaagcttcttagctgcaaactttttatttccaacttacaatgagatttttaaatatatgttgatgtacaatagtaagaatttaggctcttattatgaccttagactcaaatgtaatggtgataatcaaattagccagattctcttgtattaatactaccaaactttctatgatagcaaaggaaagaggcctgaaattagcaactcactatgaggtagaccagataagaaactggtgctaattcaagtaagttgtctcttattattcatccatgctaaaattgttagactgaattataaaataatttctatatttcctaagcaacatccaacactctgattgatagttcccattttctcagggagataaaatttgggaaacgtggttccttcattgcctatcataacgaatttgcacaatgtgttcgtgaattataaagtatgagagagaaaaggatatactgcattttactgaacttctatgaagttaagtcggggcgggggggtgttccacatttctgaaaatgttccaaaccataaaaagacatttctcagcagagactaatcagttcagtttgccaaagcaggacccatgagttcttcaagccaccaaaaccatcttccaatagaaaagttaaagaagaatgaagctccaactgaagttctgattttaagatttcccccatgccaatagcgaatgcaataactaaaccaataatcccaaagacagactagttctagacttgaaaagtattcaagattgtgttaagagataaagaaaaagtctaaagtcaaatactgatcagctggtatgtgctgactattgtgactgattagagaggattatttttaatggcagattatcaactggtttacatgaacctttttgaaatagtctccaggactatgtgaatttattttttagattcaaatgagatatattttcagtgataggtgaactttcttccagtcagaataaactagtattcccaagcagttagcaaccaatgccatcagcaataattattataaaaaggaacacaaagatgtataattactaataacaattgtctgtgtaccaagtaaatgatatgaaagtgtatacttttagtattcagatttgacactatgaatgtattactcttacaggtgaagtacagggttcattttaacattagaaagcttttcatcttaatttgataatgctagtaagcttatgtattagaaaatgaccagattggaaactccactgtagtatcatcttgtggaaagattatttataaaatagtcaaaattacatgaccactttaaatttatcattaactctaatttatgtaggctctattaaagttcttttctaagaaaaacaacactcaaaactacacatcagtacttttcataacctaaaaggataaatctttataaagcagccaccatgaactgaagaatgtacctggtgacgatatttattcttaaaggatcatgtatattaaaggctatagggaatgtttaaaagaaccctctcagactaaagcactgcctttctaattttgaatttctcctagctaatataacatgattgattacctttatttcatgtaccccttgattttccttttcattcatcattgagtgctttaaaccaaatgcatttagaaactgcctctagaagaatggtctcttttaaatctttgtaaagtaatgaaaggacacagtaaatcaatctcatttctactgaaggaaagaataatctttactgaagtcatttaaactatttctgtttctttattcctggatagtaaacataaaacttcatttctataattcttttaaaatttgaaaggctaaaatgaataggcttttgactctagccttagtttactaatatacatctatagcatgatatgcatttatttacaggtattttctgcatgcctcaaaactggagttcattataaaataaagcatatatgggcttcttcaaattaaaaagcagcactaactctttcattacatagaggacaaattatctgtctgcatggtatttaacattttcagctataaagaacttttttttgcttccaaagattaatatatatcatgtatcccataagtattaactatagttgactgaacaaaacgtattcacattgtaagtggtctcgattcaatgttgtccacttaaataagtggctgtcttctttgattttaaaatagtttatagttctagaactcatagtttttaaaatatatcatgtgccagaatgctatctacattaaaattcatattttcatgatgcttgctaagttttcttgatatatttttagatatgtgaaagaagtaattcttatgttaatggactttagtaatcataattacatgaggcttcgacatttatcataagggataagaaaattaaagctgccataggttagggtagtggaggaggaaggctgcctccaaatacatggaattggtcagagtattctaactagcatttggggctaaaggtttaaataatggaggcatgttttatgcattaaaaattaactggaaattagagatgtgtcataaagaataatgcaaatcccatgagaaaaatattcctgagaatatgtgtaatgatttttaaaagaacaagtttctaaacttatacatcctgcatatgttttttaaaaaacacaatggacacatacatctgtcaaatagaaccatattctagtaattataactcatttcgtgttataacaattttagaggtgaaaaaaaagcaacattccagagaattatgttgagaagccaatggctggcaaaaccactaattattattatttggtattttcataactgtgtacagatgttttcagttagttctcactcttttggtttgttttgttttgctttttttaaacctggcaaaacatcaagtattctgaataagctatcatctttatgattttctctgagctctgcatgtggtgacctctaatatgcagtctgcccccttgggctgcaactggaaaggacttgagaactccacaccaagcacagttgaggtaggtcacaacaagggtatgtgaggtgaacagatcaagaatgaagtaagtgggcaaaagtatcttactacctacacaaaaagtcatatatatgcacaggcaacttataaataaagagcgagttagttaacaccagctctttattatttattatagcctaattttcccctatgtaatattttgcatactgttaatttcaaactgctctgctatcaaaacttgagagcagcaaacatatgcatcataaaatatatttaaattcggaactgtttagaattacgtctcttatcctgtaactagaatcgtgggatttctacattggtatggtccatgcttttgactgtggctgatctgtttataagccaccattaatcctggctgtatgttttcacagtttgggtaaacacttcatttgcattaaatttacagcattaatgagatgtgaaatttaaaatgctactagaaacataaatgatgtaagaaagcagaaccaaaaaaaagtgttttatcacatctgaaatcagtaaaccaatttaaagctattaaaataataggaatgaagtgtcgcctgagattttaacttcgtaactcatcgtcttggactaaaatacaaatgtgaggagcaaaacatctggaaaataagaaatcactcaaaaactcgaattatatactgcttctattctagttggctttaaaacagtttgcagtttttgtctttgaaagctatagtctgtaagttctcaatagccaatgagactgagaaaaatacactttggctgaaacactattactcatggatgttatcaatatatgctacagagatggaaaaggtcatgagccaatttgagaaactctactcaaagaggtgagaaacaaaggatcaatgagaaaaaattctgggaaatgaaatgatcagttttggtctcagaagccccgggagcccccttctgagtccggatctgagaggcaacatggagaagcacggaagcgaaagcgtggctacaccgtcacacctgggtgaaacttgcccacctgttgctgatgtaggaaggatgggtctcttgggcttagtcccacatatcgattggcttgagatgtgcctgaggctgtgtaggctgattaaggaagaacaaaaacaaagataaaaattgtgaactatcagaacgaacaccctgtccatgtataagaaacccagagaagtgggatttgcaaccaaaaaaaaaaagtgtcttcatttctcttctcttttgtctgagtgaacaccaagtgatagaaaagaaataataattgacttcaaatcaactagtttattccccctaaaaaatctatccagtaaagcagatctcatacttcagtgtgggtgtctcacacttacatgctctagtaactgtcctgtggaggtactaaggattggataaatagaagggccctgttcctagacgtactttttcaccagatagtagttgtctaatataaaataatcaatgatggtatatgattctaaatgtaaagcagactgaaagtccgccaggaaaaagtgacagcttttaatgatggaatttaagcagatgttcttaatgatatgggatggaaaatgtctttcttaaaagttttgctaaaaaggaaatcaaatcttactatcatgaaggagaagcctgtatcatgtagaatgaatcagctcggtattttacctgtgaaaatggcctcaagtctgataggaatgtttttgaaaaaaagtacttcccataagcacacatacaaaaatcaattacttgtaactgatccaggaagaaagctgatgcacctttaaatagttggccactaggtagtaagtatatatggtgactattccttacattgttatagtctcatttgcaagtactttttgtacaactgctttttgctttttggtatagagtaaatttttcacacacacaaaaaaaaaatgaatagggagctactcctaaagacttttgttacttttcacaaggaaaggactgaggtatcttcccagaactaggcaatcccactgctccatattaccatatattacctttattgttctgaagaaagctacactgtttggtttaaaaccaccagattaatgaggaatccaggcttcattttaaatgaactggctttctaaaaccaatatattaattctgccttgttcacttaaaggactgcagaatttgatccatggaagcttttttaggtcaactttttaaaaacagtgaagatgctcacaattcatattttaattgctcctgaataaggggacatgcaaggcagccatcagcaaccagtgacccctactcaatctccaagcctctggaattcaccacacctcacagacagccggagatgagcctcacccttacagaagagcaccaaatctatgctgctttttcttttcaactatgagaaagagccttccttggcttctgtgttttctttgaccatagtactatatcaattcaatgaccagttttttattactggtggtgcctaagaagctggagctacaagcttgtttataggaaagaaaaactactcactatgtttcttttatgtaggagtggaaaatggactgatgcagccatctttatacaaccaagatactccttttgaatattttgtaattttactagtcaaatcagatccctttttgaacaacctgtatgtaagtataaaaacaattcattaacaaacaggctgagggtactcctataagtgaactgtgatcatttgggtctgatcctctcctgaatctcttctattaataacaccacaagagtaggcatcagagtttctagaacttggttttgaccatttatcctgtgataatctttcaactacttaaaaaaaaatctttgttttctgtgtgcttttatttaaattgctgacattgtttgctcaaagatgtgaagacatccacttttaaaatgagtacttagtgttttggtgactgtaatgcacatagcaaacctctagaacaaaataatttttagtttttcctgagtaggtcgcatccatctgtgcattcagggaagtattctaagcattaagaattactgatgggtattacaagcctataggaacttattaattgacggggctcatgaattttgagaaagaaatgctgaattcactgtacaaagtattgtccatttttcttatagggttccttcctagtctttcagaaaccataaaaaaaaaagagcatctttccaatggctgagaaagaatgagtggtgcatgcctctgattgtctctgattcacatggaaatttcaagatcatggggattttcttgctctaagaaagaaaaaaaaaaggtttgaattgaagatatctgtataattggtgaggtgcatgctaattccaccaattcgatagctttatccattctacttcaccaatttgtacattccagctccagtactaagaagctgacagttgggtgaaaccacctcaaaattaatttcttctatacttctaagtattttacatgaaaaaacaaaggaatgatgcggcttattggtacgtgttaggaaggttcactggctaaatctctgacatttaaatgttatggccacactaaaaagcacagtatttgatgtaccaatgataagcaaaataatcaaaaggttttaaaaaaaaagcttgcagatagtgaaagtacaggtagcttacatgtgcctaatactaagttttgaaatgtcctcatctgttcccaaccttatgcgactgtttttaacaatgacataacctacaatgatgtaaacatgcaattaccttacagaggcactgattccatctgctttgtgaaggggcttgatttctataggaatgctccaataagtaccaattacctaatctctctttgggtgatacgaaaactttgtattctgcgttatgttactcagtgcaatttcaatgtataccttgaacaagcaggcatgacttattatttttgttatagctgttaacttaaacaagtgagcttctcccttttcaaatatgattcactgactggaatttgagaagagagagcctgtgatagcagggccacatccatgcctgctagctccacttaaatgagaaatctccatctggtcaggtagctggaaaaattgccgtgttttccaccttggatcagatatccaatggtgcctctgatggacatttctcatttcctatggaaatacttactggttgctgtaggtgaagctgcctcaccttcagtggatgtagtgatgggtttagtatctgtcatgctcagggtcacaggtcgcactgcactgggatggggagagggtgccaagacaggagtgaaatggccaggcactttccctactacttgaccactgccgttaggctacaaaacaaaaacagaatgccgggtgaagcaatccaaaaggcagtcatcttgttcaacaagtccactcagcacacacgactgtgtggatccagcacactgcgcataggcgccacacaggccctctcgagtcggagtcggagaggccagtcaatggttggtagtaataaggagcagcagcatttcaaagaaggttttcatcttcaaagcacgtcatggtataggtgaattcctctttacagcacccctgagagccaggtagacttgatcctttcatgtagtaggccaagaaactcaagtgcagacttaaatgcttagcccaaaggctaaaatggaattccttactgaactagctacagttggaacccaatgcttccttattctctgctcttcattttctataatgagtcagttttggcttttagaacacaattttcacctacatgatgatatcactgaaacaaaggacacaaaaatatctaggagatcaaatacaacgaattctggaattttcatcatttacagtcaagaaccattctcctgcatacaaaactctagctctcttacacacaggtgtgctgagatgcacacattaggcaatttagattccgagatctatggtcaacttttgatgatttactaatacaagaagatagaataagatgtaaagcatctaaaatttcagaggtcatacaatgatataaaatgctgagctacgtttgtccttacacctacaaataaaagatttccaaagtaaattaaactgtactgaggggaagcagaggacaagcaaatgagcattgttatttgagttactcttacatccatggtggtgcatggagagttacacaaaacatttcttgttgacatttgtgagaattaactgagaaaatcccctgggcaatgatagaaaagatgttactatctgagttttagctcctgggtacaaaaatagtttccgtggtaggaaacaaaatcctaaggatacactctttgaagaaatagtggaatatatttttctagactgagaatgttatttttgattatacccatgttggaattctccactgcacggtgttcatcgcaatttgctgggaggctattctcggcaagtatatagtctttataatctgaactgttaaaggcaaaaaaaaaatgaagcagaatatttttctaaatatctgcacataaattacaagtagacatttatttagagaaaaagatgaacagctaataacacttaaatattgtgacttagagacatgaactaagtcttcggttaggctcctcagaggccacattatttattctataaagaaaatggacttcctgaatatcctgattattcatcatgggtaattttaagtatttaacttgatgtcaggaaaattgaccagagttttccaatatggaaacctatgggagagttacatctttaaactaattttattcaaaatattccattgaatagcatgactgtctcactataattggtgcagcagtaatgcaattaatctcaaaattgctgtggggaggaaaaggcatctcagttgcttatcttaaaaatcaaaatcagtgcagtgctggagaatattgggaagcaacagctgactagaagtgaatggtgaaggaatactgatgtttttccatttctaaagctaaaatggtaaataccaagaattctaatttgaaatgcaaattaattggttttgagttggagttaaaaatcaaagcagatacactgttccttaaaaaaaaaatctgcagttaactataaagacccatttttcctttcaaagggaaaaagtagtttgtttctacagcaggccatccatttctggttatctgaacactggaaataagtgctttaaatatcttaagaaagaagacaggtctcattttatcattggtggtacattcaatggtaaaaatgtttctacatacagtgttcaccaaaacagtctgaaagtacctacctggaacaaaatgtctggagcagaatgacaataatttcaaggaaatgctgccaccaaatatattatcctaccctgaccattctacaaacttcacctactggaattgaacaacatgaactagtagacacttctctcatttgaaaagaataaaggtgacaaagaaagaattcccaagtcaatgcagacaactttcctaaaactcagggtgagaagaattgagggctattttctcctcagttttctactggttcaaacagatgaagctacactaaaaatttctatcttttaaggctgttaatagatgaactttcatactgtagatagaaaagagagatgtcttgtctgaaggtgaagctaacagcattaggaaaggattattctactttatacacggttcctattatacaaaatcctgagagtttttttgttgctagtttttctttttcttttttttttttttttgagatgagagtaatatgcttccttagaaggtgatatgtatcttgaaaaagtgaagaaaaactgagaacaatataggcagattatcacctaatatgccctcttaacttataaagaaattgaaatatacgtaaaacaagcactgaataattaaagaaatgtgtaacactaagggcctgattttaatttgcataatttttcccctaacagtgcctaattaagacatcagttaaaaaaaaaatccaatggaactctaagattttccacactgaattaacgttaaggacttttaatggatgtcttaattagactttgttattcatggaaattctacacaaattaaaatcagaccttgtgtgcactgttcccagctgagtctagcaaaatgctctatggaactgagacttctgaatccatgagctgacaacaaattttatttctaaacgatatactaagatcccactctcacttagctgtctttagtacttcagtcatgaaaagtgctacaacattttaacattttcttctaaaatacaaataataattttaacttcaaattcaaaattcaatattgagtttaatatctcagtcagtcaaactaaaagtaatgataactttttaagtaacccaaagggtcctggatgcgttgttattctaaattaaaagttcagaaaggaccattttgtttcattttaacaaattaagaccaaagggatttttttctcacctttctttgctaatttaaattgatagacacacactatttactagcatttcaggaatgttccaccgtagtaatgacggaatgtttgtgaaaattctccaaaatattaaaaggtataataagtggacaggagtcttagaggtaaagcagcaaagctaaatatcagatcctaatatcaaaattacattacatgttttagatattacaattattgatagccccaggtctggcacaaagactgtctacttgattgtggaaaatgctcatataccaaattcctatgaagtaacctcttggtagaagaaaccatatgtctaggggagtgagaaatgctcatgagtcactacacttacaaaatgaatccccaaaaccactgcacaatgtttccaaaaaaaagaaagacgcttctagtaatgtcactcattattaaatgtaagtcatgtctctgcaaagaatattcaagtagtcatcaaacactgagaatgtttacattaccaaagcttattttaatacctaatagttggtctataaatacaactgtaagttcttttgtgtgtgtttattttagcacataccttactcctgcctgaaataagcacattgtctctgtgtcaaaccaggtatttaagaggtgtgaactccagcccagagctttcctgtcaatgtactttctgcataaactttcccttcagtcagtgaaaatccaaaaacattaaaccatcttcacaaatgtaccctttggggcaacacacttcctacctgtcattcagccacctttaaataaaaacttattgagtcaccaagcaacttcctgaagatggatttcaaggcttgacgttctgccagacacactgtctgactaacctttgtgtctcagaattagatctgtcccatctcccttaggtgctaatcttattttctctcttatttttacctggctggtttgtggactggatgggtcataagaaggtacatagttcttcagagtatcctgaggattcaggtggggaggatatctgattgttggatgagaaaagtagctcgatggggctggaggaaggatagcttgtgttggaaatggcaacggtgaaggtggaggtggagttcgagttgagatgactgcagaagacagaaaaggaaagattgactcatcagctggttaccttattgctccattctgatcctgaagaatgctgtgaaactacaaaactggtaaccattcatttttgtccccatgatttaaccaagctctcctaaatcaacagttactttttcatttttattctcaacaccagtacggctaactacacagagataaaacatcactctagaaaattaacaatcttgcttcctggctctgtgagtggttacaaaatcagtttctcttttataggttatgtcaatacttgataaaacacttctttgagcaaagatatatcccgttgaaaacatattctttgattataaaatctttaggccgggtgcagtagctcacacctgtaatcccagcactttgggcggctggggcaggtggatcacctgaggtcaggagttcgagaccagcctggctaacatggtgaaaccccatcgctactgaaaatacaaaaaattagctgagcatggtgatgggcacctgtaatcccagctacttgggagcttaaggcaggagaatcacttgaatccagtagacggaggttgcagtgagccgagatggcgccattgcgctccaacctggtgacagaaccccatctcaaacaaacaaacaaacaaaaaacattttgtctcataagccccatctcaaacaaacaaacaaacaaaaaacactttgtctcataagtccagagcaagtcacagcattaagtagagggcaaaagagccaaaaattttctaccaaaattaaaaacaaaagtgaaattcaatttcaaataaaacgtttccctgtacatcctacctggcaattgtttagaaggaaagacaataactaatacaacatcatctcatgtcatttataattgtctggtcatggtataaatgcttatgaacattggaacatagagctagaaactctcctaatgaaaatgtttctttcaaaaccaaaagagctctattctgcaactatttttctttctactttaacttttactatatgtagtttaaaagatattgttaatataaaaccaagaataaaacacacagcaatgaaaatttaagctttcatataggtaagtatattactttacccatatatcacatattttataataattttataaagggaaatactatataaaacacatgcaatgtggacaatgttcaattttactataacttctcaacattagtattcttataatttattgttcagtttttgaaatataaatcttaagtttgaaagatggagaaagagtgtaatcgtatgatcattatctctaaaatgttgagagaaataatcatagaaatacaaattaaaactaccaacaaatatatgtagaagtgaaaagtaaatgtctttctattttaatatttcccaattcaaataataggaaattataaacgataaatgtctaatgttttatgagacaacttaaagaatatgaaaaaaaataaattttagccataacctacaaagggaaatcacctagaatgatttatttccaactttgaaactatgtgggtgggggggtgggacctatttatgggatgtattgcttacctctcccaaaaaaaactttttcagaagatataagaaattaagaatgtatagaatagaaaaaacataaattcaattttatagtcacgactttgttctctgaacgtccagagcactgtttctgaaattctctgtattgttcttacaatgcagatcccttggtctacacacagacctaggggatcaggacctctaggggtaaggcaccaaaatgtatattttaaataagtgtccatgtaatcttcctacatactgaagtttgagcatcctccatcaaatgtatgcatttcagagaacaaatgcgtatttcttaaaacaaaactctttactgaagtattactttatttaagaagtatacccatttgaaagtatcatttaaggaaatacaaacatctaagaaaaactgggcatcttttacttagtgtctaaatgctcttaatctcagctcattttaaccatgatttttgctcacatctgtacacaaaccctggaaagatatatacatagttccatcttgggtcctttagcttttgagattaatttggccttaatagttctggaggagatctattttcaagtgaaattgcagaaatcaaacccgaactcacatctatgggcaacctggcactgtgcttgcatgagctgtaggtggcctgataccactgggtaaaatgtcgtatttcaaactgagagtaaaaatgactaccttttccataaaagccattctagtcctttaaaaataagaaaagcaggccaggcatggtggctcacggctgtaatcccagcactgtgggaggtcagggtgggtggagtggatcacttgaggtcagatgttcgagatcagcctggccaacatggtgaaaccccatctctactaaaaaaaatacaaaaattagctgagcggggtggtgagtgcctgtaatcccagttactcgggaggctgaggcaggagaattgcttgaacctgggaggcagaggttgcagcgagccaagatcacgccactacactccagcctggagtaagaccctgtctcaaaaaaaaaaagaaaagaaaaagaaaaaaaaataagaaaagtaaaatacaagacaaaaagttttcctttattatgaaagaatacatacacatgtatgtgtatttcttgcatacattattgcaaagccttattgtcttctttccttcagtcttgctccttccaaaacatcctttatagtgctatgtgaattactttttaaaaacaccattataatcatgtaacttctccgctaaaattatttcagtggcttcctactgcttccagaataaaatcccaacaggtttttcagtacacacaacctcaggtactctgagaccgagtcctggatcacttctttggcttcatctctggccagacgaagatatttgtggatccttggctatatggcagttgcctgctgcaatggcctctaatgcactgatacatgctgttgcctctgcctcctttgcctgccagtttgccccttttcttcctagtttgcctctctgcctcccagtttgcccctcttcctcttagtttgcccctctgcctcccagtttgcccctctgccttccatgttgcccctcttcctcctagtttgcccctctgcctcccacattgcccctcttcctcctagtatgtccctctgcctcccaggttgcccctcttcttcctagtttgttgttccttcttgtggtgaactttgccatcacactttagctcagaacacatatcttccaggtatctaaaccttcttcaggttatctagtcatgttcagattagatgcccagccaatgacgtggccccactctctccccactatatcctgaactctttaaggacagaaacgatctttctgaacaagatgcctaacacagaccctaatatacagatacagaacaaatatcgggtgaaggaccaaggtggagggctcatctaggtctctcctgtttcgttatataaaaatatactgtctactttttttcacgttagaaataagaatattttcatcaggtgtcgtaacaaatgggtgatttgacttctcagttaattctgtccaaatattcaacattacaaacctatgaaacagttactgattttttcacctatctcaatggtataggtaataaatgcaaaagttcttataccacatttaagttgtatagtcctctctcaatttcgtaattttttaatgatagcaataaaggccatgcatttttttaagtatagcaccaacaaatatcaacatatacttacaaaccaaagctaataaggactttattttaaaagatgttacattgtttgcataaagatttaaaaaccagattcgattagtcagaaggatgaggaagtgcctaactataaatttaaaccaataacagtttcactattaacatatttatatataaaactttttccacctaaaatgcagtctactcctctctaggtaaaaagtacacagtgttaattattagctgtatctcatttttaatttttgaaagatttggtattagctgttggttaaagtacaaatgtcaaatattggattcattttcctacttaaattaagacatcagacacaatatcaagtgtactagcccaaaggatttgggcatataaaacaagtgtcaaaaaaagtaccttttattctctgattactctcatatagataaatattgatttatatgtagaaaataacatctacagaaatagtgccttacgtcttaatgcctttagaaacactctaaactcagcaacataactgaaattccatctttcccttagtaaaatatcaggactaatcctgaagctataatgaagatagctatgtacccatattttccacattcttctgataacaatctttttgattaaggtaattttaaaacacatattataaatattatttacttgtatgactttgaaaatctttcttttttctttttgagatggagtctcactctgtcgcctaggctggagtgcagtggcacgatctcggcttactgcaacctttgcctcccaggctcaagcgattctcctgcctcagcctcctgagtagctgggattacaggctcatgccaccatgccaggctaatttttgtatttttagtagagacggggttccaccatgttggtcaggctagtcttgaacacctgacctcgtgatccacccgcctcagcctcccaaagtgctgggattacaggcgtgagcccctgcacccagagaaatcttttctcataaattgagaagaaaaaatacttgatcggattgtgcccctcaccatatgggttgagaaaatatggttgccatagctctatttataaacttttgctccgtccctaagggggttaggccctacagacaagaaggaggcttctcctctatgcttgaaactcctcaccactgtgtgcaactccaggtattccgggatggtggtgctgggggaaagtgctcagtcttggggaagaatcctgtggagatgcagagctgaacaatggcttttcaggcttcttcatagtagtcggagaagacatatctgcgagaaacagagaaaaacccaaagctccatgactttcttaagctctaaggttcatgtcaacaaatgacagatctcatcttgcaacattttagtattcttatactttggctcttttacaaaatatattctgagtgtcaacgatccagctgtcttggagctctgaaatatttgttcaatctccatggaagctagcagaagccttcattaaaattatcatcagaattattcccattactaaataaatcttaaacttctaaaaacccaaagtcttgtttcctttagccccttggttcacacaaaggccttctttacctcagtatttcattctgagatttatatgattcagaagattgtctttcgacagaggataactgctgcaaatgggaaaaacaaccttcaggtatgttggtcacgatatcactgatttcacagcttttatggaaaactcattcacttgattagcaaaaagtacattccttaatttactccttctgcaaacgtttactgggtttctgtactggccaggtaaaatgaagatgtcaaagaaattaaaagtaattcctgctctagggatgctcactgttggtgaggaggaaaatgattagaagaaaatggttgtgaatggttgagaggtacaatgtgtgttgagagcagggaagttttggcatttgctgctacatcgccagctgcgatgtacaggacagatatcgtctcagtctccccaggatgaggaaggcatttctcattggtgccattttcaaaatgtgaatgaggatgacattctcagagaggaaatactcagaaaaaaagatggcacagaatacacaagtaaacagtgtgtggagtggtgaaagatgaagaagaggagcaagcctcttgcaggtcccacaggatgacgggtctccagcttcctgtacaaacgtctgaatgcttaccctcataggagaaacgccatagatgggcaaaacatgatcacaatgacagtttaaaacaattcccccagaaactaaatggagggcggactggccaaaacagagacagaaatcatgaagaccacttcagaagacagattcatcaatacattcattccataaatacttgttcaagaccgaatgtatgccacatgctgcactagcctgggacacactggtgaactggactcactttcggctcctttaaagcttaaaatctagtgaggcgatgtggacaagtaagaaggaattgcaaaggtgctgtgataggaaaagaattcagagatttcgggcttcattcactcattcatttcataaatatttaatactgccaaaagatagatcatgagagcttgaaataagaatcatgatagaactaatgcaataaatattttaacagggttcacccaattaaattattaagcaatgtagactgtcatcatcttagttgactaagagactataccatgcagtttgttggaataagcagggagttgagagatatgccttggttttaacatcttgagtgctgttgactttaatggaagtttatcaactcatagtaaaatgttataaaaatgatgagctataaaatttgtattttattatgaaaaatgttaactgtattcacaagtagacagaattgtaatgaatcctcacgtaccgataacccaacttcggcaatgatcaactcataacaaatcttatttcatctttatccccatctacactttctctccctgtggtactttgaagcaaatcccagatatcatataactttgcttctaagtagttcagcatgtatctctaaaagaaaataaatctttattaaaagaaaaaaacaccaaaactttatcacacatacaaaatgtacacaatttgcatttttgagttttcttgaaattagaaaaagaccttatggtgctattaatatgagaaactaattatcattacattttaccatttgaaaaattacctaagctctggtaaaggcattcataaaattaaatatgcattttcagcatggtggcatttaaaggatgaatatgctactgtaaaggcagtagacatcacagtctacaaaaaatgccaggcggatttgtagctgtaagctacaatttgtgactaactggctgttgtgaatctatcagaactttgatgagtcagagaaccatttctgtatatctttttcaaaaaaaaaaaaaaaaaccagaaataaattgttcataaaaccacagcaattaatgccactataaaaaaagaaaaaaaatttaaaccatggtttaaaaaatagacaaagctcattttgctatcttcaagatgccaaaaataatacttaatgtcgcataagagctatgtgatttcaaaaggtaatactacaaatataggcctctaactaatggatgtaaaatcatagacatacagattattaagaggtggaaagaacctctattctgtctttcttgttatagatgatgcaatcacttgccattccaaatttttaatttaaaattaactgtttgaaaaagaaactgggaactttttattgatactcttctgctttacctatgtttaaatataaatttcaagtaaaatgtaactgggtaaatcagtttctaaaaattccatagaataaataataaagcataattatacctcattttaaaataatttaggccgggtgcagtggctcacgcctgtaatcccaacactttgggaggctaaggcgggtggatcgcctgaggtgaggagttcgagaccagcctggccaacatggtgaaaccccgtctgtactaaaaatacaaaaattagctgggcgtggtggtgggcacctataatcctagctacttgggaggctgaggcaggagaatcgcttgaaccttggaggcaggggttgtagtgagccaagatagtgtcattgcactccagccgcgacaagaacaaaactctgtctcaaaaaaaaaaaaaaaaaaattaatgtgaccacagcttgagaaacagaacagtgtcgttctgggtatgtcatttctggagaagaggatcaattaaggcaactgcaactactgtaactatatcagacttttcattaaactcaggcaaattcatgggtctccttttgtaaagggcacataaatcaagggtgtttatatagaagttgaagatgattatgtaatttttaatgtaaattatataaattttaagaagcaaagcatttgtattttcttagccaaaatgacacacttgcttttactgagtaattattatgggtccatttattttttcaattcttttttgggcatgcacctaataataacggtacgttcatagaggattatacagaccaacacagaagaaacagaatacaatttgctgttcaagttgcaaaaggaaccacaaactctttccttaaacaacaaaagtaacttataatagtaaacataagaatgggaaggttcactgaccaaactgaaaggatttgctttagagacaggtgaagaacggtagtatcagaatataggtttaattgcctttgttttctcattaaatgaaattaattcttggcccattaataaaaatacactgctacacagcatgcagaaggcactatgctaagaacttaggaagatacaaaagtgaatccccgctcaaaaaaaaaaaaaagacaaaaaaacaaaaaaaaaacaccctctctagactagaaggggaaataaaagatcaattatctggggaaaaagtaaagatagagtttctagctattacattttaatcatgaaccaaactagtgttattttaattttaatttattttgaatgtctacagtctaaaaggcttcatgccaaggtgaaaaatgatattgtttctatgtgtaatgtgctcatatgctacaaaaaaaagtttgaagaatgaatatatagaaaagatactttaaagtgacctttctgtgaagaaaaacaaataccacgctttacacaatctactgtccctcaagcaggaagaatactacataaaaagattaagttgaaaataagttgaataataataaagttgaataatgcataaatatataataacttgaataatgcatacataataatgcataagttgaataatacataaaataaagcagctgaaaagagatgcaaaatgataggcaaaggattagctgatgtttctactggtgggagggaggcaggagttgctggtagttgaagagaaacaagtagaggccagtgatggcttaaaatcagacagaacaatttaaatttgatttagaaagtaataatttataaatgaattgattttagaagaaaaaactttccaaaaatttgactttttttttctgttctcaccgcccttttcacttgtacctggctgaaccaaaaattttcttcctagtctcctccaggccttcctctccatggcactttataaaaaccagcagctggcatcgtatccttcaaacagtatctttctcattgcaagatctaccacagtatcacatttttaaatagctctttttctttgttattccattttgtttaaacttcagtgaagctaattttcttatggcttccattaggagcaggagaaatatgtttttaactctgtgccatccctgatctatgacattcccttgaactagaaaatgaggcatttccactctccttattccacgcatagaacaatgttttatccactgaacaaacttgttttctccttaagtaatctctcttggaaatccctgagatctagatttcattaatgatcttttgtttgtatcttatattgcttgatgaatttttcattgttatttacttgtatccactgcgtatgctttttttaaaaaggtgactaatggcttacctcctaaggaacatgcttttaccaaaaacacaaaaagatgtagaggctggaagaatatgctacttgggaagagaatgaaaaaaaaaagtagaaatgaaagaaagaagaggtaaagcaggcaccgtgtctaggcagcttattttagaatctctggcatgtgaaagaaactgtattatgaagtgatgactagtagtgcaggatgagaaaaataaccatagccagtatatcttaaaattcatgttccatgaataaatatcaccagatgagaagtagctgactgtaaagcaaagagaaaagaaaatcaatcactgagattctagtaagtgtgaggaactatggctatgcatcaagatgccaaacaaaaccacgtggtccctgtcttggtgatgctcatggtttagtagagagggcagaaattaaagacagaaatgcattaaatagttgcaatcataataatactggattgcagaaagaattcttcttaatgacagattagagagaataatttttttaaaaagattcacattgatggtgttattcttcaatgtgtacacccatgtttacatttataactggaaaattagctatgactttagaaactcatcgtgtagttgaatatggaataaaagatcaccatgtaagaaaaaagttcaagtaggctactgataaagttggttcatttattcttaagcatccctttaaataagtattttgcaaaatcaaattatcacacgatttttcctgaccatactatatatatttttggcactgtaacatatatacatcctaggccttgatgtgttatttatttcacgtcatcacttcaaagagataaggacttaagcaaataaagagttagatcaactcatctcccaacaaggtaatttcatctacaaaggaagagagtcgctgtgaaacacagcgtatgtactcgactcatcggcagcttgcacaaattgcgctccagatgtatatctgttcaagtcagcccaaggcaacaattttgatcaattctaatgtgataaaatgctgcagggaaagtgtgcagaaacgtgtttacgtcagcccttaattaaactgttgttcacttccaaagaaccttaggaaacactaatgagacatgagttttggcaatttcttcatcaaagcaaagaccccttcctcagtctgtagcagcctgtcatccaagtcgctcccgggataaatgtcacatggcactccaatcagttagccacctgttagtagaacttcattgaagtcaactagtgatctagggcaagctcaaacagcaccttaacacctgcctgtctgggacacctgctcctttttcacatatagtagagcaatatgttagcttttccaatatgctcgagtagattaaggttacaaatcagactactaaagcctacatagaaaacatacaattttcttttttgaaaaattccttttcttccctatagtaacacaatttttaacaatttcaaattaattatgtaagaacacgcaagaattcttgaatttctggaagctattattttcagcaaaccatatcactaaattaaaatgtattaaccatgccagtcctatgatttagtcctttttctaggatagaatagtcctatttctatctggttaacaaagaagtaaattccttcaaaatgttttaaaagtgtaattattttacatattcctaaattgtcttccttatttacatgccatacttgtaacttgtaaacaagtctaaatgaaccctatagagacaagtcaccatttgctggctacttttattctccagtatttaacgttaaggtttgttttattgctaagtgcttataaagctataatcattgttaaaatatctacatattttctttatttttcacattatcaagctgctaaacaatttacaggattcctctttttcctttctatcttttattattgtgtaaatttcatttatttatttaaatttatttaattattttagagacaaggtctcactctgttgcccaggctgcagtggcacaatcatggctcactgcagcctcaaactcctgggttcaagcgatcctcccatctcagcctcccaagtagctaggactatgggcacacgatcacacccagctaatttgtaaatttttagtagggacaaagtctggctatattgcccaggctggtctggaactcctagtctcacgagatctcctgccttggcctttgaaagtgttgagattataggcttgattcattgcatacggtcttcttttttcctttcttcctttttttcttcatcttctttttttgttattttttggcagaagaaaactcaaagtgtaatgaaaacagttgcaaaacttctgttaactttgaccctctggtatgatactgaccagaggagtttgatacagaccagagaaggaaagaacatacataagcacacttagcttagagacagtccaatggctgggatttgacaagattatattatattgacaagttttatcaagttgatacaccctcataattttcaaagttcttcattttttggacttttgaaagtattagactttcatagattttttttaaaagagttttctagataaacaaaaactctgaatattgaaaacctcttcagagaccaaattcattgctgggtgaaggcaaaggtggtcaacacatccatcactccattgaaactctgtcaagcaacacagcactgaaagagaaaaatgagctttagcttaactgggatatttctgctttccattaaaatgttgggtggaagctggaagacaacaggaaaaagaaaagaaccatctgtataagataataatgttatttaaaataaataaggtagtaaatgacaggctaccaaatcaagtgtgtgggatgagttttgtagctgaaatctgacatttttacttcaggccacaaatccagagtcagtcctgagacaaggaaacagtttgggctctgttcccagaggacaaggagaaggcagagaagatgactgccaactgaaagctaaaaagaccacaatttctctgcctctgtttttgccctgggataaacagtgttgaagagaggaaagtgtccaggttatttataagtgtatgagtgttatgtagaataagacaactattaaggccagattggggcagcatctagcctgccagatacttaagatcccagtccaaagctttgaggtatttatttctaaggatctccatgtagagaatgacagcaatccttactttaacaggttttacctaataaataaaggactgatgatgggtgagggtgtgtgtcctgaaggaggaagaaaggagagagagaccaagcaggctctgcctttacttgaaagctttgtacaatcctttgtacaataccctctcaatttctccattttcttcacaaatggagctatcctggctcatggggagaagacacatggtgtgttccttgatggtttaaataaaattcaaatgataaaaaagaggtgcatgggtaaagtcacagggccataaagaatgttctataaatttctgtcagaggacatgctttgaaattgcttatagagccatgtgctacattgaaattattacggcttataacaatggagttaagccactcaggcactgctctagggaatgtaaattgataagatctatgccaatatttaccaaaagccttagaaatggacataagatttaacttagtaattctacagtaggaatgtatttattcccgtagcaaaatttcactgaacttctacttggtgacttcatgccaggcagtatgctagggacttgggacagtgaaaagaactagacaagaatcacccaatcagattaggcacagagttacatgcagtgatgttcactgtatctctctttataatacaaaaactccaaaactatctaaatattcatcagcaaagtagatatttaaaattctatggtgtagccaaagtgtggcatattatgtactcattacaaagtggaaggctggatggggtggctcatgcctgtaatcccagcactttgggaggccgaggcgggtggatcaagtcacctgaggtcaggagttcgagaccagcctggccaacatggcgaatccccatctctactaaaactacaaaaattagctggccatggtggcgtgcatctgtaataccagctactggggaggttagggcaggaagagttgcttgaaccagggaggtggaggtggcagtgagccaagatcacgccactgctctccagcctgggtgacagggcgagactctgtctcaaaaaaaaaaaaaaaaaaaaaaaggaaattgaaggatatggtaaaatgccattagattataaagacaaaaaaacttacaaaatagcatatatcatataagctcaatttactgcaaaaatacattcatagaaatagaacgcaccgaaatgcagaaaaatacatagaaaaacaggctagcatatatacaatgaaatactaacagaagttatctttatgtgatgagattacaggtgatttttattttcttcttcatatttgaaagtttgttttttcaaattccccacaaataactattacttttactgtaaaaactgtaaaatagatatttttgggaaaattgttgcctgtagctccacagaatactataaataattcccaaagctgggctgacaatattgaatcctgttaggtgtcccacattacactgcaagaaggaaagcttcatattagtttaggtactggatattgcaaaactgtaaaatgaaatgcttcaatgtaacatttgcaatttagttggctacaggcaaaacaatgtcttttgaaaatacagtgaagaaaaaagaatatctaaatatctgtgtctaaggactcctctagatgtaaaattttatgattgtgtggcaaatgtgaacaagtccttcccacacactccaagttaacaaaaagctctgaatgttatgacaagacatatggatgtaatcccactacagtagtttgatgatgatgccagatgattcaaaaaataattagctgccatgttaagaaagtatctccttatatatatatatttacatttatcacactctaaaataacactggaaaaaatggcaagctacgttaagaggagataagatgtcatcttcaattagatttctcaaccattttttttaaatttatgaaatcagttccttttcaaatgagaaagtatggtggtctttgtgttaaataaatgaaattcttactttaattactgagttatttaatcttaattacacttgagcatattattgtattcctcagtaaagtaaaatcttttctaatagtttaagtctctcttgccatatattttagcccaagcacggttaagtagcatgttcctacaagtctcaattttatcacttcgctataaaaaaggtctcgaggctacacctacacccaataccaagttaaagcaaacctctttgaagctcacaaatgtcttccagagacacttaaaaaaatcctttgaataatgaagaacagtgctaaaacagtgaatatggaataaatgaaaactactttttaaaaacacttcaaaatgcttttgtccactaagcaatttcattttaacagacagacaatgataaagggtcttgagtaatgtgtgtaaacctaatttgaaagagagaaaaaacatcaaacaattatgcaggacttggagcatattttcgtcacttattaaacactggcataggtaaatagctgctattcaccatgcctctcgggaaaacctcttggctatggagtcttattaatgttaagcatctgagagccatgggctataaaataaaatcaataccataaccttaactgtaaaagtcagaaagatactggaagggctctaatttaacaagattacagatgagttttcagaggagaacatttggggaaaagccatacatttaaaaacatttatgctacaagacatctcaaggtttttgttgttactaatgctgttattatccacgctggtaatggttagagttgatttaactgatgtgttactttagtggatttacaggaaagtcctataaatgatctggaacttacttcaaataaaatcattacactgaggtagtaaactaattgcttgagaacaattatgatttgatgtgatttagtgtggtagaaaaagaattacaaaaattttaaggtcatcagttcagcagctcaatgcaaatatgattactctgcacaatattctgttgctcttaatggaaaagtagtcaaaattggtataaattgtagtgtttaagttcaacctaaatctatattttttttctccaacaaatgtaaatgaagaaaaaaagaacattctgtcaatgaaattactatgatggcatatttattatcctaatggttttagaaatcatgtgaaattcatcagtaacaaaacctctatttagtaatggaccaattacatttgtgagataatgtcaatgaaaccgaatattgtcacaggataatggtctcccattgctacatccctagtcatttagagaaaataaatgttgctgtctggctgagtcatttgttttcaaagtaggagacactgattccataacaaggttctgttataataactcaatctctatcaatcatttgttgcaccagaatggtgcaggacaggacatgcatttgtgagaactgcgcattcctcaggtataaagcaaaatatacggggcctccaagcacataagcagcccaattattgttattcaatgagagtgtttaaaatgaacattcaaaaaataatttaagaaacagaaaactttctgaattttccaaaagatccatgttaatgacggctttggaaagactcaagtactgaagatcttcaaattcttggactccaatagattcaaaatctaaaatattagaacacaaatcttagtatacaactttgttattttacagatgggaaaactcaagagttactgaagttaagtgatttgtctaagaccacaccagtatttagagtttcctaatcacaattacagtgcactaggcttaaggcaaaaagactagaacagaactaaaagaaaacatatgtatgataataaatatatactttatttttatattttgacaaatatagctcattttaaactggccatatatcacacacttctactaaagacattctagaacttaggattatttattactatcttattaaatggaaaagtgattttaacctgatttcagagcaaggactacatgcatgaatctctaaggagtctacgaacccctgtgaagttatgtgcattcatctgtattgaagtttcatgcattaaaaaaaattgtaacagaggttttataattagtttgcaaaatcataaacataatatctcaatgacttatttgggatacagtattatatagcaataacgagcatgggtttcttcagcaagagagccaggggttcccattctacctctgctacttatgatctgcatgatctatgatgagtttcttaagcatgatcagtttagtaagctgtaaaatggggtttctgtcaggtttaaaagaaaaatagatataaacttagccaagcacctgacagaaaggaagggctcaataaataaatgacaaccacaaatggcaatagaatcttgttttccatgtttcatttacatgtgcttgttgaagacaatttttaaatttacatgctttcttcaataaataaataacacagaaaaaggaggcgaataatcagtgtaggctaaaaagaaggtgaaaatacaaatataatctatggactaaatttgagtcctgattcaaacaagacaacctttgagatattctagggaatttgaacatggattatatgttagattatattaagaaattaatgttatatttgttaaattgataatagtactgtgattatgtaaaaaaaaaaagttcattgttcgaaatattcagatctatttacatgcaaaatgacagatatctgggatttgctttaaaatacttttaaaaactgggagatagtaaatgcaataagactggcaaagtgttaataacagttgaagctgtgtgacagtacagtgaggttcactttacaattctactttcaatattctccaggccaaaagacttcttaaaattgtgcttaaacattcatttcaaacaaactcttccccacatttattcttcaaaagcattcatatcttcagtttattttagttgaaaaaattttaatcctggcactaataataatagttgatttatgtgtgtgtgtgtgtgtgtatgtatatgtaaaattttaccatctcaaaattttgttttgagaattctttcagaaccctgaaaactcacaaatacacctctattttctcattctagttctgttaggtctaacagagtcttccttaagctttccaagaaaagtgtccctctgggaagacttgcgaagcagtgtttaaatctcctaggccatttgtaagtttacatactgattccctaggcaggctgcaggataacagaaaatgaaaaaaatcccttgaacaaagatctaggctctgccattcattagttgggacaggacagcctctctgatccttggactacttagctgtgaaacaggagcttgaattatgtcttactaagggttctaataatttgtgatctgtacctgaaaaatcaatttcttattgtatatgatattgggagtctaataactcaaatgacactggctttccaaactacttcacaataagcttaaacatgaactcaatatgtaaaaagatttgaaataaaaccttttcttatgcagagaaactttgtatggcacactatgacattatctcccatgggtttcccacttccctattttaagctgtgttccatcaagctagaaacccagtattaaatagaaagttgttattttttcaaactaattatctattgtggtttttctgcaaaatgctgtattttcaaatctttaagcctccagagcacagaaatatgagcacgacttttccatattaatcagtaccagcccttctaacatgtatacaagtttaccccatccaaaatgctattcttgattagaacacatgaagggggaacaaacattcactaattaggaggcaatgtggggaattctgatgaaagccttcaccaacaatttattgttttcctttccattttgaagaagatcgtgttgtgatttttcaattacagcagtgtagcagtgtagttgaagaggcattcctcttcagggtggaagcatccttgaagtttgctttccaatgccagggtagtacctagaaattcacttagagttctttacttttgatattttccataataagaagctaaacaaagaaacttaaaaattgggcttgaacatcaaattcaaaccatctcttcttcacattcatccaccaaaagcatttgtagctctctttttttctggttcaaaactttggtatttgaatatttgccatttcatccctgtgatactaactgcaggaatataaggaattgttggtgttctatttggtccccaaagagaactttaaaacttcttccagtatggttactaagctgtctgcactgccattttctaggacttcatttaatgttaatgactcccagatagcagttattcaaccatctatgacagctgcttattcactcagctcccacagctctagagaaatcttgagattatatcatttgtcagactgtggtttggactagagcactgtgttccaaagtttgggcctaggattaatgctccctatggattctttgatagaaataaaaggttctgaagtcacaaacttaataaacatgttcagtcaagagccactcctggatattcacagcacacagtagcatattaaatattctgcatattcatttatgaatgaaaatagttgaaatttttgttacaaaaaaactttgcaaatttagctgaccactcttttgtatgtagcatatcttttcacattcctaaactcacattaggaaatgctggggagcctggtgtggtgcctcacacctgcaatcccatcactttgggaggcccaggtaggaggatcagttgagcccaggagttccagaacagcatgggtaacatagtgagaccccagctctacacaaaatttaaaaattagctgggcatggtggcaagtgcctgtagtcccagctacctgtgaagctgaggtgggaggatcacttgaacctgggggggtcagggctacagtgagccatgatcgtgccgctgcactccatcctgggcaacagacagagaaaaaacagaaatgctggcctctgattctggttctgtcagcatgctatcacactcttatttactgttacttatttcctgattgagcacataatactaaactggcatttttactctctagcccccagtgttcccttgggccctctggcttaatgcgtttgacatttaatactatatccttatagaactctagaaagtgcaaactgaaatttagcacaacagttaagactaccttactaatgagaatattttcaaaattatcaaaaataaatctctaggacttggaaacaaattaaaatttcagaaagacttaactgagaagacatttatataacagaactggagacttgtataaaaattagtagttttattttttagtacctaagacaccagaacacaatgcctaaatatagcttgagagtccagtttaatttttcaaactactctccaaattgtaataacatgccaatataccaagtagtgctagtttttgctaacatgccaatttattgattttatgtaaagatttacggctcatcgtccttaaaactaagctagctctaaagcatggagtcggttctctcataatcttatttattttagtccccgatttttctaaatagtaaaagttacttttccattcaggaggtcaagggctggaaacttaatttattcatatttgtgtacccaatgcctataaaaattcctccaatataatatagacatttgacaaattgttcattgaaccaaattatctcaaatcccatacatgtagaaattaataacattttactgcataaagtctttttgaatttatattttatctaagattacaggttgtttaaatactcatctggctgaaaagctgttcaaatttccatttagaaatccccagctgagggcaacccgctggggtcccccttccacactgtggaagctttgttctttcactctttgcaataaatcttgctgctgctcacaaaaaaaaaaaaaaaaaaaaaaaacaacgaaatccccagctgcatactgcaaatatatttaacatatcatattttttctcattaaatgtctattaaatgttttagaaattttacattcagacttagataaattagtgactattagaatggcagtggcaaagtgaccttataaagaattgttttcaatgttcaagcatactatttatttgtctgttaaattactgagtgatatggtttagctgtgtccccacccaaatctcatcttgaattgtaactcccacaattcccacgtgacatgggaggaacctggtgggaggagactgagttatgggggcagatctttcctgtgttgttctcgtgatagtgaatgagtctcacaagatctgagggttttaaaaacaggagttccctgcacaagctctctctttgcctgccaccatccatataagacgtgacttgctcctccttccaccatgactgtgaagcctacccagccaataaacctcttccttttgtaaattgcccagtctcaagtaggtctttatcagcagcatgaaaatggactaacacactgagcaacggaatacaactggatttagtctcatgagagtaacttgaattagacgaaaaactatgacctcttatttttcctcttatatcaaaagttacaaaagattgctctaaagaaaaatttcaaaaaaagtacatcaactagaaattgagtctctgaattgactcagatggaaaaaaaaataagaaagacaagatcttaatggaattttttatggaggaagtattggaataaaagaaatgttcaacttgcctgttgacagtctaatctggttctattcattaatcattaaaatcttaaatgaagaaaagcaatatccaaaaaagaaagtttttaatagagagagaagcagtcaggagtttaagaccaggatttacagaagagactaagcaaggagaaatattctgaaacataggaaagaaatataacagttgttggatacccctttgctagtgactcagtattattttccttttcattttgttctgtatatataaaataatacaaagtaaaaatataaatactacataatatagatgctgacaaatttaattttcatcactattcatcagaagaagcaaattatatagccccctaccaaatgcttaacactattaaattatggttagttttaaaatattcatgtctatatttgcagaagtataaattacaattctcttataatcaggaagttgtaactttttgttttgaaaagaaattacataaggacataattaatttattattgtaatatgctaaaaatactttttcattaagttactaaaattgcatgaacatattattacataaacctagattttgtgttaatattttgcctgatttattttaagaacagaatacatataataatttggtcatattatatcctttatttttgcctactcagaataaatctcaatggtttaggttggtatttcagattgaaagggaaagcagaatgccacatattgtccataattttgttatctttgattctcatatttaataaatcaattttgctaagggctatgtcaagaacagattttaatgcaaatttaacactaacagaataaggcatacccaggaaataattaatagtaaattttaaggatttctgcccattttaaacacaagcatattttaattaaccaataaatagttattgagtatcaattagtgcagggctttgtaggagaaaatattataaatacaagacatgtcaaagctatttcaatgactggagtggcactcaatatgtgctttagacaactccctccatcacagggaagtgtgtctaaagaacattagaagatggacaagaacaaccattgggcattttattttgcaaatttttaaaaagcaattttctaagaacaaaaggactgcattgggcttagcaaatttataaagatagtactgtactgcccgcatttcttcattgtagttgagtcttcttcccacaatggcttattgtgcacattacgaagtcttcagggtcttcagaattaaagtgacagagtgtgtgtgtgtgtgtgtgtgtgtgtgtgtgtgtgtgtgtgtttaaaatgcacatttgagaatggaatattcttccttcctctaaacataatatgcctttacagactcctccaataagtctagtcatcttgacaaaagaaaatcaccaagacaatacaatgttttcacaaagaaaaagaatgacagtttcccttctacttttcaaaaatgtttcataatatgatttgagattggctttattcagtaggcttaaagaggaatcaattcttacaaagtgacactctctataataaagaacacctacacttctgaataacgcatccattcccacacattcacaaggttattaccattaaaatcttctccagaagaattttctgacaaggaaagtatggctttgtttagaataagctgacaatgtcagtaaaacaagcaataaaatataaagggttgagggttttgtttttcgtttcacttctgcaactctggtaaaagtctctattatatcttgccttcactaatgagactggtgttctgcctatcaatggttcatttatacaactacttattgtactcctactacgcaccaagtgtgtgttaagtgctggttacagtaatagtcaaaatagacaaggtcccttctctcacagtgtagacagatttagacaactaatcccataaatagctatatgattacatattatgagtacaatgaaagaacagtactgggtgttgacagagaaaactaggaagacagaatttagactgaaatttctcagtttaagctgggctctgaaggatggcaaagagtttgccagatgaagagttagcagagcattccagaggtcataacttataggaaggtcccggttgttgaattcgcaacttcaagtaaagcagtgggctcaagtgcaagcaagaggaagcagaatgtcacctgccaaggctatggcctgttggtgatatgaaaagattcccattttttcctgagagcagtgggaattgactaaaggatctgaagtaggggaataaaatgctgttatttacattttataaagatgatttttacctactgcctgaaaaatagatttggtggggtctctcatgaggggagtctcagagacaaaattccgtctgaggggggggtctcacagtcaaaactctccagttgagtttcatatccttgcataaaatgacccttgccatctctattatttccctccatgtgcactgtgtccagccacatggcacacacagccattctcaaatttgcctccccacctaacacagggttatgcttttgtctcagttcccaccaccaccctcttcagcccctcacttctttactagttaaaatctcaaggagatttagatgagatttaggaatcgagctttgagtcagttgtgctaaaggaggtacacttgactcaaaggccaatgtctccatgaagatttttcactattctttaaactccatggcactcggtataaaaaatttgagcagcaaagaaggagcactgaataaagaactgactttggccttaactgttaaggcccagagttatgtgtctcctaagagtactcaacatagagtaccccaaccctcaccaatacacacccaagtcctgggctgaaaaccattattcctttcttttagacttttttttttttttttttgagacagggtctcactctgttacccaggctagagtacagtggtgtgatcacagcttactccatcctctgcttcccaggctcaactgatcctcccacctcagcctcctgagtagctgagactacaggcgcacaccactatgcttggcttacgttttattttttttttgtagagatggggtcttgccacattgcccaggctagattttttttaatgcagaattctatttaaaagacaatttaaaaatacatgtttatgctgctgacattaagatcttatttgcagacatgcttacataccaacaaaaacttcagttagctaatttttctatttccatgcttaataatctccctctgattgtgggggaaagcatggatatatctaatgaaatatagtaaatccaacagactttaagaagagctaagtctcaatccttccgggtctcaatacccatttcttaaagttatatttctcctcaaagctgccctagaactgggtcacagttttatctagaaagcatagctagattgactccaacacaaagtatcttacattacacttttctttattgtatatggtctacctacttccaaaaggaattgcaggttcctttaaatgacaactttcagttcctggcacttgcaaactgcttaaagtttggctccctgcaacgctccatagagaggagcaggcggatctaattgaatcacagtttgtggttctgctgtactccaaccaacaaatgtagacagaccataatcagtcacatacataattgtgggttctaaaatatcattttgtctaaaaaaaactccaacgaaacatgtaaaaataagattttggataaattaactttgacgacatttgactaacattatctcaaaaataattctacaggaatcattttatgaaaaaaatatacaatccatattggtttaattatgaaattttgactcaacgaaacttaagaaacgagccaacattttactcatggtctctagaggcatctccttattactcaccttgatctctttcgtgccatgttcgacttccagcagctggtgaacttggagaggggtaaaagtctcctgtaggacttggttccatattttcatctatggatatagttttgggtcttttgctgttaaaatatggcaatagttatattaatgggatttctgggaagatgtgtacattttaaagtaaatgatctgagaagatccttactgtgaaaattttcataagcacaagtaataatggtgagtataatggtgagtattgaagatatcaatagtaatagcaaatatttctagttgcatataccatttattagaccatcttatacctaacctgtctaacaaatatggtgttcattatatttatctttcaaatgtatttccaaaaaaaattccactaataaaaagtgaactcttaatgttgtttgccttctaacattaaaattgtgttattgtgtacctgactcattattattatcaatactaacaatgttccttttaatagcacttgtcattgacaatgcaatccaaagataaggtaataaagtaaaacaagagctttggggtcaagacagtcctagtataaaatcttgagtaggccacttatgaattgctaatagtaagctccttaacttatctaaactcagtttaatcatctgtaaattggaaacaataaaacctagttcaaaggcagacggttggaagagtaaaatgagttgttaaatgtaaagcttttagttaagtggctggcatttagaagatacttatcaaatagtaattcttagtaataaccctatcattaataataaaaaattatagtattttactgattataaactatttcatatattattctttactttttcttaaaacttagattattgattctttattcttaaaatcgactgtgaaaaaaagaaggccactgccaaattcaaacttttaaaatgatactttttttttttttttttttttgagactgggtctcactctttcacctacgatgtagtacactgtggctcaatcttggctcacagcaaactccacctcccaggctcaaacaatcctcccacctcagcctcccaagtagcttgaactataggtgcctgtcaccacacccagctgattttagtattttttgtagagatggggttttgctattttgccctggctggtgttgaattcctggactcaagcgatcctcccacttcagcctcccaaagtgctgggattacaggcaggagccactgtgctcagccaaaatgatacattttaatatggaaatatgactcatctcaatgaataagaaaggtgactatccagaacaaagattaagaagctattttatacccatagtggttgatatacttctttcatatgcccccaccaataaagcagacaattatgaaattatgactataaaagtgaattcttttctttttttgtttgtttgtttttgagacagggtctcactctgttgtccaggctggagtgcagttgcatgaccacagctcactgcagcctcaagctcctgggctcaagtgatcctcctaccacagccgcccaaatagttaggatcacacacacatgccaccaagccttgctaattaaaaaaattttttgtagagagggagttgtccaggctggtcttgaactcctaggttcaagtgatcctcctgcctgggcctcccaaagtactgggaatccagctgtgagtcactgtgcccagtgaatattttttctttaattaaaaaaaaaatcttattcacacctatgctggtaaaacctttttaaaaatcttcaaaattcacttttcgcagcaataataaccataatgttataggatttcagcattgaaattgacctcaaaaatcatatacataaaccaatccccttgtttttacaaatggggagacacatttggagagattcagtggactgtccagggcaagttaatggaagcagtcagacataaggtaaggacgtctgacttccgcaagtgtgctctttccactgcactgtgtttccaagcccttgaatcatgtatatgcctgagtacatttgtagatactcatgattaatatttgactcacaattctcagagtattaacgatgtagaagatggcaatttctatccatgctaagcttagtttcttcccaaagaatccaaagttagaccttacattttaactctcttttaaacatattctctcatctatgagtcagcagaaaatctgcctgaaaaacttaaaattggggacaaattacatgcataaggaagtactagagaaatgttttttaaaccttgcttactctgaaagacagtatcttatataaagtagtcaggaagaaagatctgtgttgacaacagtgatttagcagacagaatttaaaaattactgctcacattttaaatttagaaaaatcaaagcatttctaagactttgatatgtcagagactattttaataataaaccaaattatcttgctacacaatttaactatatgaaaatggtttaaccggaactgatataaaattgatcttagtttataaacatacacatgcccagtccataattaattcaaattcaacgaactttcactactgagaatactttagaaaaataaatatacaggtatccttttatttttaaaaagttgacattgtaaaatgagtgttttgctctagaattcatgtatgctcttatatttgattacacatatatttaatgctctaggaatgagatgggtcttgaagatctagctcaaataaaaaaaaattaacacatctgtaatctttattcaccctgactggcaattacaatgagaagatcaggaaaaaaaaaatgagaatgttaacagagaagtaaaaagcaaagagaactctctctagctgacccccaacatagaatggttaaaccaaatctcagggaaggtagtattttcattggtaacagagcgttaattaaattagtcaaaaaacatcaactaattgaagaacttggcaaactgtggtctttaattttaaggctaggtaaatgacacattttattttttatgtttcattatcctaagcttagatgtaatatttgggtaaaagttaccaggaatcagttataaaccagagatcattgccacagcaacatcatttttaaagccatcaaaagattttgttaacttgtagcattttaatatttcctacaacaggacaaaagtcatattaatatattttcctagttacctgtccccctgaaaaagatttttaaaactgctgtgtacaacaattacatttaatttgtaacagccaaataaatttaaccaggaaagattaaaaatctgtgtactaccagcaaaaattatttcccatctctctttacctacctacctatctatctgcctatcatccacctacgaacctatgtgtgtatcacttgagaatatgagcagcccttctttcagtacctgcttggtggagaagacagagacctctgaagattgacccccgagttcatgtcatgatagtatggttggcttgggatttctccaattgggaagttgactccagttccctgggttatgggcgctgaggaataagacaaagaagcactgggaatgacattcgtatttctgacctctattcaaatgtaataatcgagaatctttcatgcctctggtcaaagatagagagaactttcttcaccttaagcctctaatacccaccatacaacctgggtaggacctgaaaacttgctcaccttagcaacgttcaagcttggaaatttgaggcaatcagattataatcactggttaccaatttcccgaatcctattcctcaaccttctttactcactcctttatattagttgacattacatctgtcactctgctagttaaaaatgccttggaggaaacagaatatacgagtcctatcactcagcaacaccaaacaagctgctttgcactacctaggctctcgaaaaccaaatcattgttaaataaataaacagagaaccgtttcacaaaaaaaagcaaaaatcattattcacagcctcccagttaggatatgataataattattaatatcatgacttctaatccactcaaatattaatgttgatattaatgttgataatatagaataataatttttggtttgtaacacaaaggataaatgcttcaggtgatggataccccatttaccctgatgtgattattatgcattgtatgtctttatcaaaatatctcatgatattttgtataattacatctgttcacattttttaaatttaattttagatatcatgaacaaagctgtgaggcagcatattgtgttagaatcagcagagtcttgagagataaatagccttttagtttaaactccctctgtattataagttatgtgccctagtttcctaactgtaaaatgggagtaataataaccggacacataggattattttgaggatgaaatgaaataggtagtgataagagcctagaatcatgcctagtgtataacacgtgctcaaccattgtgagttcccttccttctttgctttctcctccaaacttcttccctggtagactggaatggttagcaaagatgaacagttcaaaaacgtgttaaaagcagaggaagaggtataaatgaacctgttcgctgaaaatttgttcattcaacaaattactgactgtgtccactgctggcaggtgttggctgcaatgtgtacaaaatagtctcatatattgcccttaataaaaatattgggcaacaagctgggtaagtaaaacattcatgcgaaacacataaataccaaaatagatgaaaatgaaactgtccaaattaatgacatgatccaaaactgctgtagaatttcaagggaaaaagaatccaataccagcttgaattgtccaagaagtctgcgaaaagccatagctggcactggactctggagaatgagtaagagattagagggaggtcattctaaacagggactgctgcagaagcaaaatcataggtagagataatgtgcaaagtggagaccaggcaggttggtgtcaaagaactccttaagaatagtttccatttctttacctgtcttaatcagcccttcaaaagctcacacgaaattgtactctggggctttgcaacaaaattctagagcccctgagatgcactctaagcatacgtggtctacttaaactcctcctctctcccatctgcctcaagttgagtataaaattccaaagggattgcagatttttatggaagttttcttacccctcatttttaatgaatattctaaatgtgttcactaccctttgaattgtattttaatattaggcaggctaagattaacttaaaatatttttaagaaagtatgattaggaggtacaagctttatcacagagaagtaaccacggaatacacaatgaacatctccctttctggactaaaaattaaatacatcagtatatacatgactagtaacagctccaaacttctggattatctatcagccttctgatagattgttcatgttatataatacactgtaacatcctttacacagaaaatacttgtatccaatgagtaactaagtgcctgatggcttgaattatttggacagctaaaatgtagctatgtctgttgtggcttgaggcacaccaaaggttaaaaaaatgtgaggtaagaaatcccacagtaaccgcatgttttataatttattattagaaccatgttctatatgacactggaagtggggtacatgctagaaggagtatttcaggggctcaagtgaagtaaacaatctgtctggcttcctatcacagtaatggatacaattcatagacctgagttattaacaggaaacttagaggttccaccttacataaactattttcaatttattaagctcatgcaatatttaggcaaagatttatagtttctattgaatacatatggctccatagttaacataatttgcttacccataaataaactagatgtaatttgtagtaaatgataattttaaaatcttcagaaattgtttttttctaaattttgttccagaaagattattccgcagtgtcaagacagcaataaaaacgacaaatatagcatgttctcactcatacatgggagcttaaaaagttgatctcatcgaaggggttgtcagaggtgggggagggtggggaggtgaggagatgaagagagattggttaatgggtaaaaacatacagttataatagacagaaagaataatttccagtatttgatagcacagcagggtggctacagttaacaacaatatattacatattttaaaatagcaaaaaaagaagatttgaaacattcccaacatgaagaaatgataaatgtttgagatgacagatatcctaaatagcctgatttaatcattatacactgtatgcatggatccagagatcacatggattccataaatatgtacacatattatgttttaattttgtaaagatagcaataaaataatttgtctacggatttatgcatgagcactgtaaaaatttagtatgcattctgacactaaatgggagatacagaaaggaaagtagattaacaaacacggccaaagtactaaaacaacacacatggaaattatttaatgacagagtgtgtgggaacagcaagtctcagtcagatattcctgcttaagagcctctggaagaacttacatcagacgcaaagatcagtgttagcgcctctcccagggagctacaagaaggctgaaagctgcaaatcatgtttaagaggatgccgatatcctcttagaaatgaagcaccaaagaacctcagattctaagggttagaggccaacctttaatctcccttattgttctcctcactccaaaagctgatcctaaatcaacttttaagatggagataatatcattcaaaagagagatcactatcctaatgctgaatggcttcattagctaaagtcaacatacacatcagtgggtcttatgattgtaaaaccctagaggactgaaagcactagcatactgtaaaccctcaagaagtcagaatttgtgatacacacatagtgttgtgctgaagtttatgtttacttagcaaacccctatttcataaataatgaagtttaattgtgtaaacaaagattatgatgcggatatattaaaacacttaggaggagaacttatcaggcctttcagagacacctatttacatatggaggagaaaataaatgtttgctgaataaattacgtaatgaatatagataattaatgtgctaattacaaatcagtaatgtttgttataacaaataacctaaaagtttctaggatatgacattataagttaagaatgaatgaatgaagtatattaaatttaccttggttttgaactgttctagaaagataattttcatctttgttttaatgtttgaaattcagatttttcaaaatatctatctgggcttttgaaggttctaatgtggttctcctttgacagcccttagcataatattacctatcatgaggtactaaataaatattttctgacagctgactctactgccctactcctaagaaggatgaaaatataccattgaacttgaactcagagaagtacaaatttaagcaaataatttaataagcctcctaactggagcaccataagcctttccgctaaagaagagtatggggaagacacacacaccccttcagataacccctgtcttacctgatgctacaaagtgctactggtaagtcaggcatatttcttcccaaattaaaagtgaaaactttcaaatgttggatacctttggatatcacatattgatctggaaaaacacattaaggtacactgccttggacaatctccttgcccatcgaatacacaccctggggctaccagaatacaggatatttgtgtttcttctcctacactgccaccatgtaaaaagacccatgagagaagtcttttgggcatacatttatccactctagaattataccagaaaggataaactacttaagatcttaaacgttcatatgtatcactccctgctatacatgctatttgcactgttcactttagaaatgtgagctatttgaggaactacggttcaaaagacagtcagtgatagcgtgaagattcctttactgaacaacaagactctaaaacactgcttattcttatcctcagtaactcgattactctttgttctttctggatcatcataattcttattcatgacctctaaatatgacccaaatgagaaacacaacttaggcaggtatcagagtgtgactacatcatctgaataacatcactccgaagtgtgatgcattctatcaaaatgtcaggtgaaaatatacccttcaaagttacataaataagctaaatcagtgaagggagtatgaagaaaggagtcaccttctttaacataattagtacatatagatctgcatcttggatatgtttgtacatgctagtaataagtaaaagagttaatcaaggtaacgtcccctttgcttaggtagcctgccaggtgagcttagcctagaaaaatctgatccagcctgctaagaatggtgtctcaggtgaagtggccagttaaaacaattggacattgttttggataacaatgctttctatctatatccaactacaatctgcaaagttaatttctgcatccctctacactctgcacgttagtgtgtatatcctgtgcatctccaacccccaccaaaatgttagtaaaatgaaaaagcacttatctacaggaaacttatgtgggttatcataacaacatagagtacatttaattaatcacacttcctttgatataaatggccatctatggtcatgcagagaacagtgaattaaatgaataccaataacatggcaatcagaaaaaccccaaaattatttttgtacaacaaaaagttttgatgatttgaatgcaaacattttagaaaatcaagcaaaatatattgttatttcatcaaaggttttaagattttaattcaaattttcctaatatgtggtcactctttatactacatttaaggttcaaaatataaagtattttaaatcatactgcatgcttaagtagtaacaaaacaatttacttacttctggatactcttacaagttctgatacattgaagactccagattttacaaaactatcctcaaggtaacctgaaaataaatattaaaggaaaaatgatcaatataagcagaaagtaaaataaatgattatacactagaatttaagtgttttaaagccaatggtttgaacaaaaaccaaatatgcttacaataaggactttaaaaaatgactcttaggaatgcaaattaggtttgtttaaacaaaaataaaaagtttagataccaaataatctcttaggaaaattttttcttccctttctaaaagtacaggtttattgatgcggtttgatttgccatggcccatgcatacagaatggtctgtgggctctcagtgaatgcttttgactcggtagcacctggtagactaaagcgaaaaatgaaagaaagaaaaaggaaaccacaaccacaattagcaccttgctggaataatgtcaaagatctcttaaagccaccgttcttttgtaaacccttctctgatgaaagaaaagtgaactgctgttaccagcaccccgacccttgttccagggtcactaataacataaaaagcagaacttgtatatacagcaaatacagaactttgcgttgacctatttctgggcatctttaatatacgttgcacgatttcactgctttcctcacccttgctactattccactggactccttttatttcaagaattagacaacttttctggcaaatggtggtgaatccaggcctctgggaatgccacatgacccttaagtcacaccggggcagggtccacagtggccatggagcctgcttgctagctggtctatgtccaaaactagagatgagaactcccacaaacaacagtaaccctgcacccagcccaccccattctcatctatgttaagggggtgtaatgagtgtgaggaataccttagcaggggaggttatggcctacttgcttctgtcctagggtgagaataagtttgaaaatcctcagaattgaaatacatctgagaaacaaacaaacaaaactagattctaagaactggcaatttgactggattttacataaagcttcagggctgaccaaggaattagatgcagttcagagatgtgaagcatgggtagtgcagcaacatggagcactgaaatcaaagagctgggatttgaatcctagccacagatgaccagttatgaaatcttggctaggttattagtcctctttttgcctcagattcctcacttaacaaattggagacaataaaaatcacctatcttatagagttgttactactggagataaaaatataaaccccatgataagcatgttaccaacaaattaagatcttagggccagtggaacctgcgatcagctatataccgaattacgcacactggcctccagacagtccaaaatgatccgcaaatctttattcagaaaatttaccagaacaaaaggcaccacactgcttttcaaccatacatagcatgaaaagacagaaaatcattcaattagcatatgtgtttcactgctgtgaactgaggagccactgatgtttgacatccacccacccaccttctttagaaacagaatgaaagaaggagtgagaggaagttgtaagatctcagtagggaataaaacaggtgccacattaagtcattattctgaaaaatatatatacatttttaagagtattataacaaaatgtcccaatttaatgcacttctattttaagaaactcttatttcttgagcaattaatttttaccaggttaaattcatttcagtaattattgagaaacttctaagtaacaatcactgtacaaggtgctaaaagtcatgaatacaaaaaaggacactgactgtcttgcctggtcggggaaagagatgttttgactcttctggaccactgtaacttactatcatatagaaagatttttgttgcttttgttattgtttatagttcattatactttattttatatagggtaaacttaataaagtaaatatattaagtacaaaaccttctttatcttgggaggccgaggtgggtggatcacaagatcaggagtttgagaccagcctggccaatatggtgaaaccccatctccactaaaaatacaaaaattagccgggcatggtggcgggcacctgtagtctcagctactcgggaggccgaggcaggagaatcacttgaacccggaaggcagaggttgtagtgagccgagatggagccattgcattccagtctgggcgacagaacaagactccatctcaaaaaaaaaaaaaaaacaaaacaaaacaaaaaaacaaaacaacctcctttatcatgactacagctcatatacttaaccagtcacacaagattatttttcatcacccaattgtactttgtaaatgcctacccttcatatcttcctcctgcagctccctgagatgagatggccctctttctacacactctagtctcatccttcaaaatccagcccaaccaccacccactctgtaaactgctcctccaactccttctaccacccactggcccagccagaaatctccttcctctgtacttgtatagcacctagtttgtactaattttatactttgtactttcagattttctgagagatctgttttcaagtcttgcagtcattgctggattatcagatcctttatttacagaagtgactgggttttgttcatctctatatcttccttaatgactaactcgttgcctatatatagagtaagtactaaataaacacagaacaaaattttaaaattcaactttacaaacagggtcacacattaacatcttagtcattttattacaatgtagatacagatggtttaagatttatggataattatactaacctctgttattccctagaacttgtttgctgaagagtgtatttaggcttttgggtcacatgagaaagagtaatgattagggtcggattgtatctcttactttgttgtgtactaatgtgtaatgtcaagcatttaatacaaagtaacaaccaaagaactggaagtgtttaaatagtaagagcccaaaaatatttgtgaaacacatcgatgaataagtgatgaacatttcaatgtatttacataaactatatcagaggtaatacaaaataacattacaatatctatgtgtaatctgaagttcatttccttattactccaatgagaagtcagagatccatctgctcctaagtcatgaccattaagatggagtggggtgtgagcctgttggaagccaaatcatgaagaagggatgagtcagctcaaggccaattctaccagtgggaagacagtcaggcagtcaaacacagacaatacaatgactattgcagctattcacagaaaaaaagaagacaattcagaatgtagcagggtgtttctccactccccacccccaacttcccaggttctaagaaattggaatctacggaaacaatggaaagaggtagtttaccgaaaccatgaaaagcattggaaatatatcagaacttctttggaacctactggataaaatgcaaaaaaccacagaggtcccactgggctctactcctgcatggagcccagtgagactttagtggaggaaggtttcctgaggatgagtgatgatgcctattaaccatgtacctatgggaacagggacaggtgagaatcagccaagtggggtagcctgggagaagcaccggaagcagatggctgccaccttcatgcatctctgcaggcagcatagcctttgtaacggacaggcattaaccaagacgtggcagagtgaaaaagaaatcatggatgaaatagtactcagatacttaaaatagtacttggatacctactagtgcttactcattagcatacagaagacaatacttgagggctgtagcaaaataactgagaggattttgaaatgggcaggggtcctgcagtaggatagggggtgaaactcagcaaaatgtcaggttatctgctgctaacataaccccatctgtaacctccaaggtccttgggcctttcaggaacatgtttttcacatttcatagaccactgtaaatctaaatagctaatacaacagctaaagatcttaaagcaatttggagacattcatatagtaaattcccttcgtctaccaaaggaaatatgagcatctctgaggcagagcagctgcttaatggttacagagcaatattacacaacagcttaatccaggaagaaaagaacaactctgcatttgtgtgatgctgtatttacactacatgtgtgctttttaaaaaaaataaaattgagtaggaaataaagacttctacaaactgaaaagtctcaaaggcaatatcaaattatattattttacttcttttttatttttctctgacaaaagcaacagtaaatcactactcagaagttaatatactgtttaacctcctttacaaacaataacagagggacacaatggcatatctaactgttaatatctcaaattataatcagtaccatttgaatgttaaacaacatttacatagaaaatccaaaggaagactgataatgctcatttttacagtctactgtgttctattcttgaaattaaaaaaaaagaagccacagaaagcagttattaaattcatgaaagccgtcttcaagtattcgaaggactattaatgtagatggtggatttgacttattctgcatagttccaggagctgttttttggctcaataaacagatttgtcatccaatgggaacaggcctaaaaaggcatgtgaaattttgcaaaggtagcataaccaatatattcccaacaactgtgatgaccttcacaagcaggcattaacttcacgttcaccattatcttataaaatatgtcatattattggtgttgccattttacagatgaggaaactttcatcttacagagatagtttctcagtggctataaagactcccactggatataaaaattcttgctttgtgaaggaaatctcaaaaaaaaaaaaaaaaaaaacagaaaaaaagaagaaagcatctcaaaagccactgcaacccacagattctcccttcttacacagatgttttcctatgttagttttctggcattgttcatttggagaacaaacaggtggacataagacatctataggcattttccagccctatgattgcaattgttcactttcttcaacagagtttaaaagaaggcttaattctttttgtaaagggacaagaagagattactttatactagctctttgccaatcttcatataacttcagataccacaactaacccattggtaattttctggtagtgatgttacaggacatagttctatcttcagtttctcaactgacttgaactatccatggttaaagctaaacttgtgttgaagttaaagctgaaactgtgattataaaatagaaatattaatcattgcaaagacggtgattttcttcacagagattaaatctcagcctatagcccaggttaacattcaaatattaatttagaattaagtgtatctctcaatatgaaacgtaaacccacgaggatgatttaggtgatcttggagggagtcagaaatttcccaactttaacacgccctgatagcattatatttttttcaatatttccttccagtcctttaaactttttccgcatatatatatatatttatttataaaatcaatatcaaatttaaatatagttgtatccagcttttttcctattaacattgtatctgtccttttagataaagtttttcaaaagcatgatctttatgactatatattgcatggctgtatcatactttatattaaccattccattgtttggcattttaggttatttcccaatttttaaaatataataaacaaatagcactgtaattaacatcctcatacacaaatctttgtcagccattctcatgatttccttaggctggagttcccagaattagaattacagggtcaaaggacataaactcttttaaaactcttggtaaaaactgtcaagcagctttccacaaagttgttttgccaacttacactccttagggcaagctgtgagcatgtccatctcacaatcctgctgccagacttacatattagtagggatttgtttttaattgtggcaagttgatagagaaaaaaggtcattacattaatgttacaactttcatttatttcattttaataaaatggactcatttcagatatatgagcatatttctttcaccagaacattaagaaacaaaacattttaaaaatcagaacattcataaatacacaaacattaaaaatatataaaatagaaattgtgctagcaggaaatttttttcctaatatcaatgagattgcatctacagtttcacaatgaaaatgttggctatgaatttatcactgatttttttttctcattatctgaaaaagtactcacttattcctagttttctcagatttttaaaaagttttctgacgagaatggctattgaatattatcaaattcttttttggcattagtagagattctccggtttttttctaacagcatttattggtgttatatattactgaattcgtagatttaattatctttgctcatccatggaagacagttcttaaatttactgttgaactggttggctcagtttcttctaatatttctacaggtagctggaaagcttttatggaaatttttgtattttatttgtcaagtttttataccaggagtatacacatgcttcataaaatggttttgatcattgtcccaatatgttttatgctctggaacaaaacaaaatattatttcataaaaagttattgaatgtttggaaaactttactagtaatatcatcttccttgaatctgttgcagagaagactcttagataactctgaatcgtgaatactattctacttttgctttctaatgttgagataaattttattatatattttccaaaaaaattcaatttttcagatttataaatttattagcaccgttattttacagtttactaagtgggctatgtttatttttatggcataataaaattaaatgtatgccctcttatctttttaatggatgtggaaggtatgcctctctccaacggtgttaaagcatactagctaaaaaggcagccctggggcaagactatcaccatttactatgtaaacctaaggcaagctgtctaactcttctacacctcacatttctcttccctaaaatataggtaataatcatactacctatgagtagatgcaaaaattgcataatcttttcaagtaatagtaaagcagacatctcaagagcaggaaaagaaaaagtagaatttccaaattagcaaagagaaaagaaaacacaataaataagaatgcaatcaaggcagcaaaaataagaaaataggatgtaaaaatatataataatatgaagtaaaatataagggataaaataaaatacataaatcactacaataaatgtatatggactgaattttcccataaagggagtttaggtcaactgaaaaatacaaaatccaactgttttcaagaaacacacctaacacaaaatgataataaagagaacaaaaagttgtaaataaatgggtaggcaaagagaaatcaggcaaattcaaacaaaaaggaagcagtatcagcaacggttaagagaaaacttaagctgaattacaacaaagataattataaatggataaaaggcacaattaataaagaagataaatcataaaccccacatgcaccaaaaaatattatgaatacaatctattaaaatacaagaaactttataaaaaataaagtcacagtgagaatttttactattaatgtatctttttaagaattgaacatgactgttagacaaagactaacttcatatcattcaaatacaaattatattttactgatatgttcatggaacttctaaaaacatcgatcatgtttttgaccaaagaggcaactttaacaaatccctaaaagtacagacttttaaggccatactgtctcatctttggcaaataaaagtaaataataaaaaaatgactgaattatctcaactacctagaaattaagaaaataaaccatgaaccaaagagaaaaatcaaaagggaaattataaactatctaaaaagcaatgaaaagaaaaagaagaaagaaagaaacccattacttaccataaaagaaagaacagcatcacaaccaccccaaaaattaaaaagatgaaattaaacataaaagctgaaattaacagaatagaaaaaaagaaatatttaaaaaaataaataaaacaaatgactctctaaaaagaccaacaagacagaaaaaccacttccatgcctgattaagggaaaaagagaaagtaaaaatatacaagtatagtcatgaatggcttaatggcagggacacattctgagaaatgtgttaataggcaatttcatggttgtatgaacatcacagagtgtacttacacaaacctagatggtataacctactacacacctaggctatatgcatgaaattgcatatagctcctaggctacaaacctgtatagcatactactgtactgataccgtaggggattttaagacaatggtatgtgtgtatctaaacatatctgaacatagcaaaggtaccataaaaatattataatcttatgggaccactgccatatgtaatctgtcttcgactgacctatcatgatgtggtacatgacatacaaatataaaaagaagacataaccatagaaatcaaatacattaaaacaattatgagagaataatacatacaacttattgactacaactttgaaaacttaaatgggcaagtattagtaaactaaaagtaaccaaaattgagcagagaagtgtaaaacctgagtggaccgattatcctagtgtagtggttgccaaatttgctgaacactggaaccatctgggattcttgaaagcagtttatgtttggcttccaaccccagctattctgatttaattgatatggggtgagacctggacatgagaactcttttaaaagttcccccaagtgattcaaatgtacagcaaagtttgggaatcactatgacaccacattcagaatgtggttccagagccactagcactggcataactggggagcttattagaagtgaagaagaataggctctaccccagaccctcagaatcagaatccacagcttaatgagatctgcaggtgattcataagtgtacttaaaaatttgacaatcctagaacatactagaaatgtgagtaagaaccacctttgaaaacagcaccaggtccaggcgagtgcacagctggattttatgtatcctttatctagtctttaggttccaatgttatttacactctcccaggccttaggaaataagacaagcttcctcatgaagaacactttcttataagcctctatgaggccagcaaaacttgaatacctaaatttgtagcctctctcatcgaaacaaaacaatgaaccaaccaatgaaagatcaagcacacaagtaaatgtgacttcaagatgcctaaataaaatatgaaattgaatacagcaatattatcaaaagaacaatacactattataatcagggtttattccatgaatgagtgcagctcactatgagaaaagctatcattacgatagaggaaaaagtcatatgaccatatcaagatgctgaaaatgtacttgacaccaagaggcaggcttacctaataataaatctaagcacaaatagagacaaagcaaataatacagactcttcagcaaaattcaacaataaattattctaaaaggggaacactagtctgtcattcctattttcccaacctccccagcctcctcctctttgcagcccttaaaaatgtaatctggaaaaaagccagtcacaaaaagacaaatactgtataattccacttacatgaactatctagggtagtcaaactcatagaaacaaagtcacatggtggttgccaggggctggggagagtagggaatggagagctgttatttaacaggtattgagtttcagttttgcaagatgaaaagtttctggaggttggttgcacaatgacgtgaatacatttcacactactgtattgtacacttaaaaatggttaagatgacaaatttaatgttacgcgtatttcactaaaatttaaaaatgcagtctaaaattttggacccagattgttaaccacattcttgtttacatatattcaagaacaatcttttacattgacatttatgtctgtcatcttatttataacaattacttggtcataattctcaccttaattgttactattctcatgattagtctctatctatatttttattcatatatttatggttatactttcctgttcttaatttttttattgagtcatcacattgccagtcagaataggtattcaagtaacatttttgcaaataaaatgaggaactctattttttgataccatgagtaataaagaatatatttccattgcctttgactgtaggtgaaactccttgagtgaaaaacaatgttttttccatcacaatttcaagtattctcccactgtctcctgttatttaatgtcgataaaaggaaatctagaagtaacttgtttttcatccaggacatttcaaaattttcttcatccacgaaatgtaaaaatttcaacaggatatatttagatacaagcctctcattatgtggctggaatagcattagtccttttaatccacatagataatttttagctcatcaaatttttctccatttgtctttgatcctacatcctccaatttctccacaatgaacacctaaataaaccttgaattttctattctctcatcatcaacccttttctcatcatcttaacctctgtgtttcctctgcttctggaataagtatcttggggttgtcctctatatcaatgcttttttccacagtatcagtgctgtttcttactcctccgatgcaattttaacgctatgaaagcaatttagtttttcttgatattcttcctcatctcacagaataccgcatttattgaagctattcttttgtaggttcacttttcgtataagtcttctgggtaaacattttctctggaatttttttctagttctttattttcaaagatatgtcctcgtggttcttgatcatatcccatttcccttgttcctccatattttctcaccaagggcatattgttgtgtgtgtgtgtcggggggggggggttcccctttttaacatattcagtaatgtaaactaattggaagagacagaaaacagatcaataagtcatctgaagatgagggtagacgaaacctttgggattagaggaaacgtcatcatccttgagtgtggtactgatttcatgagtatatgcatacgtcagaactggctgggtgtggtggctcatgcctgtaatcccagcactctaggaggccgaggcaggtggatcacttgagtccaggagcttaagaccagcctggacaacatagcgaaaccctacatctactaaaaatacatagcatggtggtacgcgcctctagtgccagctgctcaggaggctgaggcatgagaattgcttgaacctgggaggcaggggttgcaatgagccaagatcacaccactgcactccagaccgggcaacagagtgagatgctgtctcaacaaaacaaaacaaacaaacacatatgtcaaaactcatctaactgtacactatatatatgcaacttattgtatgctattatacctcaataaagttagcaagtgacctataaagagtggtttccaaattttcaaaaagtgctatttccacagcacaaaaagaatcacaagtgaatcagaaacattcagtgtaatcaggaatatttttgaaggtatgaattacaacagtcaggtatttttttgcagcttctagaatgttatcttaccaggttcctcattcatggtcaagtgaactctaagaacactgtagtatactccctagtaaacaaaagcacaaaagcagcaaacaggacttctctataatttgtcaaactgggagaagagaaactctatccacctgagattagtattctgaatcagcaattatattggagtgctacaattctcagtcagatacctctctacaaaattcatcatcagtatgctacataagatgaggagttcagaaaaatattccaaataatcatgtctaggatgtggtatacctacagggcataagaggatcactgtaagtatctccgcagaagtacccgctttttctaggcctaggtcaggttctgagtaagggaatgatcccacacactgcaagaacaggttatttatttagtctattattggtctaagcctctgcttcataaatcttggacattgtctgtaggtaggcattgccttggatgataggtatacaaaaaagaagaatgcaatactcacccaaaggggctcagaattcattaaggggagtagatgcgaaaatagagataaaatagtgcactaaatgctagtactgtaaaacagcactgcagagaggctctgaagaagtctcactgaggaggtgacaagggagtacaagcattctaggcagagaaacaacatgagcaaagatacaaagaagcagcacacggctaacgctaaaggcatagtccatgtgtgcaacggacaaatcatgaagggtcatattgtatgtcatgctaacgagctaggcttaggctagagtggagaccttggaaccatacaaggaggtgaatgaaataatcagatttgcacatcaccacagacctgtaatggatatatcagagggattaagacatgaggcaaaatatcgctacagagattaggaaatgattaaaatgatctaggtgagctagttaaagaggcaaagtgtaaaggtttttaaagagttattaagattcagcatcaattaccttctttttaaaacattttgcccctctcatcagcagcctgagcctttgtattcattcctctgttctttctacattctttctcccaaaagctcacaagtactcccttcttcacccatcaacattatataaggtaacattattcatgtgggctatttttggatatcaatttggacatggtaagcataaaatagcagaatactttatcatgtcccaacagacatgatcatcttctagttctatcttacttatttagaaaatactgctctgcttagaaagtacttcaattcagaaaatgacagcagtccaaaataccaaattttaaaatgaaaaatccattgcattgaaaacattactgcaaaatacacaatggagccagcatcttaccattcatcatgtcactgtttgtttcatgacattaacaagtggaagtgatgattttaataagatcaaatctgaaagtcaagtggttttcctgtcttcttcctgctgaatactgcaggaacacacatacatgcaaggtatagagcactgcgcaaggggaagatatgtctagtggaatcaggaattaaaatatctcagcaaaaacaggagtttggtatgaaagatgccaaggtccctaaagagcagaatgtaagtcaaaagaccccaaaaagatttgtaacaactttgaaaaccaaaacctgaccattgtttcttaaattcttctatgatcaatgacattatcaagcaaaagctaataagagtcagctgggtgtggtggttcacgcctgtaatcccagcacttgaggaggccagggtgggcggatcacatgaggtcaggagttcaagaccagcctggccaacatggcgaaaccccacttctcctaaaaatacaaaaattagccggacacggcccatgcctgtagtcccagctactcaggaggctgaggcaggagaattgcttgaacctgggaggcaaaagttgcagtgagctgagatcatgtcactgcactccagcctgggcaacagagcaagactccttctcaaacaaacaaacaacagtcaaattaacacacaaaagtccttgcttaaattattcattacctagatacgctttcatagtcacggagaaggaaagaaaaactgagactttagtaggagatttgtccaagatctttaaatcacatcctttaatcctataaggtagaaaaagattaaaactcctcgggtaattagacacatatctacttaatattttattctgtttgcaatatattactatagaattgtactctctttttaaacattatgcttaaatatacaagtgagagttgccttagtgcctggacagtttagtccagcgagcttaacttctgcaaagttcagtgattttaacaagcctagagcaagtccactatatttgtgatacaaaacaatcccagctttccgtctgtgaggcagaaaatgctttgcattattaaattgtagctgtatgtggcaaaagcagatcttgtaaatatggagagggaaagaatttaaactgagaggaaactttggatgcaggaggccaccgtagaaggaacctgaggccaggcatggtggctcatgcttataatcccaacactttgggaggctgaggtgggaggatcacttcagcccaggagctggggaccagcctaggcaacatagcaaggctctgtctctacaaaaaaattaaaaattagctgggcatggtggcacatgcctgttgtcccagctacttgagaggcttgaggtgggaagattgtttgaacccaggaggcaggctgcagtgagccatgactatgccactgcactccagcctgggcaacaaggcaagaccccatctcggggagagggggagttacatgagatacttgggtaaaagccatcactacaacactgcccagaacagcaggtaccatcacaacctcacctagaggaatttatgactcagacgtcttttcacatgaggattctgaccctcccttaaggggaacctagacattcaactaagaaaaatataggttatagcaatagcctttaaaatttagcaaattacaagctatttctgtgcaagccctcttggaagttttctggaactaggtacagtattaattaagtgcctacatcaatatattaaaattttacttggattctatgttaccttatgacaccatttcagataacacgagaccttaaaataccgttgtaaagttaaggaaagtttgaactaactgtagcccatgaacgagtcctttctctgacagcattgtgaaaggagagtactgtgttgaaattaactcttctccccattctttctttctctgacctgtatattaacacaagtcatgaaacacaaatctgacttgctgaaaaacccctgatgactcactacttatgaacctatattctatgtcacggctttaaatgctgctcaagccttgctcagacaccaagttcccttcctttccccttcttccatgtgaaatgctctttcctcggctaggactatatccaccctacaacctcttgttcatccttttatccaaactgttccatgcatcttatattccctgggaaggggtagacatctctgactccactatgactgctcctttaaatataaacttgtgtgcacacatctcttgcccagtaggcagtcacattttttaaaggtttttcctcaatttcaggcaagaaacagtgttcagaggtcaaataagggtaatggtaactgagaggtaaaagtaaattcaagagacctttcaaagtagaatatgaatgaatatgtggaggataaggaagaaaaagggttcctgggaaagaaatcatgagcaactctaaccaagggtatctagataggattctggtgactccaggatatcttaaaaagggaaaaagcaaaaacaaagaaaacaaaaaacccaagtctggtaaaataaaataaatttaactttggaaatgttaaattggagttaaccatgagacatctagggaaacatgtccgaaaagtagttggacacataggtctaaatcattaggagagagaggtatttcaaaggtaaacatctaggagaaaaggttaatatactttaaaaatcgcaaggtactgaaaacacagagaattaaagacaaaaatctgattaagaagacagaagaaatcaccatatgcaatttttaaacataggaaggttcctggattaccaggagaggtcctgttttcagaggcacgggcaaagttttaaacagagcatggccaactaaatcaaataaatattcaggaatatggaagcaagaacaggacagaaagaaaccactggtcatggatttaatgagaatcatttcagtggggacagaagctgagaagaaatcaagatggaatttcaggggaaatcaagatgagactttgacatccttcatgccatgttacgaagaagaagagagagagatgagacacttggttaaaggggtttgtccaaatgaggaacaaaagatgtatgttttaaaataagaaataagttggtaggtaggaatcagtgaaataagaggcagagtaagagggctaggaaaagtaaaggacagacagaagtttcaatagacacagaaagttgatggcttcataaagtagaaacaccatggaaaggaaaggaggggaaaaaaattatacaatgttaatacaagcttctacaagataaattcttggtaggaaaaaagtaatctctaaagatacatttgtaccttttctcatgtcaatactgagatttatgtaacaaaagtcactccacctttccttttatgccaataggcttataacaacatttgctttctaaaaattacaattctatttcatcatgagacttgaaagcatctgtttcttttgcctcctttataaaatctctaacattctattcttatgcatcttctgtaacttcggtatgtcatcttaagcctttagagaagagcagtataaaaattcaacactttttttttttttgagacggagtctcactctgccacccaggctgctgtgcaatgacatggtctcggcccactgcaacctctgcctcccaggttcaagcgattctcctgcctcagcctcccaagtagctgggactacaggcaagtgccaccacacccggctaatttttgtatttttagtagagacggggtttcactatgttggccaggctggtctcaaactcctgaccttgtgatctgcccgcctcagcctatcaaagtgctgggattacaattcaacacatttctatttgattccacatcaaatgatactttctgcaggaagccttcttgatcaaactagctgaagagaaagtagaatgaaaaaacccctcacttttatcaagcacctgctatctgtcaggtgtgctcccctatgtgatcctcacaactggcatgaacataattgactgcacaaagcggttggctgacttgctcattctcctgatgacccttataatcattcaagggaaaattttaattccaaagttcatgctcttttcactccaccatgccacctacaatggtgggaaacagtatttcacaactttgaactcctacaagacctgcatcgtaacactaatatttagtctttatcttaaatataaatacatatgtaatatacatttcatatattataattatgtatatattattttgtagattttatgaacaaaaacatttgggaaaagcaaggttcatgtgtaactcacatttttatcttctccagtatctagccgagtgtgatgcatacaatagatgctcaataaatatctgctggctgaaaaatctacctatagacagctctttctgaattgtttatggttcttggtataaaatggtgtgtattttacacaagggcaaatggctgtctctgcttctaatgttgagctgactcaaatgtagtatttaattgttaactcagcaatcgttaggcaattaatataatttgttatctgatagagtaggtgactggggagacatggaaaaatctccttctctcaggaccttacaagacattcctaaattgtcccctttttttgactctttcacattaagtattacaaataatcaggctagaagcactgtggaggctgggcatggtgccaactgctatgtagatcaacctttcatgagtgggctgtatacaagttcccataatgtaccctgtaaaattatgtagctgagggctatgcgttcttctggctttttaagagtaatttgtgaaagaaacacttccctcatcctctcttcctttactctgaatcctattctaaatttgaacatttaagaactttattgaatgtgacgtctccaaacaagttagaggataaagaagaaaaatgttttaaaacaaaatacattaaaaaaaaagtcctttgattttagcactgacccatacagacctcattctcaaattacttaaaggttttacctacgatgtcaggtcttacctgccattaaccagtcctttcagcatctttctccaaatatttttatgaatagagagcctatttatagtcgaatgcacattgtctagtgccaaagtttaaaatcaccttttaagtatcatgaaatagtgcatttttcctcattaaaaacatcttgatcctaatggacacaataaatgaggacatgagaaggaatagacatgaatttattaagaagtgaatgaggccgggtgcggtggctcatgcctgtaatcccagcactttgggaggctgaggcgggtggatcacgaggttaggagttcaagaccagcctggccaacatggtgaaaccccatctctactaaaaatagaaaaaattagccaggcacggtagcaggcgcctgtaatcccagctactcaggaggctgaggcaggagaattgcttgaacccgggaggcagaggttgcagtgagccgagatcacgccactgcactccatcctgggcgacagagtgagactccatctcaaaaaaaaaaaaaaaaaaagtgaatgaaatatgatttgaaaaagccagagtaaatttctcttttctttgactttgactttgaacaccatattccaagataaaacgtggtatgaggtcctcaaggacctatgcgaatttatctgcctttatgtacagattaaaaagtactaagtttgtcctaaattctaagatctgaaaaatcaagcaaatatcggctctagtgatctcaacagatgaacaaatgacaatgaatactgaagattttgaactagttttcctaataattatttggtttgtttctattagttttatgacaaccttctgttggctttgatttcagtatctataaaataacattggagagagagctatctcaaaatttttatgacttaaagaatttcttttttttttttttttttttgagatggagtctcgctctgttgtccaggatggctggagtgcagtggtgcgatctcggctaactgcaagctccgcctcccaggttcacgccactctcctgcctcagcctccccagcagctgagactacaggcgcccgccaccatgcccggctaatttttttgtatttttagtagagacggggtttcaccatgttagccagaatggtctcgatctcctgacctcgtgatccactcgcctcggcctcccaaagtgctaggattacaggcgtaagacaccacgcccagccagcgacttaaagaatttcttaagtgcaagataagcacatagctatcattaatagataatccttctttgatttactcagttatttatttagtgtcatccttgctccagagaggatataaggtggcttacttgaggtacacccaatatataatcctactggttcccagaggtgttgccacactacatgcataagtcaacacacaaaatagcacaagcacctataaaacctacaaaaaggaaagtagcatgttaagtccatgttattcccggtaagaaagttctgcttaatgatactagaaaggccccaaaagtttatatcataaaatttgcaaaaactgccctagcatttaacatgtcttcgtcatattaccagcagagaattccccacaaaactaccagccttcctgaactccaaaataagacattagtttggaactgacttagaagcaaaaatctgaattctagattgctatgttttccttggattttacccattctaggattagtcaagggattgagattgggaaatcttaaagatcatagtccaaagaatgtagacacacaaaataataaagcaagtcaaagctaatttccaaagattaccatccaatcaatcacacatttcctaaaagtagcagtggagtttttaattattaaaggtaaaaagagattcatgtctaagtcccaaaattaatggtttaccctcatttggtccacaagagttgtttgctataaccaagagaggacatttttagttctattgcttaggagggattaacttgttaaaaaaaaaaaaaaaaaaacaaagaagaagaagtgaatataaatatataacttctgactctatcataaacaaggcaaatgtgtatccctagaaaaatgaagtgcttagcgcttctcagccaaaattgcaatgccatgtccttgggtgctatctgagttgtagagcaccttcactccaaaaagattacggtgcccacccctgccacgtaacaaagaatgcaaacaaaacatttaagtcacaaatcgtttaaagaaataccataaaggctacttaaaagctctataaaataacaaatgacaaaaaattacttaaatattttataaaataatatcaaatattcctttccaaaaatgcgttgcctttgctgcttgtgcttaaatactaattccaacacagaaactcaaagtaagaactaaaggcctatctgtagatgtccatactatagtttgaagagctttagggtcacccttcagaagttctaagtcagtaagaaagtagtctcaaagtcagacattcaagcctgatgctggagaaaagccaagccagaggaggtgttaagtttgtgggtaggcatatgcatctgcacttataggatgatcggatgggattccaccttcaagtcaacagtggggaacagatttcaaagagcctatatctccaaaagggcttgaatttttgccatctcttcccaagctgttggggaataaacacaggaatagacggtagcaatttccatgggttgcacatctcccagtggaaaactaccagtgataagaaagtgttggtattcaaggtgatctttttcaaaagcttagcttgtatttggtataacaattcaagcagcaaagtgatttgattgtttcattgcttgtggtggtagactgaattttctcatacatggatcgtgccttctcaagacacaaaatctcaattttggagatttcatattttggccaaggcaagaatacagagataaaaagagcttcctaaagataaattatgtcctaaaataccaaatatgcttatacttaaaaaagaagcttttaatagaaagtataatttactccagttgactacaaaacaaaaaccttaataagttctagttgttcacatttaaaattagaaaacattttatattctaggtttaatttatttcgaagtattacaaaacaaactcttaagctcataaaaaattctttaataatctctatcattaagtccaaaatagaattccttaataagccttatggttgagttcatagtattataatacacaaggcatattaaagtcaatattttacattctggataattaaataaaattctaattatattccatttaagttgggtataatgtgtattttatattacattctggctctaaaaaaatagaatcaacgtacgatttacatatatacaattttcaactaatcataaaatgtatttatctgtagcatcccagtttcaggacacagtctcaaaaaggtttgagttccaaggaaaatttaaaagggaaaaaaattagaggtgttctaccttggttgtttttgtttgccatgttatatgcaaacagagaaataaagagatgctacatcgaatgcagcaaaaatgaaattttaaccaagcttcttgacaaatattgaaaaattgaatgatgttacataactattcaaggattatttattcagctcaagtagagaacagttttaggtgagtataattccttctgtacatgttcagaaatgaacttcaaacaataactgctttattagtttcaaatcaagctttcattcaaatgcagaaaacatatccgttgtttagtccgacttataatagctatcaactctttttctaccaaaggttcccctcttctcccacctcattctttgtaagatgagtaaggagacttttaaaaaatgtttggataaaattcattttgtctatcatgcaacacagggaaaatatcagttaattaaaaagaaaaaaatctttgtaaagttaaaagaccctataagttaatgaaatattctgaacttctgaaaatttttgacaaaatttattatattctaagtagcctttttggaaagataactaaaataatatcaatcctccattcacacacaacaaaataaaataaatttaactgggaattacattttaaattattctgtttttaatgttttgctctcaatgtacagtaatatttaaatgatttatgaagaaaatgaaaaatcaacttagcatacatttttaaacctgtgtttaattagaactttttatctttgaagtgtatactacttttgtcaacaatatgattttgtacaatacagaattaataaatatttggaaaaagataatttttctgaaataaaaaaacataggactcagaaaaatatagtctgttttgattttgcatttttacttgtatatctacttgctgtatctttctaaaatcattttaagacaaaattggtctgataaactttcttgcaattttggtgttcttctggtatttcagcctcatattagctaagcacgacttcaaggaagatcaaacgatggaggacctaaaaactaagtctacctgaggaaacttttcctattacttcatataaactttctggtttattttcaacgaaaggacagatgagattgtttggggaggtggggggcatgtgtagctggttcggggtttttgtgtttggttttgtttttgttagtttattcttagagcactcttttactaaagtcaccaatataattcacattcttttaataatgaaaaactgcttgtgctagttttatctcatgagaaaaaacactgttcctaaatcaaaagcaaaatgttgtatgttcagagctatatgaagacagccaagttataaaagcccattttcagatctggaacaacttctgaaaacaaagagggtatttgggataccttatgctaaagaaaaaaaaaatcctgctttcattatttcctgattctggagatccaataaaaactttatggaataaaaagtcttgcaaaaatccttcagtgaaaacacaaccaaccactcccacccccaacccccttctaaagtaatgagagttgataaactataattgcagtatggaaatttttacattttcttatgagttttaaaagaaagattaaaaggttcattggcttttcaaacagcaattattttagcacctaaaagatacacaactaaaatatatgcgtatttattttcaaagaaacaccaacaaaaattaaaacattggtgattaggtaaatactgatgacgccaatataaaagtatttgccactgcaaagggcctaagcacaatcacatcttgtcccgatcatacctgcctgccagaacaaaataggcagctgaccaattatggggtgtttatctatacagtggtacctttgttctccaacaatgtcagattgcaaatgtcctggaacacatatttacctggaggattcttggcaggatcattgtggcttggacttcctgattgtccagaatctgtaaagaaatcacagaaaatgttttctttttaatttgttttgaaagaatttcacaatcctcaaaggactcgaaaaaaaaatttgaaggtataaaaatgaagttgagtgcttaaataaaatacactttcccaagacttttgatagaaacattttactcatcaaactacatgaatgcatatacatatttctatgtcaaaagaaaaacacaagtattgatctataattttcttgggctagagcaaggtttttttgaaacaaaagatctggctacaaagccattgaagatggtttgaaggttaggcaaatattgaggcctgtcagtagcaatatgaaataaagcagatatattctcttaaaaatgcaatctaagtgtaattaaacgtgcatttaaaagcctgaaagtatgtttttattcaatgagtaaaatacacagaaatgagagtccgcttttccatgatttcacacacaagtacacatacccactccaataatctcccaacctactggatccaggcccagatttatctacatcccataatagcaatcgatttgcaaacagcaaggaaagcataaattactaggtagaaaccaacatggctttgtggagagcaaatggttgaatcaatttaatttccatccatgacagatggacagactttgcaggtaaggaggaagagatcaatgtcgtatatctgaatttcctaccccatactattcctcattgatgctacagaaagaaacgtggaagacatacaactgttaggcaacatgccctttcggactgatctgacactgttgtgttttgctcactcctcttccctccttgtaccctctccatttatctgtgtcatttgccccatattattatacacttacttgcgagttgctttgtaatcttcttttattggttctagcatttaagttttgtcgccccaactaaattgcatactcctaagcagaggcagagattctgtctacttcttttgtgtcctcctcagtgtgctgttcatggctgtgaatgcactaggcttgcagtaaacgccggaggaatggatggctcagctccagcagcctctttgcttgcctagaaaaggcaattttgaacttgataatgaatttcaacaaaatttgataggtggggcacaaatgacggctctgtcatgtactgccatatactgacaagtctcttcccccaaaccttgccattatacttgagccaagaaagtgatttggttaagcaggaaaatcatatgctggtttttttcatcggggttattctgtccttccaggtaagtgattaacatactgaaattgctgcttctactattaaatgcaagaacatcctgttagtttcttctcatataaaacctggttatttatttctgccctttgcctcatgcctgttagcttagatttaatgctgaaatcagaattttaccccttcatcccatttccttaattgtctttttggttttattctagaacagatttcatgagatcttggcaggcatatttagtgattcccacattttcctccaattgtttcctgatttttcaaaatgaaagtaaagaaactagaaatgaccattcttcatctggctcgagtctcctgaagacagtcagagagctgagaactctctgaaaatctctctcatctcccatgaagtcctcttattactttttctgaaatcaaggcaagattcagtgacttataaattaggagatcaatcttcttcgttctacattcctttaaaaaactggtacaatatgggccactttccaggcctggagtatgatagctacataaaaatgataaatcataactttttgctatagcatcagctatttttaccttgagttcctctgacaaatgtctctcagcattgatattacattccagtttaatttctcaagcgattctaacattttttaggaattcctacttatgtataatacacccactgaccagagcctccctatgttttactttccctccaaagctatctcactcttatgaaggtctagacatgcacccctcaaggtggctaatgccaagcttgtgatgacacctgagatagttaaagttgtcaattgttgcagcagtcgccttatttcaggagttgtagactctgcatgagccttagcatgtttagttacagcaacttcaaaatggtgccgcaaaactcttttccatcatctgttgctaaaatttgggtccagcagagaaaagaatgaaaagtctcttccattcgtaagaaactatccagctagaacaatggcatcccctgttaccacaacatcccacttgggaaactctattcttttctgctataaattactttttcttctcatttccaacaactgcagaccaacttcttcgattgaaaaaatatacttactaaaaaaaccacaagcatttgagggaaagctgaagtagaccctaaatttgaggcacacattggctttttgtaacaattccactttctaaaatgatctggtgtttactggcacacaatgacagactccttcatatgccaaagcccataccttctcatgaaataaagcagtgtatactgtgtctcagaaacataggagagggccctctcagtgagcaaatgatagagcatttacttttcagactgtaaattctaacactataatctactcttaactcttatgtcaccttatatcggtcacttaattccaactgctggaaaaggaagtaaccagggagtcgtggttggcagagaaaccaaaaatgaactgttattgtggttgacttcagagaaggaattattcagaccacatctaaaccccttccaattcaccacctaggtcaaattactctatacccaaaggttttatttaaccacttccatcactttgctcaacaccccccacctctctctctctctctctctctctctgtgtgtgtgtgtgtgtgtgtgtgtgtgtgtgtgtgtgtgtgtgtgtgtgtatttaatatgttacagtgaagcctggctctgtccctcactagtgacatgatcttgtacaaaattacttactcttaagagtcttggtgtctggatcttgaaaactgcaataatattatctaccttgtaaaatcattgcaagattctatcacattaagcaccaaaagcattgggtcagacacagtctacattatcagtaaataaaagatattaatattaagcatagagccacatttaaaatgattaatatatttaatggtttaaacatattaaaatgaaaaaattaatcatttttaatgtggctctatgcttaataacaactaacttttaggaagaaagggagaaaagggacataactaagttctgtccatcccaacacacgcatctgaaaatgactggtgggatgactaagcatggagaagtgtgtgcctacctgagaaatcctgtgtaaatgctttcacccctcattccccaaaagggaggagtccactgctcttcaaggctcttagcagctgtcatgctcaaaaggcagtagataccagccagttgatgaaaattaccttccagaaggctgaagtctttgaggaacaaggctgctaagagttgtgagctgcccagcatactgggtctggtgtctgggaaaaaaaattttttttttttttttgagacagagtcttgctctgtcacccaggctagagtgcagtagcactatcacagctcactgaagcctccacctcctgggttcaagccattcttgtgcttcagcctcccgagtagctaggactacaggcgcacaccaccacacccagctagtttttgtattttttggtagagacggggtttcaccatgttggtcaggctggtcttgaactcctggcctgaagcgatccgcctacctcggcctcccaaagtgctgggattacaggtgtgagccaccacacccagtttagtgtctggaaagattttgatgcagtagagaaaaagagaggagtttttggaggcagccaaccaaaaccagtcctccctcattctcttccacctctcattttatcttcctcgatctcaatctctattttccccattctttaagtgtgggtttcatgttccccattctttaagtgtgggttaaacatatgtttattcttctaaaaaaaaagtaatgaagttatttctaaattactatattttaaactcaatcagttccttcttctccaggttaaagattctccaggaacaagaaaaggttcacattcatgcacgacccttaccaacttttcaatcctttcgtccactccttttttaaaagcggtcaatctctcgtggctcttctaatatctaagcttacctaaggagtgagcagtttttcctatgacccaattttatggaagatcctaggacacataagtgatcaaacggcttgtccaaagttgcatagcaactattaaaacttatgttctctatatggacagcctattcagacacaatacttcttgaatcgttatgatgcaatcctaaaataatgcgaagctaaatgatttttcagtagtttaaatgtttctgggaaacttaccttcccctaacctccctcacccttcccaccattcaccaatacattcaaaatctttttcagaatctttttttaaacctttagctattttctatatctaagttggaagcaattattagtatcactgaactctatatactaattgacgttttaaagagaggccaattctataaatcaaatttgtctccattaagcaaaggaaattctaatgttttatggacaatctggtggaagctctgtaagatgtgtgttaaatatatatgacaataaataagtaatagcctgtaaagtatttcttactgagcactaactttctggagtagatacactgcaactatctgaggtagataaatcatcaaaactgtcaaattttttttgtaggtcattaatgtaaacatcatttaaatgtaaatcaattaagatttatgctcacgcctgtaaatcccagcacttttggaggctgaggcaggcagattacttgaggccaggagtttgagaccagcctggccaacgtggtgaaaccccgtctctaccaaaaaatacaaaaaagtagccaggtgcggtggcacacacctgtaatcccagctacttgagaggctgagacatgagaatcacttggacctgggaggtggaggttgcagtgagccaagatcggctcatgtattccaaacacctggtaatgtttggaacacagtaggtgctctgtaatgcttattaaatttatatttaatttacaataatgacctttaaatattgttttaaaaaaagtatactctatgccatgtagaagctcagaggctgcctgaagagacagaaatatacaaataaaaaaatacataaatcaagaggggacagatgattcttcctaggaaaggtgggcaagggcatatcataaaagatatcaaaagaaggtgaccttaggaacaatgccgtgaaaaaacgacctgatttcccacctttctaagacatatttcactcttttaccaagaagatctttataagacccaaaactgattaagctaaacatctgctaaaacctttacatatattctgaaaatagtatgccattcatggcaccttgatctggtccccatcagcacctgggtcatactttagcctttggactccttgtgtgtctcctgcatttgatgtctccaagtctgtgcataatgttcccccttttttctccctgaagtcccccagggtgaggtcatcccctttacatcctcaacaatatgacacgaagtctattattgccctatttagccttatagccctaatctttgggatagggcctggcacatttggttaagtcaaatgaacagaaaaccatcagtctataaactataaaagtgcacaagaaagaaagacaaagcataccgctctgtgtaaaatcatacagtagaagtcaaacagataaatttcttgtggcaagccagggaaacagacacacaattcccagggctaagtctctcagtctaatgtaaggctcaatcctacttcccaacttcctgaagaaatatttggaaacaagatagggtggataagacatactattttgagttagaaattattttttgtccatctcctataaagagaagaaatgtttgttgaaggtccatgtccctactttgcaagcactgaggcaagaaagttttaatgacctttatagataaactttctactcctagatgaaacttcttttaggaactctttttattctctgacaccatggcttgaggatcaacagaaaaagacaactggaaaagcataattttaatttataatgagtttggtgcaaagaaggagctgtacaaggtgagttttcaggtcccctgtggctctaaaattctatgattccataacaatatagcttttatatcaagggatatcagaggagtaaatgaaacccacaatgtaacctgttaacctacagatagcctcttgctagaactaaacttagtcatcctgtgataaagggcccttttgtcatagttctttgccttaagcaggtgaagaaatagcccattgtcaatgaaagaataccatgagattttttttaaggctcagaacagtctctttctttctctctaaaacattattaattgataatataataaaacagtatatttttacaattaaatatatagcatgccagaaacaagacgtaacaggtaagaaacaaaagcttgacggaaggaatacaaatgcatgtattttatagtagggaaataaaaaggtaaaacaaaaacatctatattattaagggtaatggagagcaaactattctccttgggccaaaccttcttctctcttcccctctctctgcccaaagttttctacctcactctttgcagtttactgtctcccatgactgattccttgggatttacagaacactagctttccataatcaagtttcctattacataatttggcttttttttttccagcacagttaaaacaccaggcagcttcagttttaatggaaggttgcttcattgctttgggtgacacaaaattatagttctacattattttattttctctctattagatgtgtattaaaataagacaacgaaagaacatgggaaaactgagtgttttccttgcctctcataagcatgtaaatgtttgggaaatggtttctctctctctctccctccttcattcttcgctcctgtgtgtgtgtgtgtgtgtgtatgtgtgtgtgtgtgtgtgtgtgtgtgtgtgtgtgtgtgtgtgtgtgcctgtgtctccctttatctcctgtctctctctgcttctgtctctctgtctcttttcaatagggcattaaattatttggagtccacttcactgcaaaacttaacttaacaagctgttcatgaaaagttttaactttatcactttgttaatggaatccctgatcttgtttgttgtttgtttgtttgtttttttagtgaatccgtactcctcctaaacccagttctgagcaataagagaaattagacctctctgaatattttggcagaaccaatataatatttgggagatgcagtttcctgcatattttaaactatttactatttcaagtatgaagacctatatcttcagatccctctttctgttgtttaacattgattttaaaatatacgtttgatttagcaaaacgcatagtttaaaaagatgttgctacacttaagatcttcatgataaagtaatttcattaaccaaagaaaactacagaacaagagagtagatatacgatatatcctgtttcattcctgaacatcccagttgttttatcattaagctttcttttaaagagccacttttttgcttaacaaggagattaggtacaaagagtcatatcccaaggattaaaataaggatttgttagcgctcaagactgaaatttgtccacagggaattaactgaaaaaataggccactgaaatttaaggtggaaaaaaaatcatattatcaaaaatcatatatcaaaaaaaatcaaagcaaatcattctaccacaggggactactaatgaatcccctgcaaatatgaaaccctgcacaaaaagtgttaaacctgccaacatctctgaccagagggctgtggtacttcattaagtagtaccaacccaccccccacaacaatgggaagctaggataatcatatctgacctttctgccctaacctaagattaagttcaatgacttcctactgatctagggattgagtgaaccaaaggtcataatcaggatcacctacagttcttgcttttgaaggctttaacctacagaatgcaaaaacaccgtactggtcattgtcaagattgctgactttctacagtgtgttttcaattaagtaaataaaatgtggtaattaaatcaagattgcataatatgtttttgatttgtaatcttatttaaattaattaactgactcaatccttgcttagtttttaaactggtcgagttagggaaagagtccctgggagcaaatccagttttctatctttaaaaacaaggcaaagcaatctggcatacttaaaaatatacattaaatgcaccagcataatataaatacagaggcaagggtgctaatgtagaggagggaagagttttatggcacgattttgactaaaagaaatagctctcgcactagagagaaataaactaaaacattatttattcaaaacatttcttttcgaattttatgaagattgcatatttgttggaagcaaaacatttccagctgtattttaagtttctgaagagggttgtaagatttataatctttcataaatgctgcccatatcttataatattagatgaacacgccactgcgtactttgaggaacaatttgccaacgcagtttgccacatgaaaataataaagtcctttccaaaacccagccagatccagtaggaaaagatgagatgaatgttctttcttttccatctgggagacattttggatttcagctatactatgtaatatacattttttccccttggaaaccaagaaacctgcattttacaacaaggtatgtagtgcaaagaaaatgctggtgaaataagaatctgaaaatgaaaaccagaatgtcatcagactcaagaacataatcatgaaggcaaatcgaaaaatcaatgcagaatttcaacataaaacaaatgcaatgtttatgatcctattagtcttaaatttttctcttaaaaggaaagcatagaaaaataagtgctgttttacctccaaagtcctgaacagcatttatgttactacctagcaccatgacttacatatctggtttatcctggagtcttcacgcattattctaaatcccacacatacaacactcctgtgtacacatggcccctctgtgctatgtcacttcatgtattttcccaacacttaatatatctaggttaaaatcagacataagactttctaatatttcattggcaatctttcttctcagggagcaggacatgttctctccaaactgcctggagagtcaggactctgggctctatccggcaactgccaagcactagcacgctgactctaagcaaaccatttcacgcacgaatcagttttcatcttgcccagtggcaactagttaatgaaaggtaagagtttagtcttagttgttttcaaaggaattagaaatactaggaaaaaaataatttcacacaacagtgaaatatgcacaagtatttttgtggaaaaaggctatgagatatatatatttaatgttctttaaggtttaattagtactcctcctccccctcctaaaaaaaaaaaaatccccacctacttggttgcactgccccttgcaaacgctgacaacacaggtaattgaagggctgggttagagtgcaactcttctgctacattttaaaacccatggggtcaagaaacatgttagtcttattcactgccctagcatattcctggcacatactagatgctcaatcagtatgtgttgaatgactaaccactgttttacagagaacaagatgatgactggtagcagttaaaacagttcatcttccttaaattacaaacaaactgccagtaataccaatcataactttcagtttttgattattatctacacatattctaatttttaagtttctacaacctctctacaaatacaaatgtagtgattgactcaatgaccaaaaagtcatattcttattttttcattgctcattttttcataggcatatgttcctaaaaaattttttaaattggatacagatttctctatcatgttagctaaaaagatactttgccaaatcattaaaatgtttatgtttatatccttatgtgagcttagagagaagaaactggatgggttttttatatcttatgttacttacatgtgattaataaccagtccttgttttattattaaattatggctcttaagtctgtgatactatattcatataaaaataaatgtatacatttaaactcaagatgcatagcaattaactggataacagagtaagatgatgcatagcctactttctacaaaggtaaagtagatttgtacgtggggtattcattactgcttctgttcataaaataactttatcaaaatattagaggaaaaaaatcagataagtcatctgatgaacaggaagcttgctgatgtggcagataatagtattaaatgtcctaacagttccttgataagtggttcaaagaacttctgtccccatgttttcaaggcaaaagttaatataccaggaataaaactacttgaataatgcatcattgaaccaacatttttgaaaagggataaaatgaggaaacaaatgaggagacagtaatttcctcttgcaaattaaaactgtgcaggcaaagaaaggaactcaattatactgataaaataaaaacaaaaaaatagctgacatgattttcctttttgtaaaaagagaaggtcaagaatattctaataagtgaaataatgggtttgaaagaactttgaaaagtttacaagctcacagagacatgaagatggggcattttatggggcaatattctttcaaacagtcacttaaagagaacagtttaaaatacagataatcctggccaggcacggtggcatatgcctttaatcccaacactatgggaggctgaggtgggtggataacctgaggtcaggagttcaagaccagcctggccaacataatgaaattccatctctactaaaaatacaataattagctgggcgtagtggtgggtgcctgtagtcccagctacttgggaggctgaagtgggaggatcacctgaggtcaggagttcgagaccagcctggccaacatggtgaaactccacctctactaaaaatacaataattagctgggcatagcggtgggtgcctatagtcccaactactcgagaggctaaggtgggaggatcatctgagccctggaggttgaggctgcagtgagctgagattacatcactgcactccagcctcggtgacagagtgagcccctatcttgaaaaaaataaacaaaaataaaaaaaatacagataattctaaccaagaataataaagaataacagaagcccaccatgaaatctactactcatcactatggttatttgggaaatgggaaaataaatgatgacgggcatgttcacttgctatatccattttaaaaaagggaactgagagtatactggtgcagagctatgtaccaggtgctcaaaattcctcccattttgtcttgttactcattttatctttaatagagattcaaatcaattccttatgattcaaaaatgcctaagccaaatccaaagagtatgaaaaaatcaaggttctgcataatgtcccatccatatgccttaaccctgaatgatatcaaacctatgtaatcttagacatcaatgccttccagatgtgacaaaattttaacacagaccaacttcaagctttttactgcagactcatctcccatgctcataaagattattttcattgcacgtaccattacatatggctaatgtttaattttccaaattgattattatgctgccatttcaaaactgacattgccttccaatccaatcaaaaaacaaactatgctgcatactcaacctccaacaaacacatacacaaaaacaagaaatcacatcattatttccaagttctagatagtgcttggttacaagaccagttgaacttttccttgtccactcttggtacctccaaaagatggaaaaggggaaggagggatcatccaattctttgtcagagttaattgccataggaataatttgagcctgtcacctgttgtttttggtcttaaagattgcttctaatcagacaagatcaaattcttcttgacatttaaagcatgttaaaattctaaaattaactaacaagattgttcatggatattttgcaaaaccatctaacagcaaggccatgacagaaatgtataaactaaattttcagataggatttaaaaaattagtaactcaacaccagtaagaaaaactggtgtgataaagctttggatgatattatgcaaacttaattcccctgccccaaacaattgctttgaatcttacctaaatctcatccctccacccacccccaaaattagaattgccctgtaacggtaacttgtcctcagatccatcctgaactctgtttctgcaaaccacctttcccagctccattaactattgacttcaggctaggtccaaccaacaggaggcaatggtaggagtttgggaatttggagggtgggaagaaaggagaaggagaggtattccttccctcctctgctttgacatttgtctccaaacagtggtgagttttcctcttgtgattcttgcttccactgaacaagttcctccctctgtgatgccctcccttcaggcagctccagctcaatttgtgtagtagattcctactgatgctaatgactgggtgacctcactgcccattcagcttttcatctattctaacattactgtaactggccttgcccatgaaattcctcctattggactatctggtagtttattttactcaaatctgacagatacatttgtttttttgaatttggcatatctgtcactctaaaatacgtgtcaggtaatagaattaagcagtattagacaaatataataacttttttaaaaaccaatagatttcacgtgtttgttatgattctcatcttttaaaaaaaagatgagaaagcactgccaccattcagtactaagtacaaaattctgtatcccaaagttttttgtaatgcatactgatacataaaaataatcaagtttttaaaaaaggcaactagatgctcaatgccatgttctaaatatatctcttccaggaggtcttctgataatcctacccatccatccaagtttacttcttctttttatcatctcctagtctctctaaccaatttttaacaagttttttcttgtgcatgtgtttttccttcacacatgactgtatgctccttgactggaacaattataagtttgattatttttgtaaaatatgatacatttacttatatttcatgccacaaacaacttcgaaatgcttatcaattgtcggaataactaacagtctcatggggataatcaaaaggttttcttaaatatgcaccactatacatcaacgtaagaataatccctaacaggaaagagaaatgacttcaacattactctgtttcctttaggaaatggttcataagtccccactggacatgaggcattttacataagaaaaattacaaaataagacaaaagtatttttcccatcagaatagtaacactctatagtgttttgctaaaacactctacgaacaggagaaaacaaaaatatttatgttcatacgcacagggatatatatgaactcacagtaccaaaactttagaatcacatatgcaaacagtaccaatatacttaatgttttaaactgtgctagataacagcccggctagaggcaagtgacataacggaaaaacatacagcatcaattcacatgttgccaactttttttggatagaactaacaggatgacactggtgatggatgtgcacacttagctgccagcattgcaccctatgcaatgtccctctacatcctctctctcaatcattttgaacccccacccccaagatttattttatgtctctttttaaaacattattttcctagttggtgacagtcaccaccaaacatcatacagagatcatttcaactgaaaatacatgtttattattttttaagcctgtgcctgaaatgtattttagtcaatctatgccacataaggcaaacttctaatgcacatttatgaatttaattcaataaatatttactgaaaaaagaaaatgggttggagtctaaatagacataaagtggccatgaagtaagtctagcaataactttcactttttatgttttcccaccaccctttactttccccaatgagaaacttatagtgtgacaggtaagctaagagacaatctccataaatatgacagcagacatattgcacagacactaaaaaccataggaataatgctgagaccacaagacagaaatagcccttgactttttctcgtaatggcaggtagaatgggtgggacagggagcctaaagccagataggaaaacgaatccaacttttaaccaaattttttattacacacatactatttgaaacttaaactttcattctaagttacagtcaaaaaagaaaaaagacaataagaagaaataaaaattatcccagttcttccaatgtactgtatatgtatatgctatgatttaagaattatgccataggaatagataattcaattaaagccaagataaaacaaatgagatacattatactaagcagatagcaaattatgatataatttggctgagaaataggttgaaacaggcactatcttagaaatgggatgacagcaaagaactaagctccaccttcaatgtatttgaaggtctgtttggagccaatttacacaaaatatccacttaccaatttcacagaagatagaacaaaataacactgagataacgtattaggaaattattttttaatattggaggtgcactctaccacctcaatccagcacacattctctctctctctctctttcacaaaagagaaagagatcccgtaagcttctccacaatgttctatacctgaccctggaaggaaatcctattcttctaggcttgcttaagccaataaggtccccagagaatgctaactggggtggttatgtgcccaagaattgaactgaaaccattaatttacttcataggaccaatcaactggcaaaagaagttaaaaaaaaacaaaaaacaaaaaacttttggtagaactgacctacagagaatttaaaccgccagagatggcaaggtttgatgttacagcttccttcatccatctgcaaagctctgtcactacctaataaatgcacaatgcttctctctcctgtggtgcttttaggaaataatgcttgtcattttccatcttattgacaaaatattgtattttttagaaaactccatatctaaggaatactttaatgaaataaagatgggttaaaacatcaagctaattttgtgagcacacgaaacagagaaataatctcaaagaaaatgataaattctaatttttatttgaaagtataaagcacatatgagacgacttttattgtgttgccacttcattcttgtttatttaggtttctttattcactgtcgatataaatgactgcagtgaagccaggattgcagaccaaatctgaatttggaagtttggctacagcaatctggatcccaaagccaaagcttcctcctcacattagactcccattcaaagctatcactgtgttttcaaagtgacaacactgttcaactttcttttcacagagcaggaatcttttatggcattaagggtatgtatgtcacaccatgaaaaacacaatgacattgcaaacatagacaaaggaatctagtaagggcattgggaggaaaaagggggtggggtatttaagaaaatgttttttaaacttttttttttgcaaaagaaaatgcataataataaaataataactgaaagttccctattaatatcatccagcaattattaaaaatagaataaattagctgatatgatccaatcacctggtagggaacagcatgtgtctccttagtccattggcagtgctaatggtgctcctaaatgaaggattttttttttctatgttcacgctggttgaacttaattttccgttcacctgtttacctggattagttttcagcttaacattcattaagcatcaagacataacaagaggtgcagtgatgatgagataaaagtctcaaggccattactcctcccatgaggcactcagggaggatctataagtgaaagatagcttcactcgcttgggttaaagtgaaaaaatatgaacccactctagaactttgaaaatcaaagagagctttaaaaagccgtgtgtttatgttttgcctaatttttcactttttctcattagaaggcaaggtctgactaaatgtgggttatttctgatatctcagcttctagtttgcggaagggggttcctgtttaagggagggaatgctgccaccccctactctccccagcagcagcacactggacacctgagaagccaaaagcgctacaccaaaatataccacctttaatcacaaatcaaacaacagtaattaggagcatcaagttaattgtgtctactccccacagaatgtgtcctccaaggctccttgaaatcaggttgaaagattagtagtaattttactcccaattctcttattctaacttaaaaaaaaaaaaaaaaacagagcctaagttcatcactcctaccctcagaactatggagtctacaagtaaaaccttaaaaagaaaaatcagactacttaattaagtgttttcttaggccgtttatgtaatcagagtaactttgatctttggcttcttaatctgttcaaaatttgttgtcaaatcgtatggaattcctttaaatccagaattataaatgttattttccatttgtcttttattaatgattaagacaacttggcagtttgaatccaatcaatcaagaatgtgcaaaatccatttcatatacattggtacaattagatactgacaataaggctctttcttaccttccatttgtactaaatatgataaagatagcaagaataccttagctattttcgaggcattttcatctacattactttgcaatcccgaaataggttgtgctttattctgaccctttacaattaccagaaaggaatgcagagcttgacaacttgcagagtaatagaaaaaccttgatttttcattgcatttccccttctgactttcttaggatctgagggacgacccttaacctttctcagtctcactctcctgtctcaaacaagctataataaaactttattccagtccactggggtattagaacaatgaatctgataggatgtccctaacacactgtactgtgatctctatagggaaagttgctataaaaataaagacactgttgttattcttccaattgagttatttgcaaatggatcttcttgatggagcccagccctccgatatagaaaagaaaattctatcagtcctctagggtacaattgccttgtggcaattatacccataaccacatttccttattactatttataaaagactgtggagttcaaggggaggcaaaaagggagcttaagaaaaaatatgctgtttattttcaacagaagatgctgaagttgcaaatttggaactcaaggctataggtaaactttgacagaacatgtgttccaaattagtgtggtgtttcttagctgtgtcagaaagtcagaggtgtccctgaggctgcagcgctttagcaaattttggaaataacttggggaaaaaaaaggtaaattacacagttaatctggtcctcactctacgaatgctacaaaacaatgacgaaaaggttcacggctagaccattctcaccaagaaagacagcatatctcgaggtacaaaaggcacaaaagaaaattaaactgagcttaggaagaaagtgctatggacaattttacatgaaaagccaaaagggaatgttggggctacgttgaactttcctggagtctacagacagaatacacgttgccccctatattcattaccaacagccataagaattagtaggtggctcaggtttaggcactttaagaattccatattcctcaaatggaattttttcaaagtaaataataaaagctttgctttatgaagtattagagaaatggggtttcccttccataacagaaatcactaggcccatcacactgcacgtctccaaggagcatgattcacagtgtgggctacggggagggagccttctaaagtcgtttcggatgttcactatggcattctacgtgtcattaaaaaagccttataaatcatcctaaaatttagagtttaaacctggaacaattacttggataaagtttcttatgttaacaggtttttaaaagttcaattttcagaaaagtgtttgttgtcagtggagatctgcatataatctagattccaattaaacacagagctccaaaaagaccaattaaaggagaagtagaacagcttgccgtatcatgacaataaatgctacttgccttattgtcatttcacaatcagtgacattcagtccacaaattctagtgagcatcagattcacctgagatgcttgttagaaattcagattcctcgacctcacccgcaatgactgggactcgtacagcaatgctggggccaagaaagcgctctcaacaagcaccccaggtaactcccgcacattgttctcagccagtgtacaagggacttggctgctgatgcttgctcacagacaccaaactggaaagcaaaaggcagtatgtgactatagagtcctgaaaacacaaacaaacaaaaatgcagtccttaagccaaaaccaatctccacttttctccctctccctgccatgtgatgcaccagctttggccaaaaatcacatgtgtacagtgaatcctaaaaagcaactaaatccaaatccacactgaaccattctgaactctatcacacttcacagagctttaaatagaattctactcaaaacatcacaccctgactggccaagggattctttgggttctgttgctttatccaagtgatccaaagtgacccaggttccattctgcaagttcgcttctacagctttttccaagtcgaacacagaaggattaaaaagaaaacacaaatattggcataggtgacttgaggttacttgacctttctgaaggaagattttttggcaattgtgttctggcagctccctggaaggcaaggccaggacacaaagaggaagacaggaagccgggagctggccatgtgtccttggcaggcagtagtgcggcagggtgaaccacctcatccctgccaaaccagaaacagtggggaaagcccagctaattggcaactcacagccggctacagtgtacatcctcggctttagatgcctgataaagttaaatggcctgccagaccctaatctacttaaacaggatcctcctttactttcaaaaacttaactcacccatttgtgtttccttaaggaagtggtaaggcagcatcttagaatgttaagagctggaaaaattaaaaacaaaacagcaaaaaaagtaaagatgtgttggagtctcattatgcttatagccgttttactttgtgaaagggccatgtatgtttgtgcttttggttttagctaataagacttccacttggtcatttatttttatttaaaagaaattctcaagtcaacattgcagactgattatgacttcagttcattggaggatccaggatccattttttttttaatttcacaaaactcctgaagatatccaaggagactgcagagttgcacccagtttccactcagctattgtttttacttacacattagttggctcaatcatatttgctaaggtatttctgtatgtactagcataaaatcaccactttctgagtcttttacagctaaaatagggaatcacgcagggagaacaggagcagaagggattgtccaaataaactgttccttactgctgctgctaacagagtgaatccagggacctggagcctggagcataattttgcccctaggtctgaaggcctggtaagagcaatttaaaggggtgtgctcagtagttgggcatatttccttctattttctgtgaaactgttcatgccttcttcaaaactcaaagcaaaatttcaaattagcttctcctccttaaaatatagtagtcaatggtgaaatttgatgaagaaaatgcaaatttcctctcagaactggtagaagagaaagattacaataaacataatccactgttttcatcagaagtttcttaaagtctacagaatattcatcctttaagcaacccaggaccccagaatctgtttcagtgaagttagaccaaggaataaaacacaataccaaaactcacatactctctgatcacgatgtgagataagaaaataataatcctcatgcccaacactagctctcaggatcggtaagtctaagtatgtgtttcagctccaaaattactattttttttaaaacacgacttgactttcccagactctacttagttgacttttcacactaagtatccctagcttttggaaattctccttcccttttcctttagggcaccactcctttcttaggtccaatcctctatttctgagggctgctttcctgtcttgatggctatctccttctcttctgttggtcccttatatgttggtgatcccaaagacgatccatccaacttggccatcttcttgtctttgtacattccccctcagcaaactcagctaggtccatgtttacaaatactacccgttttttgagaactctgtatctccatatctagccctaacctcttctttaactgcaaaactcctcctgatgttgctagtgcacaacctttgtacactcttgcctccccgcaaccaatccatatctcaattaatggcattcacagccattcagtttcccaagctgaaaatgctcattccagaaaccccaactccccaaagcttcacattcagttgtcagcccagactctatcttcctttcaagcctatttccccatctccatcccaactggtgctaagtcccttattgagcttcacatttttacctcacaatagcctcagcctcctcaggccattatgattcactcttcacactataaccagactccatcctctgcatagccaccaggaatcacaacacttcactccttaaaacaccttggtggcttccaattgctagctaggataatctacaacctccttagtacagcattcaaggtgctccataacctggccccagcctagcctcactctcacagaaaccatcaccctttaccctccccctcacacccacacccaacttcctaatattcttcttaacagtcctagaatatgccgtgcaactgcaggtctgtgcccttgctcataaggtttctatgcctggaatatcccttatttgatgcaagacaaacgcctaattcatctttaaaagctcttgaatttcgtctgttacaaccttcctgaaccttattgccccatctaatgagaccaccctctggggcccacatggtcttgctcacactttagtgcagggcccgaccagtgcattatagttggttgtttatacattacttctctccaagattgtgacctcctgtatcccaacttaccctgaataattttgggaatctatttaaatggcatacaaatttatcttggatgtactatccatgaagaaactgagacaaagagcattaattcccaaaagaaagacaaagtaaccttaaaaaaaaaaagtcataatgagctatcaatttatacaggtaattaacattcaatattctgattgtgacatatacagatgatatttatccattcgtttatttttttgaaaaggactgaacacctacagtggtccatgtatcatccttggaactcagtctacaacagtcaataaaagatgatttgttcttgtcttcatggagcttatggtttcatttgcacaatgttgactttcattcacttgctagcaggtaaaatgtgctctctatacaatttacaaataagcagaatctgtaatcattatattttgaagataaaattgatacttttcacacacacacacacacacacacacacacacacacaaagatttagcagtgggacaaactttttcatttaatttttgtttatagcaactaaaacatgagagactaaaagccacagactgcaaaagcattgtttagctgtgataagcagaatgtgtaaaggtggtatgatggcacaacagctattgcagcatgaaataatgagactataaaataatgagaccacagttttaaaattctccgacttccattatctttcagaatagatgaaaggggtctactgactagttcgggagctgaagagtcaaatactattttaggatgaaaattactttgtggtcacatcccattatagaatattgatggagccacactacatgaaagtctcaaaaggagtactgagagaaaacatcgttaagaattggttttctgctactcaaacccatcctcaagaaaaaacaaaagctaatttaaaaaaatcatcaccaaagcaaagtttctaaatggaatgacataaaaatatcggttctacgtttcttgtcttttagaaaaacgacccatatgtgtagtattttatatggttttctctaacgtatctgagaaatgggtaagcaaatctatgcaaagagatatcatggattgtgatgtcatatttcttatgaaaaaaatcaccttcacaatgtcaattaataccaaatttagctttacaactccatgaactctaccattttttaggttagctgaaaacgatctattgactagctttgtgagctgaacagttgaatgctacttacatagaaaattatttctttcactccataagaataattatcatggcgatcacacaattattacaattacatctgtaagaactgttactgggaatttatctctgaaacagtctcatgccttgcaggggacatttatctttttgaatgatcatcaacacgagtgtctttttgtagctatataagtgatttttacctccttctattaatatcctcttgcatgctttagaagccaaaggagacagcccccacattttttttttcctaaagcaattgtttcagttaagccaggcccatggcatcttttgagacagaaagctaccctttccattcacggcaacataacattcacaatgtgctttcctaaatggatggaaaacccctcaaaaaagcccctcaaatctgtgtttcataaactgtactcttagcaataaagtttattacagacctaaagtatctgcataaacccggttaattgaaaagtgggtggagaaggctgccaaattaaatgtttacattagcacagctgtattgtaaaaacattctgccccctgtgctttgtaattataagatatttctggactgtgtatctctacaaagtttatctccactgccaagagtgtcttggcacggagcgactgcagtttttggcagccaggagctctccgcgcgggcaggatctaaaatggctgccaagcggcctcctgaaatgtcgccggcctgggcccgcctcaccaagggcaaaggccaaccctgctaccaaggcagggtctaaagtctgtctcacaggaagtcaaaatgtgtatttccctcataaataagacttggtaccacaacttttgtgttgcagtagttaaagctgcttgaaaaactaactacaaaggaatattggaatactaccagatagaaaatggtgacaaggggtcttttacgaaattctgctgacctcaacatttcaatcacacataatgcccgcaatattttctgctgattaaagaaactcatttaatttgtggggaaaaaaaaatgttaaaaaaaacctcaacaaattctgaccatattaaaacatactacagagaagcataagcaaagccaacactttcccatttgcaatggcatgattttgacataaacttataatctctatcaaagcatacgtgtatgaaaaatgaaaaccaaaaaattaatttgttttcttctcatcctttaacaggctatgtttgtcttacaacattaaaataacattaacaaaagaaaaccttttcatacctttctatggcacaggcctcaaaatttgaggaatgatctctcttttcccgccgtccactgcccaagatgtggaaaggaaagaaggccaaggggaagaaggtggctccggcccctgctgtcttgaagaagcaggaggccaagaaagtggtcaaccccctgtttgagaaaaggcctaagaattttggcattagacaggacatccagcccaaaagagacctcgcccgctttgtgaaatggccccgctatagcaggttgcagcggcagagagtcatcctctataagcgactgaaaatgcctcctgcgattaaccagttcacccaggacctggaccaccaaacagctactcagctgcttaagctgccccacaagtacagaccagagacaaagcaagagaagaagcagaggctgttggcccgggcggagaagaaagcgccggcaaaggggacctccccactaagaacacctgtccttcaagcaggagttaacaccatcaccaccttggtgtagaataagaaagctcagttggtggtgattgcatacaacatggatcccatcgagctggttgtgttcctgcctgccctgtgtcgtaaaatgggggtcccttactgcaatatcaaggggaagacaagactgggacatctaatccacaggaagacctgcaccactgctgccttcatacaggttaactcagaagacaaaggggctttggttaagctggtggtagctatcagaaccaattacaacgacagagccaatgagatccgtcatcactggggaggcaatgtcctgggtcccaagcctgtggcttacattgccaagctcaaaaggcaaaagctaaagaacttgccaccaaactgggttaaatgtacactgttgagttttctgtacataaaaataatacaaatttcccttcaaaaaacatctgaggaattaactatgtctgtggcataaaactgaaaaaaaccgagatcagatacatagtctctgtgagtgagttccaagggctgaccaaaggaacaaaaattggaaggaagggaggggaggggagggggaaaaaagaagggaggaaggaagggggagggaaagcagggtgggagggagggaaagaagaaaggaaggggaatgaaaacgtgggagggaggaaatgatggagacactgcatggaactaaaaatacatactgatttgttcatagtaggaatataaaaaacacttgaagaattaaaaatacttcataagtacaccttcataagtacgatatatacacaaggtatatattgtctctgtcctttttttctctgttaaacttaaatcccagctaacaggctatgttcacagcagccaaatactgcataatgaggtcagtggatttttctttgagactgttccgcaagtttaagctcaggttgagagacacattaggcctggtgtactcctgtaatcatcattggcagtgattactgtttggtaatctaagcttcaactgaatccaacattcttgcctctgctgaaagataattcagaggtgaaagatgaattccataatgctgacacaaactggtggtattcatcatagtgcttattcactgaatgcccattctagcttgaattatatgtccacacactcagcagagccacaccaatattgtttacttaatttttttaagtctccattttaggagaagaaaatctaatgtctctttaatcgtatattttgaataatgtctattctccagtagtcacctgaaaaacacacacacacacacacacacacacttttcctggacctttttacagcagaataatttctcagcattattaattatgtttctgcgtaaaagacatttagggacttttatcctttgtttaattagttatcaaaataatcagtcacacagctatttaataatgggccactcttaacagacaggtgaaacagagtggttgtgttcaaaaaatatttctagttcactagtaacttactaactctctctctcttttttttttttttcttctttgagatggaatctcactctgccactcaggtgcagtggtatgatctcggctcactcgcaacctccgcctcccaaggttcaaacaatcctcccacctcggcctcttgagtatctaggaccacagatgcacctggctaatttttttgtatttttggtagagacagggtttcaccatgctgcccaggctggtctcaaactcctgagctcaagcaatcttcctgcctcggcctcgcaaactgctgggattacaggtgtgagccaagcacctggcccttactaacactcttaaaacttgagctaatttctttcctttcatgagattttatggtctgacactgctgacttattaccttttcttccttgagagtttccaaatactaaaacaacaatctgctcaacaaacagaagaattcgataaatgttgattgaccatctagtacctgcaaagagaccctatgctatcatatacagagttatgagattcagacaacatgctttacaaaaaaaaaaaaaaaaaaaaaaaaaacctaagggatggtttcagattttgcctgtgtcttagtttcagtcatgtttggtatatattgccaagtagctatattttatatccccaactagaatacaagtttttggagatcatgctctatgtcttactgactgcacaagacagtgcaacgcatataaaattgtcacctacaaatgaaaggattccagtgaggctaaatggtgattagctgtgtaaaaccccactattccatacattgtatgtgcttacaatgttagcttatcctcctcttagcagcaaatatcttctaggtgaacagtaataaaataatagtaaggctaacagtcattgagtatttgtttacatgtccaatactgttctcaatattacggtatccatagatttcgtccttgcgataacactaagggatgctattattattcccattttcagatgagaaaacttgcctaaggctatccaactaataactgaaaaagccaggaattaaacccaagccaaactgaccccagaatccaaactaaattactgtcttcccaaattagaggtgtcaccactggacagaaaaagagatacagtccaggtagaggttgcacctctgcaattacagggctccttagtcaattttttctaatttttgacacataccttcccaattttcctggcaaaagcctcccttgagtggaggccactgactgtggggagtttatgttgtggtttggtaatgtgtacaaactgggaggaggatgagaccagaaaaccccttttgcccatagcatgccacaaattgaggactaagtcagtgcatgctgctgacaggcaaagggccagctcggcatgagcagctccgtgcagggactgcatgtgacaccagacaccattttcaaagccactaccttcctccttccccacaaacctcttcatctcccaccaaagtcctgaagcttcaccacaggatcaagtaatccccctctaagccacatctcgtaaatgagagtctaatttctcccacgtgtcatttttcacatgaatgttactacggtcttggctgtacttaaccagagttcaaggtctgatggtttatctacagagacaacatgaccacagagaagagcccgtttccattgccacctgaaagacagatccaccaacacaatgttcaccactttctcacacagggctaaatgagactcaaggaaagagcccaaggtcaaacatttccttggttgaatttaggtggtgggttcccatacagagcacagcaccatcagattcacaaggccaaatgcctcagcatgatgacttgaaaagatgacaagctgcacacaatgttcaaaatctaaattcaaaggtcacttcccactccctaaatagttttataccccaaaagtcattttagaatcatctttccacttttattccatatttgtaatctgattttaatgacctcagggtaggccatttttttaaactccagacaggttctaattcatctatacaacaaagcaatacgtggtgttaaaaaaaagactaagagagtaaatcgatacgtgttcagtgtagtggcagtttagattttttttctttcaattggcaatccttccgacatcaaggttaaattgtactaaaaaagaaaaaaattacacctcattccaaatttgctaattcaagaagaactgaattattctcacgtctacttgtggcaaaacaagaaattactttatgtctcaaatgtgagtatgaattacgactaaattcataaaaacagacgtgacttaagtttttattttactactttgaagttgtaatgtgttcattttcctggtatttttacttaaaagagcttttttttttttttccttaaggactcttcacaagtacttttgatagagtggtataaaattatcctattccaatgaccataatatgaaaatcattttgccaaaaaacatcctggaagtttccctcattttaggtacttgggattattctcataaactgaggaccattcaacaatgttttgaagatatacagtattctattcagaggacaaagcatatattcaaaaaaatgcaaaaatattcatcttttctcaaacaactccagtattaaattcatctagacccactgattcactcagtcttttttttaagtttagtttccaatatgatattatttctgccctcatctcttccttgcaacaccccacccataagggaaaagaagaaacagtcagagatgaaagaacaacaaaaatgtacacaaaaatgaaatgttttctgataagtagcatgtcagagtaaacaagttatttttttccactatcactttcttacatgatctacagcaaaattatgttgcctctgtcttatgaatcatcaatacatcacagcccagcctttttcatatatagtgggaaaaatgctgcagattataactactgtttctgacatggagatatttttaattcatttttatgacatgcttatgttcttttcatcactgaataattgctcgtttccaatactaagctggtatttctttaaagttcacgtaattgcactactggtaactttaggatttggaaggaaaaggatcacaatcgataagcaaatgcaatgacgggcactgacaaagactcaacatttattagaaggcaattgctagagaatgtggctttaattgtgcatacatatttttattcattaagatgaataaccaataaaatcccacactatggtgtcccagcctcataacacattaataaagtttcttaaaggttttggcagggggccagcacagtccattaactctttgcaagttgtaaaaagaagtaaagtcatttcagtttgttttgtggttatgaatgaaacagcaggcagcctgtatggaaacgtcactttggatatggtattggtaatggacgctttgctgcgcaatcagaacagtgtggggagaagttaatgcatcctaccacaacccaagcccagacgcactgaaaagctaatttacttaaaagtggagggaaaagagcagaggactacaagtttggaagatctatttattttgctaataggctgtcacactgcctctgggtaaacttgcccactgtgaaacccaaaagtacaggatacattttaaatgactagaactgcttttcctgattatttttttttttcctaaaaaaaacctggttgcttaggcattcacttggtgagggctggatcataaattacaaaaatgctttttatttaatacaagaagcaaaattctatcctttctacgtttttgttttacatacttgaattaagtcatataaataactacaacaattggtagctatgtatttgtctccgactttgcctaacaatttgaattgaagcgctacacatctccccaaagctttacaatgccatctgttctcatttttcatgacactacaaacattttcctttggaaaaaggattctgtattttgcttcctttttagaatgaaaactggaaaacttgaatgaaactaaatatatagagaggcatccaagttgtacgtgtaaagtagtaaatgtagagggtatttaaaacattttttgtggttaagatctctacccttttcatctgttccactctagagataaaagttcttttttactttaagatttttgcaaaaaataattcaaaactttaaaaataacgaaaaatgaacttaaaaagtgattaaaacccttgagtttgagaacaccaaaaaaaacagaattgctttacaaattgtttttggcacttcacttacgaagaaaatacgctaaaatgtaagtatacatacacacatgtgcacactcacacaaacacacacccacacccctccattaatccctaaccaaatataaatagcatcgttagtcaattacttctgatggttaaaaccacaaattggttacaatgatctgtcactttatatggccaaataataaaacttcaagcagaagagatgattactataagtacaatagaaaacatcattcactgttttaatttgttttgaatttttactggaaaaaaacagaaagaaaatttttaactttcaaatgtaaacattcatcactgagtcctaaaaaaacttcccatttcaaatttcatttgtgtcagtgctaatatgtatcaaaatagccgcatctcttgtacactgtggattttctgggaagttactcacctttgattataggaaagtaaaggaaagtctaattaataggttgaaaccgtactgaatttctgcttctctgtatacatgatcatttttgtctctgtttggactgaaagccagatactcaacaatcattccctaaaaatttaaagtattaattacatacatgtatttgtacaatgttaagtatcactgcaacctggaaaaacttgcggtaaaattaaaatttttcatttcaaaacaacagtgctcttagcttaatcctctacaatattgtattcaaaaatagtttttctgtgtgattaacagtaatattacctgggctatttttaaaatctggaattagaattcaattttaaaaactgcactcaaaaaacatcctggattcagatatgaatggacctgggaagtttcttaaaagaaatacattttatcctagatcgatagtaagaaacagcaaggaaatgcacagaaacaggatatagggaatacataaattgggtctacactggttaagaaacaaagttaaaaaaataattctactcactttaaaatgacactgtgctgaaaaataatgagaatagataaaagctttgaccactcccattgtctaccttaaaaaaatactagtatagttactcaaggcacggaactggacaaactgcaatttgaatccagaagacagaatccagagccagggacaaaacaagtcaaaggagttggtgaccagggcaatggccagaagtttacccgtttatatcagattctgtgccatccaccctgcggggccgtctgagctgtgcttccccagctggtgggcccctccacgtcagccctctcgtagactccaaaaggaaatcagagttgaacagtatagcatattgttattaaaagtgatttgagttgtgacatgaatattgtactttcaataaaggaggtatacactttagaaagctcttcagcctctagaaagaatagacatttaaaagattaaagcgtttaaagaatgatctctccactgaccagaatacccacatcaaaataatgtaccactgggttttattggtagctgcaatttagcccatatgaaatggaatatggccttagtgttaatgcaaatacgttgccatttatcataaaataagtgtcatctctaaaggtaactggactttccttaaaaatgaaccattctaacatgaaagaggcataaattaataaatccctgagaaagcctagcctacggctgtaaggaacatctaactgcttaactgggcaaccaaaagactcatacaaataattagaatacttatttccaattgatgaaagcaaaactactccaattcacattaaggttgatgagtcacataaaccactcactgacttaattttacttagaaattgctcatgcacttttgttgctttcctggaaggttatacaaatgattatatactcatttaattattaaactgaatgatctccttaagggcaacattaaacatactaaagtacagtacaccatgtcacaatgtgcttaagtatccctactaaaaataaaaattaaaacaaggttagaaaacaactaacaactaggttaaattcaatccaaaatatagatttgggaatttctaataaaattgtccatattgtttgaatgggttcaccactgagtaatagtgtgaataatttaggtaatcatctcaaaaggttataattcctctgggaaaaaaaaaaaacatgtttaaaactctacacttacaatatttcacataatataattaataaatgtttgctagatgattggatttaagttatatgataaaaaaatactgctcacacttataatgctttaaatgctttacaacttacaaaacactttcacataagccaccttacgctaacaactgtgttaggtagatattactatccccatttcatagataaggaaattgaggctcacagagattaaatgttttacccaaggtcatagccctagtaaattcactgcttagagaataattagcttaagttaagataacagctacttcctgcttccccattccagtctcagagacacacaaacacaatatgcatcacatataaaatgtgataaaatcaaaaattatacatcaatcatgtttatgcactacattatttgcctatttccattcgtatttttgtaagcgctgtttctgaaaggtaatatagcatataattacacctttctttttaaaatgctatgataatcttctcactgcctgggaagtttccatggcagaaagactgggcacagtcaggtaactggtatttcttgattaccatccaccagtaggttgatctttggaaagttacttatctttggaaagttacctatccaccagcaggttgatctttggaaagttaacgcgggcccccaggttccttgttagtcacataagggatctgtaataaacacttcctaagtcaggtccaccatccattctccacagcagtggttcttaagctttaacatgcacaagaatcacccagagagcttgtcctaacagagtttctggcccatcctcagagatctgatttaataggtccagatagggcccatgaatctgcatttcccagaagctcacaggtcagaccagtgctgctggtcgtgggaccaaactttgggaaccactgctacacagtaacatgggaaaccgaaatacttcagaaaatgaaagtctgatgtagcttctctccagaagccttcagtggtttccccatagcccttagcataaagtccaaagtgctaaatgaataacagtatgtggacacccaggtctccacccagatgcattgctcaggatctctttctgggcctttcctgataccccaagctgctgggctgagttttatgtccctcatctgtgctcttaggaaaatgtgttccctgtgtcctaaaactgtaaggaactgttatcacatgcttccttgcctctgttctcaacattccagaagtggtttgtaaacatacccccaactcccactgctccaaatttaaggggggaagagtcccctcatttcacctcacatcattttacttaagaatcgatgccaccttcgggctatgcatcaggtctcgtttccaatatttctagcagagccctcctcaacccttctttattactccccactctgctccccaaataggccacatcctagccccccattaattccccttcctgaagaagcgacagagataaggaaagcccaaagagagaacctgcacttctctgagcacatccctgaatgaggcaccaacttccccttccccaccagcctgctcttctcctcacaggtcctgagcatgctcaaggatctcaaagcacacagggccagtgtcaggagcatggacccatgcagtcacatagagccccacttacgtggtccccatgcttggcttcatgctcttctgtcaccatcttgaaactcttaatttttgaacaagaggcccacacattagggagctggtcctgaaggcaaattatggaactggatacatctcagctcctcagcaagcacacattaccacatcccattttcacccacactatctcagcagcacagctcccagcagcctaacagaaaagtcacgctttcctctaagaaactgccatacttccttccttcagagtaaaacaaaatcatattatggattgtatcatgctttttacataactaccaggaaactttttaaacacatgatgctaatttagcagccaacatttttgaacttcatggtctataaatttgtactgtttcccatattttcagtctctgtttctattttcttggtcctgactctcttttccattggaaattcatcatttattttactgaatatgaatatcctgctgagagctgtttatcccacagtccagtacacacaggaaggaggcacacacagtgcagagagccatcctatacaattggaatttaaagagatctgacttcataaagtacgtgtatacacatgcatacctatgcttccatgcccattaagaaaatgtggaaacaagaaatttaggcttgggagcaacggccaaaggagaaacaaggagaaggaagagatttacttttcacttttacctgtatatagtatttaattattttctgtaagtatattacttataatttttcaaagtaaatagctcagtaaaatgatcttctgtcaagctcaacaattgggtgcttagcagagcaagaaatggaaaaataatggctaaagcagcttttacgtaatctccaaagacatcaactttcacatcagtttctcatagactgtccagcatattggaaccgaagaaaaagagcaggcataaatactcagaacaataaacttgaaaaatgtaacctctggtatacatttaatggtattaaatgaaaagcagtgaaaatgaaaaccttaaacatctgcatatactaagactatgttaagaagaaacgattattaaaagttaactaataaataagtaaaagtttgagtatttgggggtgaaaaattgtcagaaagcaaatgtgtaaaaagatatatggtcctgaaaatcctcgcttattctaaatttaaaatgcaccttgattctattgcaaagaaagttgaaagtatgtcatcaaaaagtcatttaaaaaaactactacttaaaaagtgatcagataatttacaaagattattctcaagaagtcagataaagataaagatgccccatttgttaacagtactttttgttcttctggataatgtactgaaaaccagtctagcttcctatggtatgcataacttcctctgtaatactccaattgtattaccaaaagcaaacattacttttgttatcaaagcaaatttaataaagaattttcaactatcttgcccactcacttgctttgtaattcagataaatgactcaacatctccaagcttctttcatcatcttgtaaaaggcaaatagcaatctctcccaagcagcactgtactgagaattaactgaattgctttatgtaaattctcagcacgataccttgttcatggggggtgggcaataaataggaggtatcatcatcatcactcttggtaatgacgataaagctggtatattttcaattctattgcatacagtagaatttaaatttagtcaaaaataatgttcaatattaagaaataacagacttcatcttcataacaaaagataggttggcaatggctaccttagaagctacctaattgcctggtcacaattttttctttgtgtactttcctaaaataaatttaatgaataacaaactatataaataattttaactgataatcatgtgcaaagaaatacaatttggcactcaggctgagcttatcccactggaaaggtgtgcattaacatggtggcatgtattcgtttttcaagtcactttactggccactattaagtctctgtgtggatgaagtagaaactaaaaaaggtctggtttgagaaaggccggaagcaggaggcaagtgggctctgccaaggtgcatctgtatccacaggtaagaaggaaggttctccattctttctctctctctctctctctctctctctctctctctctctctctctctctccctctgtgtgtgtgtgtgtgtgtgtgtgtgtgtgtgtgtgtgtgtgtgtagcattgacaagggggtaagcccctacaaaagagagtgaacctcagaagagagatgctggagagacgctgtgtcctccaaaggactcatgtcaccacagtcaccatacccaggtcaggtctacctaacagccacttcaattccatctttctcatgtgacacttaaggctatgctgactttgccaaaattgctttcagccaaattttctaaaagaaaggaaaataagcatacttttctgatgaaaactgttgtcagacaggcctgtaactaaagccatttcatacagaatatcctggccaatgtttagcacatggtgctttacactgaaaactttaaaagctagaacagctatccatatccatcttctaaaataatgttgtaacagcattagtaaatggtgaataatgtttgaacagtgtctactaggaaggacttaatgaaataaagtggaagatatgtgaaatgactaacatttgaattcataaggatgttatgccccaaaaccttatttttggtatcaaggtggccattttgattaatttcctgatgatacttaagaaagaataacattaatttctaaagcttccagataataactttttcccaggttacagcttttatatatgttatatgcaactcacactaattcacacttaacagcagatagaatctaaattagatcttcttataaattatttccagaatgggcaagagcaaccaaaagataagatatacattatctaattattcaataatgctaggaaattcttttaaaatatacaaactaggctgggcgcggtggctcacgtctgtaatcccagcattttgggaggccaaggtgggtggatcacctgaggtcaagagttcaagaccagcctgaccaacatggagaaaccttgtgtctactaaaaatacaaaattggctgggcgtggtggcgcatgcctgtaatcccagctacttgggaggctgaggcaggagaatcacttgaacccaggaagtggaggttgcggtgagccgagattgcaacattgcatgccagcctgggcaacaagagtgaaactccatctcaaaaaaaaaaaaaaaaaaaaagacacaaactaagcaaactctaaatttatattattttggaagactcatcaaaaatcctgctccaaacactcatattgctaattatctcattcaagatattacttcaccatgtcaatattgatttattattttatactttgtttctttcccccaaaagacatgagaacacttacaaaaaatactcctgccactgagataaaatagataggtaagtaaatctgggttaagtcagaatgaaggtaagaaagtaaatatatatgggcagtggtagagcacaaaaatgtaagcttttaggtccctgatcctttgccagtaaagctgtactttccatcccaggctcagtttcttccgtgtttgctgggagttcctgtattactctgtagatttcatcgaacttttaagaaggcagtggttgctttgcctagcaagggaataagaataatgagctgagagctccaaggtggtatttggaaggcatactttttcccagaggaaaaatactgaagaaaaaggccagttgtacaggaaatagggacagacattatcaccatattgaagccaaatagaaaataaaatgattttttttaagtttaaaattcttttgtttccatgatatactcaagagtctgactccaaataacaacctcaaaaccttgtttctgttttcagtgccttcctgaactaagtgttttccctcaagtagcaccaataaaacccagattccacccactggcattctgtctaagccaacacagcttttatcaggtgcttgaaaaagactttgcatacagtaatgtgagacgctgaaggtgcatggcaaacagcaatgcactgctgtagaactccaagttgggcttctaacctcctgagagactgatgactatagatgtcacccaatcaatgaacaaatgaattttcttcagtatttaatagtgtattttggtatctggattactgggaattttaccaagggccaaaagagcctattgctaccaaccagatttggttgggggtttggcatctgaaatgtactcttttccccaggagctgaaattggaagtggacttatttaaatgcattggccttgatcacagtggatgcctagatttctattaacttttagccttgttaagtccaggtaatttcagttattgatgtaccctccttttaacttctccatcatcaaaagacatttattaagtacctatttgtttaccttactcttcgaagtaccacatggagaaacacttcttgccctctagggaacttaaaatcattcctctcatggtctccttctggctttaactagataccattaaatagttgcctcattctcctgctgcaaaaacatttcttcagtgctggctcttcattaaggggtggctaatgaagctcatgtagatcacccaatttggtagaaactctgatggctttagcccttcatctctcctaaatgctgcaccttatgaagtttggcacagcctctcacaactccctatctgccatgtttaaaggagttttgcatttgtttgtttttgattctacgtatttaaaactaccagtattttcaacaagaagagcaaatctaagatgcagataaattacgttactttgaatattaactattatatagattgacaaatattgctattttatctccagagaaactttaatatagagtcatcttgtagcactagggtaaaaaaaaaaaaaaaaaaaaaaagtctaagttgaagagatttttccaaatacgatgtaatttagggttacaatgtcaaaactgtaaacctaaaattaaactactaactatttttgtttgcaggcttcttttctcaaaattacaaccgcattacatttgttgcaaaagaacagattcaagccaggattttgttcattcacatgttattcctgctttacacgtattttatggaggagttacttttgctggcattttgttttgttttgtttcttttactaaatggtgagcaatgttagagataaatgtaactgtctacaaacactccagagcaaaatttggaaagaaagcttgagcaaataatactacatttgatgggatataagaaattaagagttcttcagatgacaagaaagtggcatattctttttaacacaatggaattaaagctatggtgaataaagcaatatattaagaatcctctggaaagccaatatcttgaatcattacatcagaatctacactgggactcttataacaaagcttccatccctgggaaaatgaagaacttcactatgagaggatggaactacaccaaaaaaacttttccaactccagtcttgggagcgcatcaaagcaacaggccctcgtccctggtaaactgtaatctaggcgtactacactttctgcatgttgagccaaggaatttcctcctagcaacaggctgtggtctgatgggctcgtccacctcctttccaagtggagagaaagcaaaatcaggaacaatatcccctgaattctcttcatcaaggattatcagacacctgttttaaattttaatctcattagttattattgataacaaggacaatgtagatccattgcaaaggcttataccacaaagaaaacacaactctaattagtacacgcttcataaacaaggcaaaggtgcctatctgaagctattttaaagcccttgttgtggttcataggcttagagagagatgctttgaattctgcttccatgtattgtactaggggaaagacatggcattctccaaatattattgagaggcatctttaccacaaggcaggatagttctgggcatggggctccctttcgaccatacctagagcaccaagaaaccaggagccccgcctgggagccccagtttcttctctgctatctctctggatgctggacttgcagtctcctcaacagtggatcacagcccatagctctcacatctttttatacccaccaatcccacactctcaacctcgtaaacttcacctccccttcactttctcctcttcctcctgccctctcccttatttcccattcagaaaacccccttcatcaaggtgtaacttcctcaggaagaactgcaaagaatcagcccagtgcagatgaggttccaccacccgaagtttctgctctatatccagtgaaatcaatctccctacacacacacacacacacacacacacacacacacacacacacaccacatcccatcttcttcctattcctctcaccccctcccaaggagagttttctgctctgaactacgttatatcctacctactagcccatctactccctcacccgaaaagtctgaactcctctaaggcctccatcagcagcaagatactaaactctgcatcctgaggtcaagccaagccaaatgttgacataccaggagtctctgcccctccgaccccagcttctagttgatattcccacatttcacttgaaattcaacatcctctcccttacaacctggctacttccccatatcgcaaagtaaaagccttctccagctttaaaagttaaccgctctacctaaattccagattccaaagtttcctattccttgaataatattgcaaatagttactaagatgccatactgattaagtggcaggaactatgctagacatgcattatctgacacagaaatcataagaactctataaggtataaatagatttggttgaatcacacaatatttgtaatacgcagctagatttaagccatgaaataattattttgtatttatatgtgcattattattagctccattttacagttagaaaaactgaggctcatgagacaaagtatgtttcccgaagtcacacagctcaagtatataagaccccaaggctcacagccacataccacactgcccctcaagcttatctgactccccaattttgcacagagctggtcctgtcttctgacctttacttaagtaatgctcatgtcctctccataacttattttaacagccagggtaagacccacattctcccatgaagctgtcctgacaaattccaagccaagctggccccagcctcccttggaatccatagtataattgagcaagctgcccttcttatgccctgtatgccagctaatcattctttaccagtgagtcatctcttctcaaactaaactgcatagttggcaaagcttagaaactctggtaactatgtcattttccctttctgaaccaccatatctcaattattaaatgagggtgttagaaaaaggctgccctgtttaagagaaagcatgaagagcctgtctgcttagcactacccttcattacctttccctccgcaaagcacaaaggaagcaaatcttggcttaaattagaaggtagcaagttgtcctctttttgatccttggatccccatttccaatgcactggtgctctcagatcttttgatattgcaaagacttcctcccttgtcaactgtttccagttcatctttccaaaacactttctacatcccactaatactaactttcaagaacacagcttggaacatgtaacttcctttttcaaacactggcagaaactccccattatctaccatggaaggcagaattctaagatggcccctaagacttcctgcaccctcatctacaagccctgcacctactgaggaaatccattgcatcagatggcattcagggtccttaagggtcatttcctggattccaggctcaggttacctgacactaattcatgcacctcaagctccaggtaaactggtaatctgagcctttgcccaagctaatttccaggtaaatctgtccctttattcattaagtttagaaatctgcattccaggaccaggcacagtggttcacacctataatcccagcactttgggaggccaaaatgggaggctcagttgagcctaggagttcgagaccagcctgggcaacaaagtgagaccccattgctacaaaaaattagccaggcatggtggcacacacctatggtcccagccacttgggaggctgagctgggaggatggcttaagccctgggaactcaaggctacagtgagccatgatcacaccactgcactccagcctgggcaacagagtaagatcctgtctcaaaaaaaaaaaaaagaaagaaagaaaagaaaaagaaatccgtattccttgcagaccagctcaaacaccccttctttcctactctttggactcaacattaatccatttcttctttccactgctccctcaagacattacctggaattctatctagtggcttatgcagctaaatcaggggtgtccaatcttttggcttccctgggccacactagaagaagaattgtcttgagccacacatacactaacactaacaatagctgatgaacttaaagaaaagcagaaagaaaaatctcataacgttttaagagagtttatgaatttctgttgagctgcattcaaagcgatcctgggtcacatgcagcctgcaggccatgggttgaacaagcttgagctaaataaaagctcagggagggtagttgctatgcttagatgatagagcagggacttcctgacagaaatctatagcaggggcacacttatgattcccgcaggtcactgagctgatctactctgaccttgtcctcgccttactgataagtgactactacgtaatactccagttcagactcatgatactaataacttctccactgcattgcttttctgaattgcaatctatttgtaataattttagcaagtccaattctcacccattagaaacaaatttaaatagaacaaagcttaaaaattagcattccaattttttttagggcatttgtctataaaaatgtagaaaccactaattatttaataattacactgactctttttatacctcaagttctcctcttgtgcaattcaataggagatcaatcaaaagttaaattttttgagaaatcatgttttccctcaatgtgtaaaagaggaagaagaagaggggaagatgtgttacatgactggttagaggccaatctaatttcaaggaaatgcaaacgcagaaaaatcttatcagctctagctcaattcctctaaatatactaaatcaaaatctaagaaggaaatggaaatacctgtgattgatagagaagtacaatactaggaatccacctggtctcctcaagggcaacggtttgtttccttctcagccacactatatcctatcagccaccctaaccgcccactacactctagttggccaagaagtcactgagggctgtcctgtgtatcttctcaaattttgtcccttgagcaaacaggattccccctgccttccaaaataatctaaaacaatattaaaagaaataaggtcacatcaaaataaaacaaacagtaaaatgtccctcgtccaattacgccttccagtccccacacttattatgtttgcctgaacaattaacagcttttaagatatttctggctgacccagaaggccatattcaatacacaaaaaggtggaaaacaagtgataggctacacagaaaattgtgccatcatttgctgaggcttctgttcactaagatcacagctatttttcagtttccacatgatgttctgtgtagaaaccatatatccctaatattggaagaccatgatgatcttatcactaaaacataacagctaagaactaaagagaatatttagattgaaagtgtcctgagaaaaatcaaggtgtagaggatcacagttggatgttctgccctatcttagtctcttccagaatgatgtacatacacatgggctccgcatacatgaattcaaccaaccatggaacaaaaatattcagaaaacaaaaattccacaaacttacaaaaagtaaaactccaatttgctgcacactgagtactatgctgaatccactcaaatgaagtgatatgtaggcactgtattaggtattgtaagtagagatgaattaaagtatatgggaggatgtgcacaggttacatacaaatactatgccattttatacaaggaacttgagcattatggtgtttggtatccccagtggggcctggggttggggcggtcctagaaccaattcccccaaaataccatggaacgactgtattttccattgtcgtattttctttacctttaaaataggaatacagtatcttccctgagaggataagtggtttctcaattttataaatttttctttgaaagaacctgttggcttttttaccttttcttataggagagcacatgacatttactttcttagcgaatttccagtatacattacaatattgttaactatagtcctcaacttttgcattaaatctcaaggcttattcatcctacaaaactgcaactctgtaccctctgaccaagatctctgcatttccccacctccccacctcagcaccattctactctgcttctaagtatccaacattttaaaattccagatataagtgagaacagaaggtattatttagaacaaaaactgtaacctcgttttttaaatacatttgctttggatatccaagaatcttcttatctcaagaatgctataaaaaaatatataaatcccattcttaagaagccagttattgtttggtactaggttcatccttacactacattcctcctcaagaagaaaataggtgctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaagaagaagaagaaaataggtaatatgatagatttgaaagcaatgattgagcttgtgctgaaatgaagtgatggattgtgcctggaattttttggtttaatgactttagatttaggataaaatttcattttatagaaacaacatgaaaaaatcatcattgcttataatattaaagtctgatatagaaagtaatagtaagttttccagcataggcatggggcttaaagggagatttgactctatcagagtatcaggattcactctcaactttactgtaattctccagaagagccaaaagaaaaaaaatccagaaatacagaacaaaatatttaaagatccaagccaaatgttttttaatgatttttttcttttatgctgactgtatatataacattttgtcattctgatgaaatacatgttatttccttttgaaatctgaatgaatcacatttcagaaaaattcattgaaatatgatttagaacagtgatcaggtaaaatttttaacactaattcagatttaattattatagtctttaattccctgtcattgttaaatacagcactaacagaataattaattgggaaggtatgtactatacattttaaagagcatttttttttttctaaaatctaaatgatgacaatttggctttgtaacacaggctgaaaatatttattcattgagatacggatcatctcccttttaacaagctaataaacaatatttggataacttttttttggctaaagtctattaggtaaaacgaccatcaacaaaaacaatgaggctaggcacagtggctgacccctataatctcagcactttgggaggctgaagcaggagtatcacttgagtccaggactttgagaccagcctggaaaacatagtgagatccccatctctacaaaaactaaaaaattggccgggcagggtggcatgcacctgtagtcccagttactcaggaggctcagatgacaggatctcttgaacgcatgcggtggtgcctgcagtgtgccatgatcatgccactgtactccaacctgggcaacagagcaagaccctatctcagaaaaaaaaaaaaaaagcaatgaatatataagcatattagtcttaaaaaatacttcttatgagctttattaatataagcatatatttaaaaattagtccagataattgctaatcacattttaaaaataaatattagactaatacagccaaagaaaccttagaaataaagaactgtagttattctggtaattctgtcttttcgatggactaataattaaaatcaccttttttgtttggattccaaatggtttcccaatttatcataaactcacatgggtggggaagttgtggaagagagtaagaaatcttggccaggcacggtggtgcacacctgtaatcccggcactttgggacaccaaggtgggtggatcacctgaggtcaggagttcgtgaccagcctgactaagatggtgaaactccgtctctaataaatacaaaaaaaattagccggccgtggtggtgcatgtctgtaatccgagctacttggtaggctgaaacaggagaattgcttgtacccaggaggcaaagtttgcagtgagccgagatcacgccattgcactccagcctgggcaacgagagcaaaactccgtgtcaaaaaaaaaaaaaaaaagaaagaaaagtaaagtaaaagaaaagaaatatattctaaacatgtgcagaaaactactaccaattttaaaagctaatttatcagttgaaagatttctgccacctatcattgtctaaatggattcccagtttgctggtgagatcttatttttagactgtgatatccttgaggatagagcctgtgcttttcatttctaggtcagtatagggcatgaaatattaggaagtactcaaaactatctgttgaataaacaaagcatggatgaattttttaaaaaccaatgaattggaaaacattgttcttgaatatctctccatagacttgaaatatatcatactatggagaaaggcacacctactttggattttcatgaattagttattttccctgaacctaagtaatatgaatactggcatgaaaatttacaacggtactgtaatcatggtttttttaaaaaaaatttattttctccaatgttgttgatgataataaccaccccttacatatgtcaattgtaagcaagctttttgtaacaagattcacaatgtttcactctaattctcaatacaaatcatcaaggtggatactatcatcaactccatcttacaaatgaagaaagggaggcctcaatgggtttaataacgtgcccaagttaatattgctgtttagctgcagagaggaaccttctgaacctctggagtctaagctccagccactcaacctctcagtattttgaagtaattcatgtcttattatggtgttaatttaaatcaattttacataatttatttttatatacttcaacatcattttcaagtatccaagtttttatttttaactcattaataattcatttactcttcctttaatcagatgactcatacaactttgcattttctatcttttgaagacatatagtaaccagtagaaggaatctaaagctattgtgttaaactactgactttaaaaataattatataggaacagaatcatatgcatcaaagatattagattattgaaataataaactttatgattctttttttttttttttttgagacagggtctcactgtcatccaggcaggagtgcagtggcgcaatctcggctcactgcagcctccgcctcccaggtttaagcaattttcccacctcagcctctcgagtagctgggattacaggagcacaccaccacgcctggctaattttttgcatgtttagtagagataaggtttcaccacgttggccaggctggtctcgaactcctgacctcaggtcatctacccgcctcagcctcccaaagcctcccagaaccgcatccggccacgattcttaatagtaattcccacatctaaactatacaatgttccactcgaacccatttacaaaagccacactccattttagtggtcaaaacagtaaacatttaattgttcatttaatttatttgggctatattaattccacataaattcaaattgcttgcaaattgaggtatgcttgattttgaaaatattctaatgaaaaagcttcctttctagccaggctttaccactacgtaagaaaggatctgactgtttggctttttcagtccatctgagatgtctctttgtaactgtattttaattttattagagtgtgttactcatgtggtttctctttcacatgaacccaaaccaaaactaatttaatgccatgttccaggtgactcaatatgaaatggggacacataaaaagatcttatctttttggaatcttagaaattcctttatctcttttacttctttttaaattttcaggtagttgtttttattataatcattattatatgtaccacctacttgtaaaaacgctttgggcaggtttacagggaaaaaaaaaaaaacagtagtagagaaattcacttaaactaagtatgagaaaagaagtgccctaaatatcacaggaaaatcaactacatacgatttcattttataatatttctacattcacgtacaggtaatctccaacttactattgattcgtgctctaaaagctcatcggtaagttaatggtcggaactcaatgaattctattgaaccaataacatattaggtgatcaggttgttacaccagcacgcaaagcccaattcaatcctgaatgcaactcaaccatcataccaatagtaccaacaggaattctgagtctaaagacgatggccttatgaagaattatgccaaatgggagatcaagtacttctacaataaattcattcattcagtagacattaattgagcaccaaaaggctgcagagtgtcagctttacatgtactaattctggaattaaaaaggcctggctcctaaatataaactggagataaaataatgccttaaataaaataatgtatgtaaagtttgtggcacataaaaaaatctttactaattttaactctcttcctttctgctgaggaagaagaagaaagaaacagagttctcagctttacataaattcttgaaggaagccaggcttaatttcctcatcatttgcactcctctccaccttcccttccgggcttcagggcccagtgcaagaccctcactgagccaaccatcttagacctctctctgttccaggctctaaaaatatcccctcccaacctgacttttattcccatcctgcagccactaacatctgctaggtgataaagaaaagcagatgcaatggcgcgatctcggctcaccacaacctccgcctcccgggttcaagcgcttctcctgcctcagcctcccgagtagtggaattacaggcatatgccaccatgtccggctaattattttgtatttttagtagagacagggtttctccaatgtcgttcatggctggttttgaactcccgacctcaggtgatcagcccgccttagcctcccaatgtgctgagattacaggcgtgagccactgtgcctggcctgacctgatgaatttctaattagtggtatttttaagacagtataaaagaatggtataaaataattcaggcagagtacaattataatatttggggacagggagaaagccattcatttattaattcattcaggttctatgaattgccttctatcttcctggatagacatatgtcagagatcatgtcctcatagagctttgagttcatcagggaaggcagaacttgtccaagctatatgactatttccaatgggtattaacaaatatttgtttaacagagtgaataaaatgctatgaagaaacttagagagcaacagaaatgcaaaataaagggcgctaacagaatggaatgtcaaggaagacttctttgttgaaggcttctcctagaatgtaagtcccatgagagcagagatatagtctatatccaaatgaaccctgaatttcaagaacccagaataatttcaggcacatagtacgcacttaactaaaaatacatgaaagagaaaaggaagattagcttaagcttagacttaaagggtgaataaaaattagctggaggaaatgggattaatagaagtgaaggcatttaggtagaaaaaagtagcactttttgacaaatttaaagaggaagcaggttgtacagacgatgaggcagaagttccagagagaaaagtgagaaacaagtttggaaaggtgggtaaaatccagatcaaactgggcctttcacaatgtgcaaagaattggagacatttttcctgagactgactagcctactgccctggaaagcccagcttggattgaactttccacaatcatccctcagaacagttctgaggcagtggcatgtggattctggtggcgaaaggcaaagggggagcggagaaatggagttcgcaagatgagtaactgaggatcccaagctgtagtggcagagctgccactctgtcactagaacaaaccactaagaaataaatacaacagggatatctgagtccttggcctacagtttttccatggggaaaaaaaaaaaaaaaatatatatatatatatatatatatatatatattcgttgagacatttgtttgtaagttcagattgctatctaagcatgctgggagaattcactgggagaaagccctgaaaagaaaaactatttgctcctgaatttatctgtatgagcaagtatgtgtgagagagacagagagagggagagagacaaggaaaggcagagagagggagagagaggcagtcctgtcagagggctgactgtaaaagaatggaggattacacacttcactgttcaagggtgacagagggaaaacgaggctggcaccaagcaggaagcccaatcctgcctgaataaaacactgcacatttatgcaatcccgggtaccagatcttttatcacaaactattttgattgcatagaaagaaaagtgctaagtaaaaattatttactccaggtctattatgaaaagaacagattaactccctaacagttcgttctttttgaaggtatattttctaccttgctggtatgatttatattaatgagaggtttaaaacaggttttaacttaagaatgattgctgatggtgaagtgcagtaattatacaccttatgacaggacacgtgaatggctcctacaagagaactgcataacatgtcaagctaatcctccttgcataaaaagagagaatactttgcaagctggccgattttaagctccagttaacaaaaaccctttttgttggagtctaaaacaagaatgggttaacaaaagcaaggaggaaaaaaatctcatttttccccttcttcacaaaatatactattacaggacttaaaggttttgaaaggccacagtgtggctgaaagacttgggaaagaaacaaggtcttcgccaacaacaccacactcaaaagatcctaaggtaaatcgcagtctcttatcagtatggaacagtatgattttactctagttttttgttgttgttctgtttttgatttttaatgagttaaaggtgtagcgagggaaggagcgacaccatggctaggtaagaatgaaatgggttcatggatgttaggaagaaaaaaacgtatgccatggtgggcaagtcaatagtgtttgtgccttttctgcatggctgctttttctcatacaagagccacttctggacaataatgagaccccgtaaagcatctgcttagggattacgaccccgtcacactgggaatgttcagttaacacagagcagccatgggcttaactccgtgtgtgcctgtcttcctgctgcaaaacgcaccaaatgcacagtggtcctggattcttctaaatcatttgccaccaggaaagaagatactcagctactgacacaccacctacctgctcaaggaaagcaaaaattaaataaacaaaagccatcagatttacttcacatcatggaacttgttaagacaagggagacaggaagactaaaggttgccaggtgtgagaaacgaagtctggaagtccattttaaagtattagagggctaaggatcagcgtcagtgttaaattcttttctaagaattcttttcaccttggaaactttcaaatgagaaatttaaggagcagaatccttatatttttctatgactcttaagtgatttacagaatcctaaagtgtagcaagttcttataatgagttgaactatttaacttattttatttaaatgtttatttcaattgttttgcctatgtactatagtctgtaactatcctagtctataatcaaagaaatcaggagtgcccaccacctatttgcagaggtctctaaagcagagtccacagtggccagggcccatctagcaaactggcatgctcagtgggacaggtcaagagggcgggtctgcctctggcttcctccttcttctaacacatgctgcacttgctcttgataggatagagcaaaaagtcaccactttttaagaaaaccaaggcaaagaacagaaagtttaactcgtggtacctcctaaacaattgatgtcattactgctcttcaaaagatctcttacagacatgtagtttagccataaagatagtacgttgtgttgaaaatgcaaaatcacacaaatattgccttaaatattttatttccaaatgtaagtaatagttaaactatttatatcccttcatgagaaactggaagctgaaattttcagatgtgaaggaatttctcagaaagtgatcctaaaaattttcaggaaaaacatctaacaatttaaccataaagagctttggtgaagtctgacacccagtatttagctcttttgctattattcttttttttttttttttttttttttaagatggagtctcactctgtcgcccaggctggagtatagtggtgcgatctcggctcactgcaacctccacctcccaggttcaagcaaattctcttgcctcagcctctcaagtagctgggattacaggcccaggccaccacgcccagctaatttttgtattttgtagtagagaccgggttttgccatgttggccaggctggtctcaaactcctgacctcaggtgatccactcgcctcagcctcccaaagtgctgggattacaggcgtgaaccactgggcccagacttgttttgctattattctttaataactgtttgcaaactacaaatattgaaaggtgagcatatgtacaaagacaaaattaactagtagtctgagctgaaatattgtagcttaattctagtctatcaattttgatctgaaataataactctgagggcagttttgtcaccatcagcactcattccaatattcaaaaggaaaatttttgtttaatttatataacatcttacttatagatgctttacttatagaaagcacctatcaattataattagcaaaacaggagtcaagggcattgttttattgtgttacatgtcaaggaaaggagacttagagctaacttctgtgactcttggaaaatccaggattgaagcctgcagtcctgtgacttattgaacagtcaaacctaggagaaattatcctaaggtaaaatgtcagaggattactctctagattggatggcagagagagattagcattctcagcatcaaaaaccagatcacaaacccatctgcaacagaagtacatgcaataaaagtactagaacaaaaatcaccacatttaagagagaagctacctcatggtgtagtaggataagaaggaatgagattgataagaggaggcatgtaggtatattatcattactctttttttttttttcttaatggagtcttgctctgttgcccaggcttgagtgcagtggcgggatctcggctcactgcaacctccaccttccgcgttcaagcaactctccttccttagcctcctgagtagctgggattacaggcacgcaccaccacgcccagctaatttttgtatttttagtagagacagggtttcaccatattgaccaggctggtctcaaactcttgacctctgcccacctcggcctcccaaagtgctgtgattacaggtgtgagccactgcacttggtctactcttttttttaacattttgttagttatgctttgtaaaactagcatatttttaatttaatttacatcaatttaactaaaattttattaaacattcttaaacttggtggtgctggcatttgttcgttgaaattttttttttggttttttttttgggtatgttttaactatttcaacatacgtttttaaaaaccagatccaagaggatcagaataacaatagtgaggtgaaatcactggatcaaccaggggacaaaaaaaaatagcttcacatatgctcatttggtctttttgaacaaatgttgaataaccaaatcttttagacttttaaatcattcattattcttgcagttcaaatgtggcaatcttaactatttagggtttcacaactggtaggtacttaataagtatatgcctatagaggataatgataactttactcaaatgggacattacagaaaatgttatacgattgaaaacaaaataaagaataaacaccaagctcagaaaaaaagacttcacactaattcactccatctcattcctttaaaattcaggcttaaaaattttttgataaaggcgatctgatgttcaaaggacatcatttaaaacttgggaggcaaactgatagaggagaatgccttttgtgtttaggaactcccagtattgccagccccgaccttgttcctcaccagctgtaaaagcctgtgtgagaccttagtgctgaaggcctcagcttccttatctgtaaatgattagaatagataataaaggcaacaaccaagtttatacagtttgcctgacaactttgacatatactatctcaccctaaaagatccctttgggttttcatgggctatcatcttggttttatacacaactcttatttggttatatgtcacttacctaagtccaagaattacgaagcacagttgttcagttaatttatttcttatttttaaaaaaagcactgttgtactgctgtagatagaacaactctaatcttcacgtactgctgaattacaattaggtgctaaatcaccttcaaagaatgaacaaccttttgttttgaggctcgtccagaagcatcactaggacctgatatgtacaagaaagaaaaaaatagtaacctgggcagtaagagttttgtcagaaggaatgcttgtccttatcagaaacaccacttatccccaaggcttgaactttaactatgaaactttacccactgggtttttaacacaattactactgcaagctcaccattatgtatttaaactcacaataaagaatcaatgcctgatattgcattatttcctaaaagcagattttgatggaagacaagaggctgggctccagtatcaagagtgtacaggatattttttaaagacatatttaaataatagcattgatcataacacaataatcactataccctcatcttccattcctacaacaaagccccttaacaaagacatgtgtacgcattatagctaccagttttatatggaactgcccactaatagctaaattggcatctttatgaatttaaggttctctataatgttgattatggctactgcttttgactgtatttttcaaaactgaccacaaaatagaagcttctaacttctctctgcccttgtgtttgcaatctccagagaaagcactccttaatttcatcatagtggtcagtaatctttagtgattgagacagaaattaaaattgattatttgaattctgacaagctgcttatgtttgtaattaccataaaactctaccacaaatgccctagagtccacgggtgtgagtgaggggttgataggaaatgatccattttcatgtatctagatttaggacgatgcatgtggaattgtagagccacttaagatcacactcatccgtgctggactaactgaagagggaagtcactatcctctcttaatagaccagacagtcctcacgtcattgctacaattaaattccagagaattttttggattctatttaatgaataaggatatatttttcatgtggtgtcattgtttcactacttcccatgtttatttggacagattcatagcactgggtaggaaatgtattggttggcaacttcagttttggaagagaaagtaaacacatgctgattagcaaacagtaaactctactgtgtttaattttggcttctctttaaaaaaaaaaaaataaaaacacaaaaaagccactatttggtgttgtgttccaagtaggagcatttgtccctaagttctttcctaaccccttactggagggcttccagaattgctctcatttttttttcttcttcccctaacaccagtggcaaacgccaacattatttaagaaaatacttgtgcatatggtatcctcctagcacagatttgccatccagttgaacagtagggccactaacccacacaaactaaactgcaaaattatgaactgcataaacataaacaattgaatttagccctaataaattcaaggtaaaatcacacttctgaaattcctaaaaggctacgtcactgaaaactatcaggtctgagaactgaaggtggtaaatatgacaatctaaaacttccaatgctctctttagagccaatttctttcatctatctcatcctattgatttactgtgactccccaaattattctccaagctttagccattcttagccctcttctcatccatcttcagaagatcatcaaaatccctaacacccaaaaagtgccgaaggccagcacacacagggaaaagcttggccacctaagatataccattgcccactgagcacaaaagctcttcattatgtctatgtaccttctcattaaacagagctggtgtctgatcttttcactgctcatgattactactcattattaatcagacttcccaacatgcttccaaggtatgcaaaatctcgtccccacataccagatgggaaagctgaggcatccaaaagttaaataactcccaaatagcccaatataagaggtcagcaacatctcttgccgatctacattgtttcttattcaataaacatttattattgatctaccaagctcctcaccctgctaggtataacagtgtgtgtgtgtgtgtgtgtgtgtgtgtgtgtgtgtgtgtgtgtgtgtgtgtaagctcctcaccctgctaggtataacagtgtgtgtgtgtgtgtgtgtgtgtgtgtgtgtgtgtgtgtgtgtgtgtattctaccatattctgggttctgggcaaaacagcagattatcaaagtcctaacccacatgaggcttacggtctaggaggggtaagaaacagtaaaccaagaaacaaatgaatatgaaatatgtgaggtagctatggggcaaagagtacagcagggtaaggagaaaaagacctgggaagaagagagtggtagctggagtggtaggagattttgggggcacatgtaatttaagtcttcctctgaatgaggtaagggagcaagccctacctacgatcatctgagaaaaaaacggttcccagcagaaaggacagacagagcaaagtgcctgaggctcagctgtactggagggatggtagtattgctgctactgaaagggcaggcagagtgactcactggggagagggaggcaagggtcagatcacacagcacctggaagtcaccactaaaagtaggggctacaaatataaatgagactactcaagagagacagtcttgtgaagagtttaatacgtaaggttacattaaaaattcactgcattaaaagcagttgatgctttccctaccatcacataaaaagtatatgtgcacaaacagacagaagggtgcatgcgctgaattttatatagtctaggaaacattttcacattggttgtttcagtcaaatacaaagaagttacagaacagcatcgagtacctaagagagaccaaaagcatttccttctgtaaagccctgcagctgagggcttacatccgcctggtccaatcagttcatttccaaacaaaggtaggaaatggctgcatcctagtatttcattgtggactcatgactcagtgctttggaacttggtatctttgggagtgagtgtctattctccacgtctcttgccacagggggaaaaaggtacagataaacagtaacacaatttcacccaaccgagatataaatctgtgggcttctccacccttctcaaaaataaatgaatgaatgaaggaaattcagttcctgcttttttttcttcccttctctgttttgtttcctaattcccaggactccctggtgtctcctaaacagcataaggtcaactgatggtgaaagtacatcacatgataattattcaaaagctgttatgttatacaatatagtttataataggaaaaggagttacatttgattctgcaagagcagtcggtaatatgcccattacatagggattctaagaaactaaaattaagaaatttgtcctaaagaacaaattgattctcctccatcatttaaccaaaaaggtttgtagtattttgtattcacaatgttacacaggagaacagtaacttaactttgaaaactgttttcacacaatggtcacaaagaaaataacacataaatcccattaggtctttttgtaaaaagcttccataatttccaaatccacggtgtagagaggaaaagaggaaaatggcatgtgtatatgttctaagactattacttcaaatgaataaggtttagaggtatacttaacatacaaactgtttccttcaggaaaaagtgcaggaactcctggatagacacaatactcatttctgatgaaagttacagaagaaactaccagttgtgtatgatctaatactacaagtcacttattatctatgaaggaaaacagaaagagaaaagataagaaaacaacatttaaataagaatgagaaaggaatctctgttctaacttaaagatacataaacatataaatccaaatatgagccaaattattttataatgatatccatgtgatcaatgaggcataaccacaagaaccttacacgattataatgagagaagcttcgaaacaggaaatttctatctacaaaaagtacaaattattttcagaatattggaggaatctggggttttctacccagcagaataaattatgaaaacagtgaaagataccctccagagggagagagtgcaagagtttatatgttaaagagaacattacatttcacttttccaatgtagaaacaaactgaagaaaatttagaggggatggtgaggatgaagagaaataaaatcataaaaaggaatgagtaaaaaatgtaataaaagaagaggaatatggtttccacttatattagttttgtccttccattaaaaattataccttaaagtccattactcttgactatattgccaatttctcaaataatacactggtcaagttccaaaatttcattaaatatataaattgcatacataaaagttcctgtgtagcctatggaaacattttaaattttcttcagcaaaattgggcctaaagtttggaaaaattcctagagagtgaaattaatctctctgtccccatctctccctctctccctctctctttctctccctctctctcaatagataatattaccctactatatatcctgccatatatctttatactccaatttcctacctagtcccctattcagacatgcataatgcttccattttgaagcatatggctggggagccaaaagaatttaaattgccttcaaaatgtgcatcgcattataaatggtgtgaaaaaagatcttactattcagctctcaacttggagcataaagcaaagaagaagcaacacaagactgcttcaaactttatccaaaaactcaacagcttcacttgtttatagaggtacaaaaagtatgcgacacagtttataaaacaagaacgatgtactgtatgcaaaagtaaagttaaaagcaaagtatagtaacagccctatctcgttacaaacacttggcagcatgtctaaagtaccatggtcaaaaacatgataccgtctgcgttgtacttctgccagaaagcactccctaagtccaagtctctttagccatcatcaccacctcatttggcaaactctcccaagcctcagttcatctactcaaaattactccacagaaagcagacaaactctctagctttgtaggctgcaagtatcacaatgaagtagcattggcaagtgacagcgtaagatggagctctgaggttagaaagccaggaccaactaaactgtatcctcaaagcttatttgcatatcaagttgagcagggctgtcttcattttggtaattcagggtttcttctctactctcacagtaattccaatgggtctttctgaatcagccgcagctgagaaagaaagcacatggcaagaatacactcaggcaccgaataccttttaggcaaatgaggggcaaatgtattcggcaattacctgccatttaaccatttctggccaggtcttttgaataattccagaacctcaaaaactgcctcaatagttatgtatgcataacggaccaggccattaccaaggctaagtaaatacaagaatatgcatcaaggtttaggtaataagtagataaatagactatatcagtatcaacatccatatctacctgtggcatttataactaaaaaaacagcagttcataatacataagtataaatgtggcagtgaaaagatgactgataggacagaagtagctgcatgaattattaattttcctagggcacgtaagaattggcttccaaatttttctttaatcgactttctccaaagtagcatattacataattcaaaaaaaaacagatattgtcatcttaagtttacagcttgccatatttcctagaaaataaacaataattaacaacatatctcatagttgttccctccccacctttcttcaagaaactttacactctgaaatgtagatacataagctacttttggatcagggcccacaaccatatgcttccaaaggaataatatgtacaggttagtctggtgtgtaccagatgttaaaaaaaagcaaattcaaaaacagaaatatcagtattcaatgcagaaatatattttaaattaaatcccattcttcctctccttatagacacagaatcaaagaaagccaattgtatgtctaattttttaacctttttcctgaacaaaaatcccaatttgactcatgactctagattctttatatacataagatcacaagacaagaaatggtcatttataaattatcctgtctcagagtgagcctcctaccatatgctgatattcaaccagaagaatttgtttgaaaaggcaaaaaaaattccagaagttaagcctataaggcaaaccagccagcaaaaggcgacagagtccacatgtctatcagatatttaatatgttaaacctcaattaccaaaagttttaagattctctgtaaacataactagtgagtctttatttttcagatgattctgaatgcaaaatgagcacattatctgcacattgaaagaatttatgtgttttttcccacatatggaaatatgcatgagtattaaaaaacaaattacaaatatccactctctagaagtttgaaaagtctaaagtttgggctgtatttgctttttccattgcaaacctacaaggattccttcagacttacaaaagttattgcaagaagtcctgcaggaagaaacagattggggatttagatcacccatgcctaactttttcagggcatcatgatctctccccttgttctatacatcagagatgtcactgaagtgaaagccaagttttactttagaatttaataaaaattgattaagcatcacagagcacaaacaaagctgctccataaatctttcaggcctttttgtgctaggaagaaagcaagcactgtctgctgaagcagatgacagatgctggcttaaagataagtattatttatacttctgtaccagatttcttcttatgcatatcttatcatgcatgggtatatgatcaacaaagcaattattttatatcagtcaaagacattcaaatgtaccctggctccataggaatgctttaaagagttcaggtctagggttcaattaaaccaagatggagagaaaagaaagtttggaaagaaaaacaaatattgaaatggttgtgatttgaaatgtactttcacacacaggctaatgaatatatatgtactgaaaataactttgttctgaacatatgcctatgcattttaaataaatgatgcatgtttgaaagataagagggtttaccaaatctaaacacatcaagatatatctatattaaactgcatttatttgtacagtatgtcggtaaggaaacagccccctgaaagaaatccaatagttatgtaaagagatagctgatttaaccaagtttgagaacattttagtcatcaagactagagtttaaaaatttaaatgacattccttccctccctccttagaaagacagaatatatgaaaaccaatcacttaatgaaaattcccagaggtttctttattgttttacttctagcatatgaagtggaaaaaagataactaattatttgaaagagaagaaaaagcaacttatattaccttctcaaaaaatatataatattctgcatcataaggcatttgaaggtggagaagctggcatgtgattccaaaacaaatctggataagtaagagaaataaatcaggtgggctgtcttgaccattttcttctaccccgattcctaagtcccttgagaatctagaagaggagcaggtttgggggtggaattgttttgttttattgtgtttcatgagggaagacaaactggaaataaatgagttttcaagtccagccagaaagtcaacctatggttagatttacctaattgggtattttttaaaaaaaaagtacaaaaacaaaaacctgtgctcatccatttttttatggtatcttattgtatttcatttttttctcagcatttttcttcgtaaaagttcgtcctaagaaatcccaacctcgtctcagatagcctaaaaggcagaaatgttcatccactcaaagaccaggaaaccctaagctgcatgacatcatgtgggagtaaaatgactgagtgagctcaagccaggatccttgctgctggagggtttcctgcacaagggctagctgaagccacagatatggctgcaactgcattaaaatgacattggtagcagaattaaactgtctggtttcatggaaattaccgtatactgtagttatcacgtgagaattagcaatgcactaaaataggacacacaaatcagtactattatgtggtaatactaatctatcatacgcaataatttttctttcctgaattatatatgaaaacacatccataagggtgtagcaattatgagcaaatattttcaagaatggctattgtgtatgtctcttttaagcatgcaactccacatagaagcactaaacaaagtaagtgcttaaagatattcaggattctctttcctatttaaataatcctctctattatataaaaattcagtttgtacaacataagcataagaaatttgtagaggaaatgataggtcagaatggtttttaaatgaccttatagtagaaaacaaagttaaaatatataccatataccagtgcagtcagatatattggagtcactaatacattctgaatctgctgattaaatgagagacattcaaaatgaatgaaacttacccacatactttctcatccatgtaagcaggaaagaattacatttcttctgagctaatgggaatgagtatagtaagctttaccgataactttaatctccacaatctccatagacagatccccaccaaaaaataaaataactgcttagtaactttgcagcatatcaaagttcacaaaccatgcccagttccaatacttattagccgttggccttagacaaattactgacctctctgaatttgaatttgtatatctatttaaacaaagataataggctcaaagtttgaaacaaatgggatatgtagaaaaaacattgagcaaaatgcctggaacacaataagtactaaaaaaatagtaaatactattattgttgttcttgctactgttattattattacacagtactttcatgataaaagtctctggccatacatcagcctagattagtgcagcatgtgcctaatttctcatctctgattccatgacattggggtgtccggattctcctcctacttatctgacttctcactatcattctcctgtattaactccaattcttctaaaagtcagcattcccctggttctctttatcaccctctgcaacctcaatcaaactttggcttcaaaggtttgggataacaacagctaaattcagacctgtattttcatttgcctgtcagacatcaacacttgggtcatgcctacccaacctagaagaaaaaaactgaacaactcacctccaaactcagtggttcttccactgcctctgttaaggaaactaacatttacccaggtgacgaaattagaaacatcacagtcacacccaactccttctccctacatccataataatatgcctccttctttctattcctaccagtacaagctttcctatgtccttcttgctgctctcctgactttcacagaagtcttagcttggttatgttcaacaaacaagaacacctaagatatgccaagcaccatatactctgaatgcaaaccaggacagaacaaaacaaaacagaaaaaaaaaaccaacggcaacaaaaaaaatgcaacccttttgctctcaaggttcttcaagtagtgggagagatacgtaaacacatgattatactataatgtcatacaagcaataataagtacacatggccgggctcagtggctcacgactgtaatcccagcactttgggaggcaaaggcaggtggattacttgagatcaggagttcaagaccaacctggccaacatggcaaaaccccatttctaccaaaaatagaaaaatcagcagggcgttgtaatgcacatctgtaatcccagctacttgggaggctgaggcacgagaatcgcttgaacccgggaggcagacattgcagtgagccgagatcgcaccactgcaccccagcctgggtgacagagcgagactctgtctcgaaaaatgataataataataagtacacataaattataaaagtgggacagaggagggagtgattattccatctagacaggtcagaaatgagtttactgtaaatatccatcactctagaggagtgttttgaagaatgaacaggaatgtgtggttgcacaaatgtgtgcaatgaacaggaatgtgtggttttcctctctaattcctgagaattagagaggaaaaggcattctagatatcagggacagcgtgggttagactctaagctctctaatcaacatgtttacacttaaaactcgccagtctaaaacccagacctaattttaacactttcccttttccataagaccttcaagggctttccactgcctctaggataaaatccaataccttgcattggcaaggcactggtattctaaactccgacccattagatgggaggaagctcccactgctctccacatccctttgtcttaggtacaggaagtcactacaccttcatacaggactgtgctccagccagccaccaaaatgcctctctgcccttcaccctgcaaaatcccatttaccctgggatatcaagtttaatttcactctgctgaagtccttcctaatcaaccctgcattgtgtcctcctctgagccttcagtccctttgttgatagctctatttccacacatctcatacatggatttgtagagtgaatgcccatatgtttgccatatcatttttgaagagcttttgctgtaaatgagaacttcagtgagtaatttccaattactttcccccaaattaacaggcaaatattaggaaacatcctatgccaaaccctcttatttggtgccactgacagtgctaacaggctagagtgaaatatcaaggtatatgtgtggttcacagaaaaccactaatatcaccctgctattgactgaactgtgtccctgaaaatgcatatgctgaagacccaatccccagtgtaactgcatttggagacagggtctttatggaagtaattaaggttaaatgaggtcataaagttgaaggcctgttaaaacgggtttagtatccctacaaagaagagatgccaatgtgcctgatctctctctctctctcttgctttctttcactatatctctctctctctctgctttctgagacacaataagcaggtggctgtctgcaaaccacgaagagagccctcaccagaatccaatgatgctaattccctgatctcagactcccagcctccaggactgtgagaaaagaaatttctaccatttaagccacccagtctatggtattttgttatgacaacccaagctgactaggacttataccatagtcaagagaacttgaacagtccacaattaagtggtgagactgtctctggtatgatgcacaatgtatttaactttacaaacagactcattaatctctcaaaagcttaacactgtcaccattttacagacagatccagctaatggttggaggccttccatgcgccatccaataatgcagggagaggcagtgaccatgcccagaacaggattctaaagtcctgcctttcaaatccctgacctagaaaaaaggactactccatttctcacaggaaaatgtgccagtcatggaggcctacatggcacgtctctgcactgctccaggtcaggagggccatctgacactgcacaggcaccactgcagggcaaaaggatgatcaagcatccaaaggccaccgccaccactgactagctgaaaaaccatgaaaaagttatataatttcactggatataaaattaaagcaagattttaatacttaccttgtagggtcactgtgaagatcagaaataaaatacagaagtacatggcccactgcttggcatacagtcaagactcagtaattagtgggtactctgcatgctttgatgtcacctcattaacagtttcacttctacctaaactaaaagcaggaacagggtgttcttattattttttaaaatctacagtagatatctgccctgtttgtttaggtgttgtctacacagtatctactaattttttctttttttctttttttttttttttgagacagggtctctccctgtcacccaggctggagtacaacggcataatcaaagctcactgtaactctgaactcctggactcaagcaatcctcctgcctcagtctcctgagtagctgggactaaaggcatgcaccaccatgcccagctaacttttgaatttttttgtagagatggggtctccctatgttgcccaggctggtcttgaactcctggcctcagcaatcctcccacctcagctctacttctttctttctttccttctttcctcccttccttccatcctagcaatcctcccacctaaactgcccttccttccttcccacctaaactgccctgccctcccctctcctccactcccctcccctcccttccttcctttcttccttccttccttcctgtagccttggtctcccaggctcaagtgatcctcccacctcagcctccagagtagctgggattacaggcatacaccaccatgtcggactaatcttttatttttttgtggggatgggatctcactatgttgtccaggctggtctcaaactcttgaactcaagcagtcctcctgccttagcctccccaaatcctgggattacaggcatgagccaccacgcccggcctctattactttttgttagtaataacaataattttcctctgggaagccactcttccccactttctgagatcatgtagtttgggtgtctcgtgatcctcctctagctcctctccaagaacaggcaggagacttaagcatagccaaagagaagaaagcaccagttcagcaacaggttcaggggtagtccaaggagatccagcccaggaacgtctgcagggactagtgaggaagggaacattttcctccccactgggtttgcttggctaatagaatataagccttcactgtggaaagagaccctctttgcccgagaagtaagggaacaaagagaatggcataggaagagaatcagagaaacattcccagttacatcatttgaacacctgaatcaaactgtacctgcagataaactggacttttaaattacatcagagaataatctccctttctcacttcagtctgtataacttcagtttcttacacttgcaattaatatacaaaccaaatagcagcaagaatttgacacctttcagtgaccaaaaggaccactgaaataagaacttagtgataagaaatacctttcattaaattctcactgtacgtcaactaaatatttcaaatttagtatttccaattacataaactgaggatgggggtagatattattatctctgctttactgataagcaaattatgagtcaaagagcttaaacaaattgcccaagtttaaatagtaagtggtggagatgagatactacctaagatttagcttttttcttttcttaagtattaccaagaaatagtattactcggaaatctcacatatttataagatccctttgttttatgctcttatagcatcatgtgccttttcaccaaatgattcaccacaattgttcattctacttttttttaagattgcgtctcactgttgcctaggctaaagtgcatttttgtgatcctttgatttgggaaattgttttctcccattatcttataaacttcctcagtttacgtctatcatgattattgcatatcattgtgcattcactgacaatagtagatacttagcaagtactgtaaaaaaatagaaaggaaggaagagagagagggagggaggggagaagaagagaggaaggaaggagagtaaagggaaaagaaatgaggaaggagggagagggcagaagagagaatggaaaagtgagaggggaaggtaattccacaaccccttcaccacccttaagccctttcttgagataatttagggcctagcaatagacagtggtgacactgtcctcatgcaaagggataaatagaggaattccggaacaaggcaggaatatcatcataaatgccaaagtcttgtggataccatttctgactcccccaaaaccccacacagtaggaacaaacatgataaaaagtttcacctattcctaactccttgttcaaaacccctcgagtctctttcttcttttcttgataagtcttagggtaacacaccaagttttaaaactcagttacaaatttgcccttaactgagcatctgaaaggttatcacgcaggatttttagctctaacagggaggagggtcttttgagtttatggcctgttgagcacttttgtgctgagtcaaggaagataagaggagtgggaaacaggaagaatccattagacagtgtctgtgcatataatatctttttttgttttctttatgtaagttctctgatggacaataatgtccccaggtagctaatgtcacaaacctcttaaacatgagagagaaattgtaccatttctcaaaggcagctttttggaagggaagatcaaagaggaggcagaattaaagccttagctcaaaaggaagacagatttccaaaacttcagcttttgccattaaaactttcaggtgtgtcccaagataaatgatacatcattggctactacatccccacagtggcctcactactacctcaatttgattttgtgaaggagtgctgaagcactatcaaagaactttggtgttcccttgcttatgtcatagttacctagagaaaagagagtatgccttaggaaatattccagtttaaagcaacattaaacataccaaattcatcaccgggattacagtatatagaatattttaagtcaacctgtatatctctgtcaattatattttattttaactatgtgagagaaggaataaaagttactaaggtatcaccttttctagtaaaagataaccaaataaatccattgagaagtcacgtttattcaaaagaattggtttctctggacttatgacatttgagtatagtacctcctttcttctagaatactctgagttaataaaagtttttttgaaaatgaaatccatgggtatgtgtcataataagtaaatactaaatgcttgtagtttttcagagacttttcttaggtgatgtctattcctgaagtatgatcagaatgcaacatctaacattttacataattaaagattatagtattttgttttaaaaagcaaactagaaacctcaagaaaaacctatccactggcattcctttgaaacatacatacaaagaactttacggtgtttttccttgcctttgggtgtttgttttacaagagaggaactccaggtgcaatcactgaatgaggaattagaacctccctccaagctttcatctgattgcataccaacacataacgaaggacatgatatatttacagtagctaaagagttaatctttagcaactctgcttaaaaatcctaatggcagactgcccatcattcttttagacagagcttgtcagaaaaactagggcagcttgtccagctcagcagtcaactgattactagtgaactcaatggggctcccagccaacccctgagattgctgccagccccttgggtattcaaaggccaagttccaatgtggtttactttgccagaatcacatgatgtcagtgctattttctcctgaccagaataaccagtcattcaggttactgcaagtggtatcggtgaactaggcatcacttcactgttagaggtcacatacacaccaaggctctgctccttctcaccacggccgaggggccactggagcctcctgcaggaggtcagctaatcccagtttgtcagttccagccacccaaatcctgcacgggcatcctgcacaccgcagtctgctccaaggaccaggaattacacaggcgtgctgcacatggcacacttagagaacaaaacaaacaggtccaacttttataaagaacaagctggagaggaaaacaacagaaaactggttttggctttcacttatattatattactcgaggtttagtaggcaagccacacaaattctgtgggatttagtcaccgttatccacctatgcccacattctttgcatggtagtaagacattaattaatttttacatctatcaggagatttttcagttgctacaggatttgcaagggtacatgcatgtaaggagtagccagtttttaaaactgtgattacccttatctttcggtgagagaaagtatttcactccctaatgcagagaattaaaaaacaagatccactttttaatctttcttcctccagaagaaaatacaaacatcaggaatagcaaacgggctgatatggctggtggactctgttttcaaagtcttgaacatatttcccaatgccttaaaaaccttgaaatatttttaatattcctcattacttctatggcactttgcatttatttatatgaattcattttaaaaactcactttaaagagactaaatctttaaaatatgacatttaaaaatactgtagattttctatatcattatatttatagtttttcatcctttcttttttctgtcagtaaagtaataaagttttaactgctgagaaataatgggcagcaaggtaaagaagtgtcatgatttttaaacatttgtatttgttaaaaaaaacagaaactgcttcagttataatatgtaaaagaaaaagaactgtaatgactgcagtaactactattacgtaaaagacaatacatgtttcagaaataatagagtcaatgaactatctgttactactggatacatccttattaatattaccttggggaaacctctaagcaaagtgagaacaagatcacgagaacaggcgtcttaagatctactgatgcagctttacatgttcctgccatacaactttgtggaggaaaaaaaaataatgtctttccatctcctgcagcaaaatattgcacccatgacggtcacccgtattaaactcaggtaaacttctacaagaagtccatctgtcaaggaaattgtacagtaagaaaagactggtgatggatgcatggaaggaaggaaaggagggaggaaggaaggaagggagggagggagggagggaaggcaggttggtttctacaaagaaaaaaaagaccaaaaacaattatttttacatcaatgcttcataattttcattcattccatccatgaagaaagtttaagcagatctgcaacaacttcaaagccaatgttatcatgtttttcaatcaaaatcaggtgctacagttagtgttccctgatggttacagctcatctttgactattcaacatgtcttttgtcctggtcttttatttccttctcagatgcatcatatcctactgctaacataacatctttaacgaactaacaaatgtttgaaagaaagagacttgctagatacaagttctctggtgcaaagggactgagtggtcaccaccaattagattatagcgggataatttcacagttctcgagatgattgtttcaaggaaggctggaaatgtacagaggcagaatagcctggaagtgtgtggttttctctaagcagaccaaaacagcccacaaaactcccagaaggaaaaaagcaagtgagatttcgatcctttggcaatgaagaaataatgcacaaataaaatgttttagcctagcacaggggctcacacctgttagtcccaactacttgggtggctgaggcgggaggattgcttaagctcaggagttagggaccactctgggcaatacagtgagaccccatttccaaaaataattttttaataaaaaaaagaaaaaaatgtttaaaatgaagttgtcagaaatactcttttgagactacgtaataacctgggtgctgcctctaggtatctttgcggaattgttacagtaagtaaaactctctcaagccaacattcatggctctccatgaagtaatctctatttatttttttcacgtggcctccagcacatcatgggtcttgtattccagctacactggataacttcttgtacattttcctgccctttgacttttgctcatgctgttcccctggtctaaatgcctccccagcacttgacaaaacccgtcttttaaagtcagttaaaaacataatttctcaggccagtcatggtagctcatgcccgtaatcccagcactttgggaggctgaggcaagcagataacttgaggccagtagtttgagactagcctggccaacatagcaaaaccccattctagtaaaagtacaaaaattagccaggcatgatggcacacacctgtagtcccagctactcaagtggctgaggcataagaatcgcttgaacctgggaggtagaggttgcagcgagccatgatcacaccactgcactccagcctgggcaacagagtgacactgtctcaaaaaaaacaaaacaaaacaaaacaaaacaaaacagcatttctccataagatgctccctccacccctagaaccagatatgagctcctccactgcatctcagtagcttcacatttatacagtacttctcttaaacactgacttgatatgggcttgcgttacttactgatcttatccctccaccagacataagcacataagcatggagacacgcatcttcagggatgtgcactcaataatcgtttgctgatttgaagtgaaatgatgaggctaatttattttacagtactcccgtgcactggttctctaatagctgctcaaaggccctccactgatccaaaagcccatctgctataatattagtgttaataatgatacataggttcctgagataaataatttaattatcacatgcttattagggtctcaccaagagcagagccatttacctctttatttgaataagacttctgaaaaatgctttgtagttgggattctgtgtgtgtgtgaatctatgcatgtgcatatatgtgcatttacaagcaaggtctagaggcctaaataataataatgatcttttgctcctcttcagtgaacttcagacaagtaccttaaagctacaagctttaaagtattagcttatgaaagcgccaaccatgcttccaaatttcaaaacaaaataaccttcgctaagtcaggaagatcacttgaggatgggaattcaccaccagcctgggcaacatagcaagaccccatctcttcaaaataaaaataaaaatagccaggtgtggtggcgcatacctgtagtcccagtttcttgggaggctaaagttggagaatcacttgagcccaggagttcgaggctgcagtgagctatgatcacaccactgaactccaacaaggatgacaaagtgaaaccctgactcaaaaaaagaaagaaagaaagaaaaaagaaacttggctgaaccatgaggagttaacacttggacattttttgattctgcaactgtaaaagaatcttgctgaatttgttgaacttgtgtctctaacagattactgacatttccttaatgtaagatcacctggggattaaatctcaactgtagcacatatcaatgactgtgagcatctgactttaccttgttttacaattctcatgaaatggatgtatggtcaatgactgaggggatgataaactttatattaaccaaacatgatataaaaatccagggcatactgatgaccagatatgggctggtaagaattagttctaatataacatggacatggacatgcttcagtttatataaattgctctataggtagtgacagattaaccctcctaacatccttaaaaaaagataataaaagttattattcacttttattgatgaaatacttggagtgtttagactctcacaaggtcactataaataaccttttaacaatccagctcactgatgagtcttggtgtgttttgtgaagcactcaactgactgtgagaatcacatataagagaaatgatcaaatagcctgaatgcctttggaaaacattgaattcaactctgtcctgctccagaatccacacactatgctagcatagtattactgaagcgcaaaacaccatgctagcatagtattagtgaaatacaaaacactgtactcaaggcacctagtttaaatccaccacctattagctgtgtgatcttgagaagtcccttaattctccctcatgtgcaaagggaagctaccaatggtgcctgccccacagggctattatgagtataaaaatgagacattttatgcagcttctgttttaccaaaaatattcattttgacccactttttctagaagcctctccctctaacaatattcatatgtaaaaccaacaaaaacactaatcaaattccagagagattgaatttcagggtgagggaggtcttactgcatttttgccttaataatctcagtttcatctttcattccataccaaaacatggttacagggaaactatgttctaagaaaaaaaattattaattatatacccattctgcacatttagaaataaataattttccaaaaacttttacctagacaagaacccctccttacaaacagaagttttctctttagaccaatttcactgctaaccataaagaagaaaacatataagtaggatgagatagaagaaaaatcagaaagcagagaaagactaattagaagatagagaaaaaaaggaagaggagtgaaatataatattcatattctagctgccaatccactaacttccaaaaaggaaagtgaatatgccagaccattaaaatatttcagcaacactagcttgtttggcagtcagagtctcagaaccatgagaatcacagttacttaatcactgtgagctcataaaactggacccaaagtgacaagaccattgggtgagaagggtgagagggagctgagcagggtgatctgctccaacaatgcaccagttccagaggtcctctgcagaacttgaagagacagcacagcatcctgaggccgttaacttcctgactcctgcctttgaaatagaaccaggaactgagcttccatggcctagtttgacctggctttgtcactaccccagttctgatgagattatgatctgctaccctagaactaagcagaggtgagagccaagatgcctttctatggcctagagcacaagaagggcccacatagtaacaaaaacactgtcacttttatggattaggcagtattgcctaaaggtttagcacccaaggctttaaagccagactgtcctggttctaaatctgactttgacacctactaactgtttaaccttggttaagttggttaacacagaggctcaggttcctcacctataaaatgaggggaagtacgaggttactctgaatattaaatgagatacacatatataaaactgagtatagtcctagaacatggtgcacacaaggtgacagctgtgccttattacagctactgcacagctgaaaaaaactgtgaaacactgaaagtcactcttctacaagctggatattagactgtgaattccccaggaccagcaaaacccagcattcccaatgcctagctcagtgctgaatgaacaagagagaaaacctcaaaaatctttcagtaatagaaagataattctggacaggtgcagtggctcacacctgtaatgccagcactttgggaggccaaggtgggtggatcacctgagtcgggagtttgagaccagcctggccaacgtggcgaaaccctgtctcttctaaaaatacaaaaaattagccgggcatggttgcgggcacctgtaatcccagctacttgggaggctgaggcaggagaatcgcttgaacccgggggacagaggttgtggtgtgccaagatcgcttcacagcactttagcctgagcgacagagcgagactccatctcaaaaaagaaaaaaaacgaaagaaagaaacataattctaagactaagaccaataatgtgccagctatggtttccttgtcattgaatttattaatataagtaggcagaattatttgttatcatgctaaagaaaaaatgagatttttttttaacggacaaggttttcttaaagcatcatatcagtatctcagtatctcctataaatagattttgtttaaataatacaatttactaaactgtctgagcagtgtggacttcccccatatttatgtttttagtggctgtagctgttgtggtggtcaaacattgagtgttcttttatgaacatagttagcataaaagaaccttttgatgactcgtattagaacatgaatttaatagaagcaaaggtactgcttatcatcactgagaacattcattcagatctaccacagttttataactgctctgatctaacagagcaatttattccaacatgcaatttaaccaataggctgtttaaccttggatacttattagtaagggaacaatgctttcaggattatgctgaataattcagcccttccagtcaaagaacttttgctggtgggtgagaacagcatgttgtctaagtatctgagaacatttctacacatctggagtatgtggccctgtgctgcctttccaggcctgctctcccagccagaacttcttctgccatggggcaagacagtggaatagaactatcttataaacttttttgaacaaagacagatgatgttgcactactacattccctgtgaattctttctgctgctgccaacttatagtatttttaagtttgctcctaggtgttttacagtagaagccattccaaataagattttgctgaaggttcagcatgaactatgcaactactctgagaaataatcccattatttcaactgtttacttttccattataccccatttccaaaatacgtgcttttaaaagttttacatcctctcttcataaatcaagttagtaaggatgtcattcctttttaaagcatgttgcatagaaacattataaaaacaaaatacataaacacacatgtatacgtgcacacaacacacttgctcaacttgaaactgagccccaggactaacaaacacacagtccagggctctggttactatgccttctttctaggatctggcttcatttggaggctcatatcccataccagtgctcctcaaaccacgttctaaggtccatgaaatattaataatagttctatggggagtgggggagtggtataatcaaatttgtggttttgccttaggacaaatctgaatcataagcacataaggctcgtgagaatctctttggtattgagtgaaccctgccaactattcaacattcacatctcattcattgttacatacaaagctcatgaagtgataacatttctttgttttaaaaataaaagagcactgaaaaaagaagtcaattgcttgtggtggtgatgaaagtgaagagaaagtgaaaaggcctaaggaagtgatggttcttggaagaatacagatgtctaggaaagaaattatactccaaagagctacctgtaaatttagaaactcatcattatctctggacaaatctttcataaatgtcaaagacctgctacatatcaaaatggtctaagttcctaagcatcatagaaataaactggacttgactgtggattctacttgagcaaaagatcctatggctgagtcttgggtatgaagagggagaagtttctcacataagcatgggcccatggggcttagactctggaaagacagctccaggggtactgccatacattgatgttggcaggatcttctgtttaaaaggtattggtggccgggcgcagtggctcacgcctgtaatcccagtactttgggaggcaaaggcaggcggatcacttgaggtcaggagtttaagaccagcgtgggaaacatggtgaaatcctgtctctactaaaaatacaaaaaaaaattagccgggcgtggtggcgggcacttgtaatcccagccactcaggaggctgaggcacgagaatcgcttgaacctgggaggcagaggttgcagtcagctgagatagcaccactgcactccagcctgggcaacagagtgagactccatttcaaaaacaaaacgaaacgaaacaaaacaaaactattggtgaaaaacagatattttagttgactggggcttaatgctgagaagtaggcctccaatacaacctgaagatggattcgtggtggtacaagtttgccttctgtgagggtctggaggaagcacttttattaacaggtgccaagtagaactgctgggtcctgaaagaacctacaagacactggggtgagaacacgtagagaagagtccaagtgcactgagaaaagtgaggcgcactgacttcagagaatggatctagtttctttcctgtcagtgaaaactgaagctcactggagttctgagacagcctctggtctcctggtccaccccaggatggctcaatatctgtaatgcagaggctgaatatgtataaatgcagaggcccaatccaagcactcactatgactcaccaaggacactatgaaatgtgaccaaagtcttccagacaaaattgcttttcagtcatgtaaatatccttttaattcatgttcttacttagtttatgtagcttatgtgaaactcgtttgtcactttctaaagatttacttttgtcggactccaggaaggattgtctaacttttccctaaatctcatggtgcttcaaataataggaacttttccctcctctacggttttgatttcccatggaagacagccatttaggaaagttacctgcatgcagatatatgcacagctaaggtaacatggaggtgtgccagtcgagcatatctgaactggccactgtctacctagagtgacaaacaaaatgtagaatcttgcaggatagctcagatcctaccatcttgacaaccaatcacagatctgtcttctatactgggttcaggcaaggcagcatgcttattggcctatatggggcatggattggcccaaaggacctgctttttctgaatttgaaggcactcagttcagggagctacacagatggtggcaaaaggtagccacatcattggttcttgcctctccatcacaatatgtcttagctttttaatagcaagaaacctgtaggtatactaaattggtggaatccaggaaaggaggagggaaaaaagtcaagacaacagcatttaagactgaaaaggggccgggcacagtggctcacgcctataatcccagctctttgggaggccgaggcaggcagatcacctgatgtcaggaatttgagaccagcctggccaccacagtgaaaccccgtctctactaaaaatccaaaaattagctgggtgtggtggcaggcacctgtaatcccagctactcaggtggctgaggcaggagaatcacttgaatctgggagagggagggtgcagtgagccgagatcataccattgcactccagcctgggcaatagagcaggactccgtctcaaaaaaaaagactgaaaaggcaaacttgatgaaaaggaagaaagaagaaactcaaaagcagtcacatctcaaaccttttgtttgaagataatatataccattcatatcacatttcagcccgtaataaggcagtgtagttgagtccattgtaggggccaagggaaaacatcccctttgctctctaaaagtttgttgaaaattaactcacaaaaggcagattaagaggagaaatggcatataaatttattagtgtgcaagggggagaatgcagggatgactgccccatatcccaatggggtacagatgcttatatacactccttcttagaggaatgggagatggggaagtctggatggttttaaggggacagtaaatgatttttaggggaacttaatgaacttaaagtggcctgggacaaagtctgttgggcccacacagcagacaatggtttgtgacaaatgtctgtccagatgtgttgacaggcttcagtgtttctttacatgctatgagctcagttaatggaaattcggggaaggaaccagagataattgttttattctttggtgcatccgaacttgaggcagataagggaacttcagggaacaatttcctcctttgctttgggagagacagaggattgcaaggcaggaggtggagggggtacagtgtcagagagacctaaggctgcttcttcagctcagcatgtcaaagtgccacattttggtgtatcggtttctgagccctgacactatcatgtcacttttcacttatctacacagggcactaagatgcactgcaccggccctcaccatgactcctccctcttgctgcccttctcactccaggctcctaaacacaggccacctatttgatgggatatttcaaacctggctttgattgtgagggtcagtttggcatacaggtgatttccttgtagattaagaacatttactttcttcctgctggatccctcccagagataccatcaaacctctacctacgcaattagttttcacaggtggctgttttgcctccagtaaaactactttctttctccttctgcaagtcaaagcacagcgaatacacacgaaaacatttcagatatgaaataaacatgttcataaaggcagctatgatgtaatgtatcatttttgactgatccaaattatggaatgaactccccacaccaggattaaagtgagaagaatcatttctggaagaaggagcgcaatgggattgtggtgggctgaaggctagaaaaaagggttagaattgagacaaggaaaaggagccacaatttatgctggcttataacggctagggttttctgagatgccttctcctttcgtaaattctgttactgttgacaatcctaacttactagagacagaaccgacagcggagaaagaaaagatgttcatacgcgtcaagagtcactggtaaggcagctgtttgttttttgtttatttgtttgtttgttttttgttgttgttcctgctgcaccagaccagtttcaacatgaaactggcaagttttgagatgtagctgtttctctggtcctttttctagtaaaaggctcccattttagaggcagccatttccaaaggaaaaaaaaattcaatgtcgacataaatcccttgaactaaacatctgtttaaactgtttctaggtcaggagtctaaaactgtgaaacactaggggtgcagacatgatttctttcccaaggtctccaagtactgcggcatgcacatatcctgccatattgtttaaacatctggctcacttccccctaaaagaaaagggctgatagggtgggttgttatggctttttgtcttaacctataacatgattttgttatttgtacagtctctaaaacaaactactgttaaacaaggttttttttttcccttactgcattatttaaaggtggatgtttcaatggcatttgaatagcatgaggggattttttttttttcataaaagctacgaactcaaggatgttcatgaagaaatagtttccttcagttcttccctatgaagaaaaactcttccagaagttccactttcaacattccccttcattaacaaaaccaagtacgtactcttgtttttaaaagtctgtttccatacccgtatttacctgtggaaaaagactgtgttcaaaatattaaaacataaacttattttaaaaagatgcgaagtggagagagttcaagtgcagctttcccaaaagcctggctcaaaccctgtatacatatggaattctgcactgcgacctcagaaggatctgagtggctatacacaggtttgccatctagattcttcacctttactactcaaaatcacccaaataatttgtgtgtgcatctgtgacgaagaacagttatgagcctacattatcaaattcagaattggagtttagggatagcaaaacgaaaactgagctgcagacaaataaagtggcccattcaataaaagtgaaagtatatggcgtaatccgtgaaacccaaatatcagggtttgtcctctgcatctggcagttacttatcctcctcgtacaaactattactgctcctgtgttatgtccatgtctctcctaaaacttgctggaggcaaaaaagcaaccctgaaaaagttcccagtttaagtgagaaagagtgatttcactgacagggcagaacaattgcccatggttgtcaaatataataaaaggattagagttttgttttgatttattttaatgtacaaaggaagaaaggagacaaacttcaaaggttttgcctctagcccagacttctggcctcagggaaacaaatttcctagtgaatattacagaaatatagaaacgactatttaaaattgaccaaaaaaaaaaagcaaatagatatccctactaagactagatacgtatttcaaaagtccaattttatttttccttcctctctgttactaagagaggtggttcaatatccactcctggccttacttcacctgcccagtcaacaaccattcttttccccatggaaggttatttctatatttaggtcatttgttttttaattcaaaagtacgtgcccaataaataatgttctaggaataaagaaactgactaaaggaagatactattataaaaatagaaaccaaaggaacccctactctctgtgcatttaagagcatttaggtgagaaaaagacatattactgtggtttctttaggaaagtaaaaacactcaatgatgaatttttatctatctgaggattacccagattacagtaagacaaaactttgcattaaccattcaaagggtccgatctgctatatgtcccctacaatattaagtacatacttctttcctggatctgttcttattttcaacagactctatttctagaatgtagaggagaaaaggatttcaaacagtctggaaaatatcatttttaagttccaatcagagaacgttaaagccaataaggaacttgaaaggaaatctgggctatcccccaacctaaggcaaagccacactgatagcaacccaagcagataataatctaatctaactttaggataagttaggttccgtgacttccctcttaacatgttcctgtgcctgacacccgtctactcatgaaatttcttttcaagctgcagcctaagcacattcagttattatcaacagtgttaagtgagtagaaagagattcaggggacaacatgagacgctctgcaagatcagtcatgagaacaaacccaaagacctactggacccgaatttattgatctgggaaaggtatatctaggtctcagcaatgttctttggatcaggatttggagaaaaggttgtatctaccactatagattggatattatatcctatttgcaactaggactatctatctctctataaatgatgaacagtattcagctacaacggaggtgttacagactgaatgtttatgtccccccaaaattcacatgttgaagcccaaccccaatgtaggcagaacagggccttcatatttggagataaagcctttacggaggtaattaagattacgtgacatcataagggtggggccctaatatgacagaactagtgtccttatcagaagagacaccggagagcttgcttgctccgtctctgccatgtgagaacacaatgagaaggctgccatctataagccaagagaagaagcttcagaataaaatctaccttgccagtgccttgatcttggccttcccagcctccagtgaggaaataaatttctgttgtttaagcaacacagtctatagtattttgttatggcagcccaagttgactaccatgaacaccaatatgttgaccaccatatccctctctctgagacagcattcctctcccttctaggatgaattcagttattcacttaacaaacatgtattgagcatcacctatgcatcaagcattgagctacatgctagagacacatttttcaatgagtttgcagtgtagtggagagaaagagttcatttagcaataagcaattctagcattctgtaatcagtcttatgttagggaagtagaaagtactacaagagtccatagggggaacagccagcttcaacaaggggagatcaacttactgcaataccaaatgtctcagatgggccctgaagaatgaatcagaactaattagctgaaggatgggatggtcaggcaaagggagaggatgtttggtgtgatgacagtaaaaaggtcctgagggctgaaagatgtgggttcctctcccgtactcactcactgtagacctctctcaagggtccatctgtagccctcagattccctcaagaagcaatcccttccttgacagctccactggcttctaagtcttcaataacacccaaatctgcattcctaattataaccattcccttatgctcaaacactctttttaattgactactagctattgcagcagggcatgtgatctatggcttatttaaaatccaagtcttagccaattgtggtgactcgcacctgtaatcccagcactttcagaggctaaggcaagagggtcgcttgagtccaggagctcaagaccagcctgtgcaacatagtgagacccccatttctagaaaaaaaaaatttttaaatagcagggtattgtgtcccatgcctgtgattccagctactcaggaggctgaggcaggaggatttcacgagccagggaggtggaggctgcaaggagccacggtcttgtctctgtactccagcctagacaatagagcaagaccttgtctcaaaaaaaaaacaataaaataaagtaaaacccaagtcttcatgcttccctcggatctcctcttcctcttatatgccccatttttgtggcccatctcagcattgattcagtgatgcagtcatcttcccctcctccctctcccttaccctctacatctatcatcaccaagttctttttcctcaatatctccagaatctatccattcctgttgtttctgttctcggtcagatcctaagcaccaaatctgaagaatgatttttattgatttattattacaaataatgacttaatactttaattaatcaaaagtttcaataatccactaatataaaacaaaatgcaaaatccaagagatgaaagcagacaggcagtagaaaattcacagaatcagaactggggaaaacagacaaatgaaaacaaattttgggctgtgagctttctagcatacagggaaaagaagaaaactagattgcatacacagttctcatcataagatgaaaagaggcatgccaacttatcagaaaaagaaaatttgtttcctggaagggatttttcagagaaatatattgcaggggagttgaataagggacactgaacacataataggaaaaaggtagttttatacaaaagcaaagatctgcatatggatcttttacatataaaatatttttaaatatttaattcacggtgaagccaacctaaggttaaatcatgattccacaaaagtagtctatagaggaatacagcaaaatgcttcttatagatagctttctgataattatgaaaggttaacctgtccctgaggttatctcaataaatgcaaatggctcaaagggccttttaaccaaagctatattcataactgacgtcacaaatgagtactgaaagtactaggaaactgggttaattctcatcttttcctatttcatttcctcagaaagactttcccaaaagaccttagccaacaaagacccccataccccattttcactttaatctatgtattatctatgaccctattagttttctcatagcatttaacacaatcggaaatgacttgcttataaatttgttgaattgatttgttgttccctgtgaatagacagtgagccccctgagggcagagaccatgtctgtcttgtacgctactgtatccaaagccattaggaacatcggtggtatgacaggtgctcatttaaaactttacaacctttcaaatgaataaatacgtagcctgttttaggttctaaatattcagggctgggcgcagtggctcacgcctgtaatcccagcactttgggaggccaaggtgggaagatcacctgaggtcaggagttcaagaccagcctggccaacatggtgaaaccccatctctacaaaaatacaaaaatgtgcccggcatgatggcgggtgcctgtaatcccagctgatactcaggaggctgagacatgagactcacttgaacctgggaggtggaggttgcagtgagccaagatcacgcctggccgacatagcaagattccatctcaaaaaaaaaaaaaaaattatatactgtacccaaaaaatatggagaagacaaagataatattttacatgaaaatttaaaagcctggcttaaaacgacctcctcccttcactccattttcttccttcattccatcctccactttgctgtcagaattgtcttctaaaggaccacctaaatataacagcttgaaagcttgatgatctaccctctggaaactctctaatgtggcatttgaagccctcagcaaccctactctttcagcctagtctcttacaactctcctccacttcgcctacacaggctaaagtctagtcaccctcccctgatggttcatgacccccaactaccaacatgctttccccatccccaatgacttaccttttcttgtgctgtttcctgcctccaggacccccatgcctcacatcctcgtctaacaaaacggtgctcatctttcaagctcatttcttgagtcatgagaaccttctttggattcttgtgaattctgaattgcctcctctgtactccaatagctctttttatgtatctgtgtggcattgtctactatctgtttcatatgaattaggtgcttagttttatgtttctgtttccactgctagattagattagaaactccttgagaacagggattacttcattggtcttcatatttctctaacctttagcatgctcctagacatgtagtaagcacaaaacaaatgttcactgaattagacatacccaaaattagaagtactaaagagatattgatggtgacggctttgggtttcaattgtaaacagttgaagacctaggtacagtacaaccatttattaaattacagatagtatcaatctccacttaccactaactgtgccttattagcaattgtttcatgtagtccttgtttcaggaaacttatttatgttctagtacatatgagtaaatatacattttaaactttttttttttactaacagtggctcatgttacgaggtcctctactatattaaaaacattttaatagactttgtccacagactgaacttttactttttaatgtgatatcacatataataccacatctcattctctacagattctgaaatgattcagggacttttaaatcagcatttgccaataaaaagacaaatttttcaaattctgcatcatatgtaaaactagctctttttcctttcctttttttaacattacagaagacctaaaaccttatatttgatgaaggttctaagtacaaggatcaaactataatcgtgtcatttcttcaatactttcagtactgctccccgaccaggatttagtttgccaaattacgacatcattttcaaagtgctactaatcaacagagagggcaatgaatgaattcacccatatacatctgtcaggctattgagcgataaagcatggtattgagacatatgtgttcttaccatctgcacacattacagcaatgcactgcacacatatatgtctgaacctaatgttacacgtgaaaaagaaaagcattcatgccaaccctcagtacaattcacatcacatcagttctacaattggtggctttatgttactctacatatacctatatgtcccgatttttttttcttgtgaaaaatgattaagacacagaatcagatatactctttaggagattagcttcaatcttatgctaacaaaatcgcagtcaccctcaaatggagttatggcaagcaaatttgctttctcagaactcataatttttactttactcctctgaaaactacagagcggcaaggaagttgaactgaataaaaacaaaatggcaagctatatatattgattaattttacattatatattttggaagggcaaattcattatttatacaggtgctacctgacctccatccagcaagttattcattttaacctattaacaagcacactataaacaacaatgaaagttacatgaccttacacagctgtctcaagccactgtacttccatcattaaggaaactgttagatgaccctgttgtcagaacacactaaatctgtctgaataagggaaaacaaaactttgtctccaaagggtaaaaaataataataataatcctaggcagagttcctgttcacactgtacagttactattattatttatcatttcttatttacctgtgtttttagtataaacattcctggaagcttttatactgcttgtggcacatagtcagttgcttattgccaagggaaagactttttccccagaaaggcaatctgtgcacatgctaatttgaaagacagggtaggagctgcaagtgttttaatagcccattatcaaaaattatcccttggctataaaatccccagaccattggcttgagatcagctcaaagaaaaatgagattacagaatttaatctagtgaaggggagtgagagatgagttctaaaaagccttagatcacaaaaaaaaaaaaaaaaaaaaaaaaaaaaggcagaggacagaaacaacatcagcttagattaaaccttccacacatttacctcctacaaatctgacatgttccaagactgattttaattttaaaaagtaaggtgtctctttgcaacattttaataagtagggaatgctcagtgaaaaattacatattgaggtgacaggaaacaaaacagcattttgtcttaaatttgcacaacctaatttatagcaataaagcagaacctatgagttctggtaaatgtcagggcagtcatgtccattacatatgtggataggtatgaagctgagtctccgtaggcccttcaaaaattgcacacagccgccctaatgcaaaccagaagtctcaggctgctggatgaacactcagattcgctcccatgtggatatttagagagggtctcctccacccccatccccattctcacgtatgcatgttttaagagaccaaccagaggccataaccatggaggtggctcattagaagagacctcccaccccaacaaaatctggcccaaccccctgcaaagaaagcaccagcgtcccatagaacctccccctctccccctaacctctactctcttacttctcctcccccttctcctcctccctccccacacccctccccatgagcatctgcctggcccaatctcgcctgggccagctccaataacaacatctgcttggcagcttttcaagcccacggatagttatctaactgaggcttttgtgctgtactgtttattctatgtgaagaaatgcctccttagttgaaagagtactttagaaaaactgtgcagctattagcaagtgaagcacaaggctaataacccccacctgctcatcaaattaattatgacatctgagtcattataactcagaaagaaaacacgactgcagatttgtcacatgtaggaataaacatgtattaggaccgggaaaaaaatcagaccaagagactcagctggacgaaacacatgcttccacctttcagagactggaaatatggatcctatctttccaagtgaaactgacgaagagggatgaggtggttggccagataaccacactgctgttacatggagcaaaatgagataaagtcagggattagggaacctcatggaaaacactgtaaggttgaataataatttatttagaaaaactaaaactctatacaaagccatttcacagagcaaaacaaaacatactgcccacaatgaacgtgaccctgtgtcatctggtccatcttaaaaacactcataagaactctgggtagagaatttttgtccctaggtacaaaagaatattttaagggtgctaataactttagcaaagaaataccttagaagtaaaaataaaaacttgtcatgaagttattgcatttcctaaccatgagtgcataagactagtatttttaaaaggcaaattccatccagtggccattaaaaaattacatttaatagtcagacatgtaacagtatatctcgtgatcagtaacattttgctaatatttcatactattaaaaggcgcaagtttccattatacgttttgaacaaacttaaaatagctactaacctcttttttcccccacatatttctggaacttgcaactatagcatacatgttaaaatatcttactcccaatttttcaatctggctttttgtcgtaattttaaaatgcaagtaaattttaataaaggtaaaattattttaaatagaacatgacttaataggatgatgacccatgcaatagagccatgacatttttccttgccattattttaaaggaaataaattataacatgatatttgcatgaatcataaaatgctatcatttaaaaacactcctactgaaaatgtttgcagctataaatttaaagcctcttcatcttcctgcaatatctttagtattaaaagaactttttaaattcttttctagcatttgtgctgccagtttcataaaacataaatccttctatgaaagcatatgactcttgctaaataacatcggcctgctccactttatcttctacctccaggaaagtcatccacagtagcaacagctataatcaattctcgcaaaaaaaaaaaaaaaaaaaaaaaaaaattctatctttttataaaagcaaaacccccagaagagttaattttaaaacagaacatgctacatttttaaatcctttgaggtttaatatattatgaaagcaaatctcaggaagcaatacaattagtcttttctctcggtaaacaattttgtgttagagtctaatgctgagttgatttatgtaaatgtgttacttagcctcaacttaagatataaatccagagtaaacataacaatggcaatcccgacagtctgctttgccaaatcagaagatttagtcagcctagactaaaaatgaattaagattatattgagagtgtcagtcctaagtcaagaaaacatgcccagccagggcacgccagggagaaagaagatcactcattaacgagccagcaatgctacaaagcttttgctcgtctgggaaaacatgttcccagttttaaactccacagcaaatcaaggcactctttttaataagtacattttccgtctctttccccctcatcaatcccaaaaagaaactcagcttctctgtgtattatctgtgtaactctacatgtcaaactacaataggccttgtatcctttaaggtaacatgggccagtgtctgaggtggagtggaagactcggggctgtggggagttaatgcctcccttctcaaaataactttcaagttgtctattaacaactagttcccataattacatattaaatttctttaccatgataggttacagttatacatcccaaataaatctgactgtggagtacctgccggcagatttctgtctctgtttccccagacacattgacacacagctcagagacaagctggtcaggcacgctacacagaggtccgtctgtcctcgcctaaaaagtaaataaattattttgtgaaaaatatccttagcaaggatcagtattattgtcagtgtgactttaaaattctaaaggcatgccagaaagagggctacataaaattcagcagtttccagatcatacacagtacagagattctcatacccacttaatctcagcacgcatctccacccctacttccttcccaatggtatgtggtcttgaaaacacaaatgttcacgtttcctgaagctgagctgcaaaggaaaagtctcctcccaagaggcagagctgtaggcttttggtgcccccgaaattgttcactacagtacaacataatgtgacactcaccacaattagccacagggaaacagtctttttttcacctctgatgtcatataatagatttgagatcacatcagtgagcaatgttatctacaagtatttttggaagtcttgttaaaagagccacgatactgcaagcctaacttgaagtgtaaatggtgaatgcttctctatatctcatcttgaccactactttactgaagagtgaaaaatgacagatgcaaattatttttcagaaagtagacatttccactggtagttcttcctcctaagtgatcttttcttctctctcatgctctaccccctttctctctctagcattcttcctccctacacacacacacacacacacacacacacacacacacacacgaagacatccattaatattaagaacagtcttccgtaatgtttttcagaatttctcaggggcttaggagggcggcagccgtgccaaaattacaagctttcctctagtcagaagggatgtcttttcaaagcccagccctcatttttcagtctgatgtaagtaaatttacctctgtgtgctgggctgagcagcttttctttgtcgtttttgtttttctaatagctgctgctctggcagagctattcatttcaaagggaagttagaagcattcttcactcttccccttttagattatttgcagttactgactcttctgaaatcttagatttgaacagaaacctaaagcacagcaccattttaaaacagcaaatcaccagcattcctgggatcacatttctctagagcaactatccaacatgaggcacaagaactaagtcgaactgggctaaaattgacaaaattaaagacaaaagaattatctcttttaaaaattggggcctactgtgctctgacagcatgctaaaggacaaccatcgtttggaaacattgtttcagaaccagagaagaggtggtggagttctgtttgccagttagctaaattaactgatttcttaagaaatccaagtgaactgtatagtaaggtggtcaatttttggaaacattgtttaggcaacagataagagatagtgaggttttgttttgaagttaatttacttcatgagaaagtcaaatcaacagtcatagaccatgaagctgataagatctatgataaaatccagtgggcgaactatcagtaagttcttaatttgcccacgtcccagtgtattcaacgggcttcagttggcaatggctggaccttgctcttgttacttctgaagggagttgttttacgtggacaaggccaggatcatggtctctgagtgctccaaggggttaacctctgtgaattctacttctgtgtcacatatttaaatgagtaacttagagttcaatatctttgtgttcaactaaagtcaacttcttctttatcagccaacattctcttactctaatcgttgaacacacttgaattcatatcagttctgggattttcgtaaccatcaatcataaagtcatagtaagaagaagaataaagcgatatcagtgcagttgaggcaaacagggaagaaaaagtgcacggcgccatggttaggatatcatgccaggctaggaagactctcattaacatctcctgagtcatcccattcacaagcagtatccttgaagaatgatatctgtgtatataagtgaaaaccctatcacacccaggggcttatatccttggcatcttaatttcctagttgtgagtacttatctaaaaggacatgagtataatgctatcctatatggcatactaagaaactgatgtaaaactaagtctgcaggagaaaagagatgctacattcctgtggcaattttcaaatggcactaaaaatagataaatacggcagtaagaactaagtccctcctccctcacttccctatctctatttttcttttacatttgtgtgaattcagtaaccataatctatctaatcctattatgccaaaagactaaaagttgttgatgttcaaaactctaccagtataccaaaaactctgaaactaggaaggaaaaaaaaaaaactttcttacccttaaccaaaaatgaagagtctctcaagcatatatggatagcttgacaaattaccaatttatactgaaatatgagaagatgttcactaagaattacatgactagatactgcaggggttttttgttttgtcttgtcaagcaaaaaaggtctaggtttgccatactccattttttggtatgaggtggtgaatcaagcacaaattttctttggacttaaaacatttaaaatgcagtggaaaaacagttggggaaaagatactgttcttaatccccagatctagactatctgttggggtagttgcttcccaatcctattttctcaattgtaaaatggaaacaatatcttatccaattgaaataaatattaaataagatactttaaacaaaagataaaggtgctttacaatttacaagtatgaggtataacttaaacagctaactggaagacattaacataatctacatagaatgaccttcagagcaatatggtttgcaatttaaggaatgaaaggaagataaattgtaatacaaatgtacctttctcagagaaggctgaaaggtacaacgccaaaggcattatctgcggactcaggcttcagattacctttgccacttcctacatgtgaaatactgggtaacttattgtaaaattctgtgagctctaattttctcatctttagatgagtaataataatatctatcttgtgaaggttcctgcaatatttaaataaaatactacacatagaagtatctgactttaaaaataatattcatgcgagggaaagctgatcacacgaaaggtttcttagggactgtttgccttccatatctgtcttattaatatagcttcatgcagtcacctaaatatcttcaagtattgtaaactgaattcagattatgtgcttttttaaaaagtacatcttttctatatcaagcagaaatcaggccacaaaaaaatacttctgtaaaaagcttaggaaagaataatttttcaattcaggaaatttcttcatggtgctacgaagaacttttcttgtactgaactgctatttgtgatccacctgttaaaaaaagctcaaaacacatttcaaaaacaaatagaatgcttaaactttcttaaaagacagaatgttttacatgttgtattttgaggagattttttttaaataacaagtttttacttactcatctttaaaataaaagagaaagtaactgcccaagaaacagccttatcttttgctttctacaattcagaattttgaaagaaatcctcaaatcctccaaacaagtgtaatacacatggtttgctggcagaatttattccaagcatctccaggcaatatgcatgtgcacccgcgcacacacgtgcacgcacacacagacacacacacacacacacacacacatttttgaatcattaagtcatttggaagaatctccagaagtgtgccgaggcatgtttttggtgttttgccaaattatgtgcttctgtttgtggctttcaaatatggattagacagacgcacaagcatgtactgtttggcaagtagcgacaatggtctagtctgaatttagtaatttaagcttttcattagtcctcgtaggtgaaagaaagaattaacaacaacttgtttgagctctatctttatatccctttgtcatccattcctgttcacttgccatagattagaagccaaaggaatttcagatgtcctctgcagatagacctaaagtaagggcttcaaacagggggttcaaatgtcaagtacatttaagctggaacttgaacttttactcatccttactctaaggctataactctgcttttctgagttccccattgtacttgaacatccagtgtaccctccttttttctcacaaaaagtacagatagaaattacctaaagagataaaaggtcacttgagatttctgtttctcgtgacttgaaattaccatgcacaacagtagacttctacatggcaaagcgctcacaaagatgtttctgtctcctgtgatgatctctgggggaagctatgtccctgccaccctgcctcatgctgtagtcactctaaacttcagagaccagcatcttacgaccatgagttttggtgctaagttcagaaaaattaatcctaaactgtcacaaccatcctgatgaccagtatgtctttctaattagaatcaatgcagtaatcattataattggcagtccctccccagatcacgtggagaacaccatgggaagtgcagttgacttgcagtatttgatattttcttctgttggtaggtaaaagtaatctgatgtccaacagaaaagttcacaggaaccatgaggtaaaaaggaccaaatgttgacagtggtccattgttaattgagtcgtgcgaagctacagaaagattagtttatacagctgctgttatttgtcataacattcctaacaagatacacatgttcaatcagtcttattttgcacctccaaaactgggccatccaatggtctgaaacatgtggaaatcaaaagcaacagtgtacagaaggaagaccatgtatcccctcaggctgcctcaatggctgaggaaagaaaagaggcgagcccctgagtgagcggagcctagaatgtttgggtttggaggttagtgagtaaaacatgaacaatgaatgtgggcgggaagctgggacagaaccctgttagggtcattactaaggtataatgttattgactgttttgtggggaatttagacttttaaccccaccatgattcagaagcagtgactttcttgggacaaactgaaaaacgaactgggggaaaataattccagtcagagcacaaagctaaccatgtcacttgtccactgtattttccagcagtagaacttcacgctacttataaactacaggcatactgaggggaaaaaaatgtgttaactaactttaggaaactttcactcaaacacctaagctgaaagtccacaataggttcaatacaaaaacattatcagtactatctataaaacaggtgttaaaaataaggtgtttcttatcctcaggaatttttcattttagtgaggtagggagaaaaatatatgcatacacacacagagagagagacggacacagagagagtgtgcctacaattcacaaagccctttcacacacgttatcaaaatttatcctcaggagtgattgttaacaatgccatcattatacagacggcaaaaccgaagcacaagtcccagtcactggtaatggaaccaaaaatggaagccccgtcttcccatcatatcccctaccttttctacgataataagaggatattacatctactaatcactatgatgaaaaaagtacatcatgcctggaaactgaatcctgttttcaacactgataactagattctccaagttgtatccccttcccactactttcacacaaacattttacctaagacttgaccacctgagattgagaccttattaaatcctcatcaaaaagggaaattaaggctaacagtgatcagactgctccatagagaaggcaggtcaaaaggtacgacttcaaagaaagaccctcaaggcaacagagatcgatataatttacttcagacaataaaacataaatctaatttgaaggatgttgctcatctacaactcaaagcacctaagatattttccaggatggatatttatgggccacaacatgtactgctgctagtctgtatttgctccttctgcacactcctttcacactcttcatctctggttccttatcttattatgaactggttgaagaggccatctcagacctcaatagaaggtacacttaccataaagctcccaaatgtaaacaatggtcctgtaataatgatgtgaactcagaaggtaagaatgatgtttagattccttttgcatatttctcatctaaaacaattttccttccctcacatctttcgtgctttgattaaagcaccaaaacacaatgacaacacaaccagcgggattgctctgatagcagctgaagtgcccattccaatcgtattaacttgatccaagatggtacttcaaaatgacacactttggaaatgacaggtagaatccaggattttatttcccaggaagaggaattaatctgagtcctgtatatctagtttagtacaaagtctgctaaggaggttagtcctatcctggatcagcctcactaagccagcttaggggctgatctaaaataatagtttaacaaaatgcctgtgtccaaaggctgattccaccacttgctagttgtgtgaccctgggcataatttttctgttctttcgttccctcacatgtacaaaggagatactaatagatcttgcctcatggggctgatgtaaggaatagatgaaaatacgcacacacacacacattcaagtgtttaaaagagtatctacattcaccacccccttcaagcctttacttaaatgttgccttaccaaggaggacctatcctaatcattttttaaatacctcaatcttctctaaccctacactcacactttacttattttaaaactagattagaggcagtattttctatcagattagtgctcctgtggtcagtattcaatttataacacaccttaaaagaataaggcaattcattgactagtcttctcctgtaacaagtagctcccagggaattccacttccacaggagacaacgttaggcaaggggggactcaggatgacagctcagtgtgggtgcataggaggtgtctgtggttccttggaggatgcacctattttgtaaataatgaaatttactattttacgagtagtaaaatagggaaaagaatcctcaggtatagaaggtggccagggagactacagaccgaactgataactggtttccttggaggaagactaggattcttttatatgttatatagttgtgatcatttaaaaaataagactttcttataattttctggagattcattaaactacaatacttcatatgcaaaggcaattatggcaatacataagttacatagctctttgtgccacaatatgtacggtgagccaaaatgggatattatatttttctagaaaaatcatttttaccctctcaaatggttgtgagagcagcaaaaataaaaacctaaaatctgtattgtggttgctaacttgaaccatgccaatgaacattcaaaagattaatcaaaggcttgacagttgttaacagttcaacatggttcccataattatccaattaaacatataatgcaaataatagaagtcttatgggttccatagagcatgaatatcaggctgcttcagaaaactattaactgtaatgtactgtctgctgagtctgaagaaagtgaaaggagaactagtacatttataaaggaaggcaaggagtagaaaaatagagtggagagacacgtaactcaagcactctttatgtggtcatataaacacaacagacagtggtaaaatccagaaaacaaaatttaagtaacaattattgtaaaaccaaaagaatgtagagaaatgactttaccctataattcctactggctgcactatatccacagcatacttcaaccacacttttctagcttgctgctaagttagaaacatggatgtaattacagttgttggcttttgactctgtctataaaccatgcagagataaactgctattagtgaacataccaactccatatagttgtgttttgacattataggtaaaaacaatgagaaggaaaactaaccacagcaattataaacagcatgctccagggcatgtcaggtcacttatgaccttgactaaatgattataatccttaggttgtgttctcacacgttcacatgcacacacacacacgtgcacaccccacacgtgttttttttagggaaattaattcagtgaacataagaatgactaaatcccatatttataaatgcccagaggaacaaaaaatggatgctgcataggtcaaatatctgtactttaaaaaatcttattatatttcaaaaaaccaatgtaaactttaaaggaaaaactttgtggtaagtgttcattctaaaaatattctattccacagctctgtctactcagggggcaagaagaattgcagaaatttgattcagtacaaaaacttctgctactatataaattggatttaagttacattatttggagggcaatttttaaatatttaaaccattcccttacactgataacattttttcagtaaccattcaactatttacctcattttatttgctacagacagaaatgctgcattcatttctttttgtaaaagtcagtcttctcctcccctactaaagtggtaacaagcaatatcaagagggcaataaatatcccataaatattattaaagcatgatgttctcagataaaaaatcgtattgtgtttaatgacttttcttctaatatacaaaattatttgtacaatcagtaacagtagagatgtgaaaattaaaataatgttatattacacatggtggaccactttgcaaaagtccaaattacaagtgatgtgactttctaatgtgattactcacagaaatggcagttgataaacatagtctttagagtgtgctaaggtcattaaaacagtctcatctatttgcgtatttcttcaaagtgtacttttttaatgtgcctttcttatttggtcttcttaacaatctgatcaggaaggcaagagtagttgtcctttttacagatcaggaaacaggttcctgaaggagggcgactttcccaaagctaccagactaatgagtttctgaattaggccgcacagccaggtgagctcctcatgcagggcttcagacctgaacacctgggttcaaatacttgttcctccttttaaccactgttgtatgaacttcggtcatgactggctctctctttgtctgagaactttactttccatgattataatagcttccacataagttagttgtgagaattaaataaaacatgctatgtgatgcccttaacacagtcccaggcacatagtaagtgcttaataaatattagatgttgcggctgttgttactgttactatcatcttagaactactctggctaagtttggcaaggttaaaggattaaataaataaccacataaatatcaaatccagagattaacatttagcaaacattttagtgcacatttttaaagagattaacatttagcacacattttaaaagaaaacgaactgacataactgggtatcactgtgactccggactaggggctcttggggaatgactcgcatcagccattcttaaaggttttctagcaaaacgcttgtgtatttgtatcattgcaccactcactggacacaggttgaaggaatttagattgagaaaaactatgcaaatcaaaactgtggtaaaatgcaagcatactagtgtctgtatccactttatcttggggatcaaagttcctctgttttaactgccacattccatcctggacctaatagtttctgtgtaactaactggcaagtctagcatcttgactgaaagttcacagttaagggctctgacataatgtccttgaggacaatggactcctctttcagggcaagagcagtcctgatcatgctcagggctgcatgaactcaagttgatttggcctgagccatcactgctctttttaaaggaaatgaaatcagaagagaaaaatatccatattcacgttagggagcaaatatataaagtcagtatgtttaaatgttgtgcgttggcatccaggaacactcaagaaagctctgttgcttgtagctcactgagggacagaggaacagtgtctgtaggacaaacagatgcacatctaagcaagtagaaagaagaaacatttacagtagacaggaaaagacaaaccatacaattatttctttgtctaggtaggtaggtaggactacactgagatctcatgagagttctctaactctgcttcatacacacattattataaaatgtagcttataacccttggagatgcagagaagacccttttttaaaaaatagttttactggagaagtagtgggagtgaagctgggaatatgagctgggaaggggcagtcatgggttgaattctgactctgcctcttactagctttcggattggagagttattcaagatatttaacctcaatttctttatctattatttgatgagaatacctagttccctgggtaactgtaatcattataataaataattaatggggggaatgggacattttgttgtttttactattactaatattgctaccaattaatactaacataattataaaacagtaataataaggaggattgctgtctttcagaagagaaagggaagtcatttctggatctttccatacatcttctttctcactaagattcatagccttatctaagaagaaaatcaatctttgaaaccaaaaaaatgaatgtaatgtataggaataaggggtggcggaatttttgtcctgcaaacttatgatgatttacaaacctcataaactcttatctaaataatccacaaagtgagcactcaaaattcaaaagtttttgaattaaaaatggactctgtttagaaagatgcaaccaaaaaacttatggaaactaaaatatacgttctttgttcatctatttccttcagaaaactttcataacagaaagagcccagagtccatttactcaagtgtacatagatattttatttgaaaaatatcccaacttttcaaatcaataagaaaaacagaagaaaaatttattctaagacttctaaggaaaaccattaatctagcatagggtgagtgggatagggaagatctttatcataagtcaacaatgaagaccatgatacctattcttgaacagttggattcctaagtatggctcttgacttgcttaatcctctctttaaggacattttatttgccctatgtagcctttgtggactgcacaataaacacatccaatttcaaggtctcctacataagcagcatagagcaagagaaaacaaaaaatgagaaagactgcttagtttaaaagatttgcttggaaatcactaagattttgtatatcaaaattaataaaactgaaagcagtaactcataaattaaagataaaacaaatgattctttccaattttcttttcttgagacagagtcttgcactgacacccaggctggagcacaagggtgcaatctcagctcactgcaacctccacctcccaggttcaagcgattctcctgcctcagcctcctgagtagctgggattataggtgcacaccaccacacctggctaatttttgtatttttagtagagacagggtttcaccatgtcggccaggctggtcccgaactcctgacctcaggtaatcccccacctcggcctcccaaagtgctgggattacaggcgtgagccatcgcgcccagtcctatttcaattctttttagtgtgtcaataagtgaaatgagttttttttaatatgtagaggttatttcagactatataatattttcttttgtctcttttaccctactggggccagaggaagttcattatctagaattacagttaagaaagaagtccagcgataactgcatggatcaaaattctgactctgtcacttaactagcttgccctcagagttctcatttgtgaaagggcagtaaagtatctacctcatatggttaccagggaataaaggagtcaaacaggtgactttgcaaacaatacctggcgcatagtaaatgctcactaaatgttagctaaatggcaatggtcacatgtggaaaagcaccacagctagaaaatcctacccaccttaagtgggtatcacttaagcatcaggtcactatgtaaagccttaacttgtaagattggtattatctccattttacacaagaagaaatggagcctctgggacttcaaaacacttgctgaaagttatacagttaaaaaatggcaaaaacaagattttagatagtactcctgatttccaactttttgactatttccagggctccttctagcaagttccaacgccatgcacacctagtcaccgccccttgatgatgggacaccaccagactgacatgttcactgcaaaacctgcaacaagtctgctgacatctgaggaattggagaaattattgggtgtaccccaatgccacattctattattctttaatttgttccattaagtgcaatcatcttcaggaagcctaacacatactcactattcctccaagtttcattacagttcttgcttactcacttttgaatgggagggtgctagggccactcagaacccaatgcaattgctccagttaggagcagcgcagagtccagaaatacatcctgacacatttccaacctcctgcaaaaaaagctacatgctacaagatgtcataacaagcatgcttgtatgcttgttatgtataactaccatgtacacactacaaaaatattttttgtcatacagagaaaattatacttgttcatcacaataatccattctcatgatctcactattttctcagaagttgtcacaagttttcatgtcatttctttcagatgatgtttgtataatcactaccattactctttttataacttattaagcacttaatgggaacacttaagaaaaaagaacaacaaaaattgggtaattcttcttaaactgtctctcactactataaaatctgtaaaatgtctgtcttctctatattgcaattttaggacctggcagagtgcctgatacatagtaggtgctcagtgaatagttgttgaatgaataagccgcttcactgcagacagaatggcttttaaatgccatcataaaggggcaaactgagaaagatttctttttaaatgtcagtgttcataatctccctacatgtgcacaacataatcaacactgaactaaagaatcaacaaaacccactgtatatcaccttataagagaacaaggggaagagaagtatgaaaataagaaaacctgatcactgtcatctaagaactttcattcactttttatttgcctgaggagatggggaagtacagaggaactgagaatttcacaaactaggttcaaatctatctttgggtatatgatttgtaaccttaaaagattgaaagctactttaaaagagctattataggccgggcgcggtggctcacacctgtaatcccagcactctgggaggccgaggcgggcggatcacgaggtcaggagatcgagaccatcctggctaacacggtgaaaccccgtctctactaaaaatacaaaaaattagctgggcgtggtggcgggcacctgtagtcccagctactagggaggctgaggcaggagaatggtgtgaacccgggaggcggcttgcagtgagctgagatcacgccactgcactccagcctgggtgacagaccgagactccgtcaaaaaaaaaaaattgagacggagttctgctctcgttgctcaggccgcagcgcaatggcgcgatctcggctcactgcaacctctgcctcccgggttcaaacgatcttctgcctcagcttcccgagtagctgggattacaggtgcgcaccaccaggcccggctaattttttgtattttttagtagagacggggtttcaccatggccaggctggtcttgaactactgacctcgtgatccgcctgcctcagcctcccacagtgctgggattacaggcatgagccactgcgcccggcccacagttttcattttacacttttttctgcaattacctatgaggaaacacctatattctggaagaggcatcatttacagagaacaaaatatttaaagctgggtgttattttattgttgggtgtgtcactagatcagcccattgcttttagcagcaaaaaagtataaatttgcatcaggtcagatattttagtctgacaataaaacatacctcatcaaacaaaaaccattttttcttctgctgagttcaacagccacgcttgatttttaaaataataatgatagtcatgtaaactggatgcaaaactcaactcagctaacttaagaatatttttaaatacagtatatttgcagaatattttgctttctagattttttaattgcctatagaattatcttctcaattccaaaatatcttaaaacaaattattgacacatgacaaatatatattgacaattttgattcaagattatataacataaacaattgaaataccagaattagttttaaaagatactttacgaaacattttaagacaatgtgtataggacatacactgaaatctaagagctaaactatatttaagaataatttagatatcagagttcaatgttacgattcaataataaaaaagagattaatcaatcaaagccatttagtattaaatattttggcatctgtgttaaaattcctattagattcttttattaacttttttttaacagaacaccaaatttgtcaccaaaacaaacattcccaaaacagtatatatcaatgccaaatgcagttaatttatgtgaaaagtagactcttggttatctgtttcattttgttttggttttgttacataacccctgagaaaactctgcttaacactcacctcctctccgtgacctttccattgcagtcacacagggttccctcccagaaagctccgcaaatctaactatatatagtagttggtgagagggttagttagttgtatacttgtcccactatctttggtatttttgtttttcataaacactgcaagtgaccatgaccctctcatttctacttgtaaattactcggacaaggccatcagtatttcaccgttttttcctagctccttaaaatattgaaaacagtgctcagtacagtgcttccactccataaatgcatttctcattttttcacctttagttcaaatgttctatattttccttgaaggatatattttcataaatccacaaatgcctacttctttgactatatgatgatacatacggaatcatattaaacacataccaaaataaaaggatttaatataccacatatatattatatcttgtccttttttattagtcattagattttccaaagcgtgtgtgtgtgtgtgtgtgtgtgtatgtgtgtgtgtatatgtatatatatatatatatacatatatatatatttggtatgccaaatatataatatttaccaaaatatataatatataccaaatatataatttggtataccaaatacacatatatatatgcatacacatacacacacacacatatacatgtacatacattaatatatataatcaacactgaactaaagaatcaacaagcccactgtatattgccttatagagaacaaggggaaaagaagtatgaaaataacacctgatcactgtcatctaagaacttatgttcactttttatttggctgaggggatggggcagtatagacgaactaagaatttcacaaactaggttcaatatatatttggtataccaatatttggtagttggtgagaaggttatattttcctatatatttggtataccatatagatatagatagatagatatacacacacacacatataaatacacatatatatgcacatacatatacatacatacatacacacacatataaatacatatgcacactttgaaaaaatctaaagactaataaaaaatgacaagataaggattattatccagggacttaattatattaccagtgaaatgattttttaaatgatgtgtcatttttaatgaataagagaaaacagtcaaaattattcttcagagaataatcttactcataatattgagatatttcttccaaccttatttgtgggactaaaagtcagtgctattggaaacataaaggaaaaaaataaacacatcaccattccagaccatgaaaatgtttgggattttaaagtcttagttccttgcataaataaataccatcaccttgaacactccccgctaggcaacagttacgagtatgttcacttttatctcccattatgtttgtgcctgggattgtcttatacccaaatgaaagacctcatgaaaaatggatagtagtaaagtatactggattgtaccaggaaatttatacaagaatctatcatgtctttgtactctagggaaggttatttccttaagtaactcacaaatattgaaacaggcattgtgattagctgtggctctataccattcacattaggagtggattttgagacattacatagcaattacagtatttaaatttttgccatatacctaggaaactggaaaatttgccaaatttaatatttttctccgcactttaggcatagcattgcccttaacttaaagctctgcccacaaaagggagaccaagtcttctggaaagctcagagaaagtattgcacgtctacaatacggcaggtgcggcggtaagcacttcacaagtattttctcagtttaccctcacaattgccaaataaagtgcatgcctactccagagctcaggaaactgaatcttagaaaataaaactaatttacccaactacatagtgaatagtataaaacaaacattaaaactcacagcaagattccagaatacgtgctattgctaatacagaccctgtaattcacatggttttattttactcattcttaacattaaaaatatacacataaagtggaaatgtatttctaaaacagtgaccaatcactagtgcatatacaaaagaaagaaaacaagcctcagtaaaaaggagattttcctagtttgaggaactttcttgtgttacctcagtaacagtaatctgatttgcccctaatgttctatattcagtataaataacttgcatgcattcatccattcattcaacaaatacatattatctattttatagtatgctctcataacatttctattgattgtggtttcctgtacttgcattgtacccatcttttgttcacctatttttccatcaacaattgtgcctgaaaaacatgctttcaaactttcaccatatactgtcaaactagaaattagctactagaagtagctgatattaaactttttctaatactctaatatctctgtttcaatgtgttaatctttgccttattccagagtctcttgatatacataagcacacacagggcatttctaaaacataaattatagacaactctttcattttataaaagaattcttggccaggcaaggtggctcacgcctgtaatcccagcacttttgggaggctgaggtgggtggatcactcgaggtcaggtgttcacaaccagcctggccaacacgatgaaatccagtctctactaaaaatacaaaaattagccaggtgtggtggtatgcacctgtaatcccagctacttgggaggctgattcaggagaattgtttgaacctgggaggtggaggttgcagtgagccaagatcacgccactgcactccagtctgggcgacagagactctgtaaaagaatttctaccttaacaaaaagattcattgaaagttgctttttgaaattaaattccccttgtaaatttcatatgttttatttactaaatattaaactaataaaaaaattctcagaaacatctcttaaataaaagagatatggatgtttgttttaaacttaaaaaaaaattctttaactgagatgatacatgccacacaaaggaaaagggagatgtagtaattatcaagctaatcggaaaattacaaacacccaaaagcagaacttctaacagctcctcataactagctctgaccttttctttaaaaatctgactttcagttaaaaaaaaaaaaagttttcttataacaaatctcaatcatcttttcttatgttattggaaaattggccatatatttttaatgggtcctttctgtttttcaaccagcatcaaattttggtattagttgagtgcaatttagtgtatcttccatccacacacaaaaaaagagaaagaccatggctgcagattgatttcgttagaatacttcctatgaaaatgtataaaagaaaaaacctagtctcttgaattaatttatcttaattacaaatgataatacaagatgtttaatcattatttttcttctattttcctttaaaaattgctgccatgttttcacgaaataataacctttcattattttttgataatttacgtttatttttcctcctacagcagtaaaagtaacgcatccaaagaagcactgggcctctcttagactcagtatcccaaactgtaaagtgagaagatctgtagggattttcccggctctaaaattctacaagttaaagacctctttcttaaaaagtaagcttttatctacattgaaccaaatgagttaactattggactttgaaatgagcaacatgaaagtgttactcaagagtcaggttacacattttctatttctctttaataaataaaatgtattaaaaccctaaatttaacaagcatgtgctaaactttattaagtattgcttactatgaagaggactgctctctgccaagataaccagaaaccaaattcctaggatgctagagctaacagggatagtggatgtcctctaggccaattctcttccctgacagatacagaaactgagttactgagagggacaaagtttcccaagcacctgcaaacagtaggaccagcaatgtttttctcttccacttcagcaagctgcttcaatcactatatggcgtagagtgaatctctacatcagtaaacaaaggaatggaagaaggtaattccattatcaggtcactaaataatttagagtctaatttttctttttttaatgtaaagaccttatgttcagaaacttacatttcaaagtacattaagtaaaattatgtccatacgcagatatgtcttctcctatatgcatcttaataaacaaaaaaaattatcgtcatcccctacaaaacaaaaactgaaattaaaagaaagaatagagtaaatctaaattgtatattttcattccttctaaaaggattaaataacagaattctaaatggtttgtttgtactttccatgcaatatgtagattaaccatgaaattctgtttgggacactttgacatctgttttcagtgcgttacaatgaaatctggggacttgatacatacatttgctgtaataaaactgtcactaatcagtgttttccaaaatattgcccataactattactattcagtagtctcatttgcatgatctaatattgttgctacatcatgtttttccctgacaatgtgttagctagtcccaggcacatggtcgaaaatggctgcaaaccactcaataatcccagcatttccatagtactctgtatatatgcacgcaatctgtcctagaattgaaccaacacttcatccttcatgaaatattttctctgtaactggaacacccaaggttgaattcacatccctgagtatgaaaaactcaacaataataaagaagcccatggtgaggaggaaattacgcctcatgggccttccacaacaggagacgcaaacataatccttactcagaagtcccttcaacaaagctgtaatgatgatgctttctgaacataagtgcggagtctatcattaacttagaccatttctatgaactaaagaataagactggactagactttaaaacggagtctacttccctttctctaggattagtagacagccttatcaatgccagataccaagagccacaagttcacaagatattaacacaaactcctggatattagattgaaaaactgtttccgtttcatattgcatatatctggtatgtcatgtacaaaatatggatctcaggggaaaagtaagtctgacagcccaaacatggtattcaccaaaaaacaaaaccttactaaaaacagtctgtctacctatgttgattctaaatgaattccgtattttatcagtacttggcattatattcatattgctcaacagtccaaaataatttcatcttgtcctcccatgaactcatcttaaacccaaaatatgtttctccatgcacatgttttatattatacgaatgttggacacgaaaagcagattaattgtaggccctaatgctgtgtttgttagtactaagaagtcattccaaatgttccaaaagggattaatgtagtataacaagtctatttaattactgtaagaccagtgatcctcatattactataagcagcttttcccttatttggagactgtaaatagaacagaaattgttacatgataactataagtcatatcctaaaatgttgatgctttaccatcaggaataaagaaatatgcaagcatctctgagaggctatgaaaggcaactagaatttaacaaccatgtatacgctcccactttaagtgaacatcaactttaaatcataagtgtaagcaaagcttttcaaatacattagaaagacatcatatcaaatctttctgccatcaacagcaatcccagtttacatatgtttaaaaactgtggctgcactttgtttcatgtatatgattttcgagttttgtgtatcccatgaacagaactgctactaaacaccagtgtgttatcaaaaagaaaaggaatgccacagattattaaaaattatgtgccagaatccaaacaagctaatcaatgtactgatcctgctttccgtacaccctagttaccctttaactaatggacaaacagtgaaataacttttcctattaactcctggctagaacccctaggtacgtgatacacttattataaagtgctccatataagaatatgatgcctttttaccctacgtcaatgtgacacgtgatttaaattttcctagtagggattgtggatatgagctaatctctccactttccaaacctcctgtgcaaagtgaggggtgcagttcagtggccgtagggaaacaagcaccgaaactagttcctccaaggacctccatggacacaaccaaccagagctactgaagtcaaacacggtgatcccaaatcacagtttcgtaagaagtaaatgttgtaaccattctccacttggcttccagttgttcttagcaaaagtgaagtcaatttcagtaataaatgttaacttatttcctacggagctcatttaattatttaattttcttaacacgatagaaaaggaggaatgggaaagagtgacttaaaggagaaaaattaaatggcaataaaatcaaaacaattcatgcaactgattaaacggtttgaggttttgactcaactaagggtcatttttaaatatgatactttcggactttaaaaagagtctgaaaaccagcagcatgcttttttaaggacaatccagttggccgggcgcggtggctcatgcctgtaatcccagcactttgggaggcccaaggcgggcagatcacgaggtcaggagatggagatcatcctggctaacactgtgaaaccccgtctctactaaacatacaaaaaaaaaactcagccgggcgtggggaagggcgcctgtagtcccagctactcggcaagctgaggcaggagaatggcgtgaacccgggaggcggagcttacagtgagccgagattgcgccactgcactccagcctgggctacccagccagactccttctcaaaaaacaaacaaacaaacaaacaaacaaacaaagcactatcccatctagccacatcatcatcacttctgccgaaacaaatctaaaacgtaagtgtagttctcccaaatggtggcaatttaatttttttgtacatgacagttttacacttttattggagtgcagtgaattacgagtacttgataggacaccctttacccacaccaaaattgagttatttattcagagagccactaataaaattatttgattccttcccttcaaatatacctagattgatcaataaatttagtctctggtaaatctgagacaaaaaggcttctaaaaccatacaatcattctaatttaaatgggttttaaaactacacacaactagctaacttcatgtgcctacacaaagagttttcactaacaaatattcacgcgcactacagtgagcaggacttcgatttcctctttggtatgtcttgttacctgagataaatatgaactaaatgatgaccctctgcttcatatccagtcattcctttttttcactactggatagtctccctggcagtctacattatgctattttccttcatatatagtagtaattgctattattaacattattgcttttacttacatgaattatttcatttaatcctaaagcaacacagtgaagtaggcattttaatcctcgatttacagaacagaaaagcaaagcacatggagctgaagtgacttgaccaaggtcacaaagcagataaatggcagagccaagactagaaccccaaatgtcaaattctatgcacatgatttttgttacaaaatgaatgtttgggtcttccccaaattcctacgttgaaatcctaacccccaatctgatggtattaggaggtggggcctttgggagataattaggtcatgagattggagctttcataaacaggattagtgcccttataaaagagatcccagagagctctcactcttttgctgcatgtacggaaacaaggagaagttggcactctgccacccggaagagagccctcgctggaacttgactatgctggcactctgctcctgggcttccagcctccagaactgggagaaataagctttagtgtctgtaagtcacacagtttatgttattttgttatagtagcctgaactaagacattttctgtgctctacaaaaatggaaaaggcagaagggggatatgctgaacgtcttaagcaattcaaaattcaaaggatgacagaatactttaatttgcacattatttactcttcagtctaagaataagccatctttcttaagtaattcctgcaagatctaagccccgcctttctctttttcttctaacttcacttcttcaactccctacaacacgtgtgtgcatgcgcacaccccctgctccctgcccacacacacacccaagttggataacacacaagttggactagaaactttaactcaacaggtgagatcaccttaaaattctttcgatgtaggaactgaggtagacgtctggagaaaactaaagagatttttaaatcctctgggctggctgctgttctcatatcacagtctcactgtcatctgaccccttagcccaccaaccacatctaaagccaactccacattggcgctgcccctgaggatgctaatgaaccggcagaaaggcaaaagagatattttctattctagactagtttttacaggagaagagagaaaaactgaggccatggactaaaatgagattcagagcacttcattcaaccttcctcctttgacccctatgattctggattatcaacatgattcattctgaaaagcatttaaattccttgatcttgtgaacattcctgggggaaaaacagtttaaaacacaacagtaacaaacaaacaaacaaaccagaaagaaaagaaagcctctcacctgctattttcagatattttctagatgggaatgcagaaatctactgcttttttcccaggttctagcgcctgtagcacattgtctctcatctgtcagtgtatctacacacatgtataaacagtacgcaacacgcaagtaaggaaatgtacattttaacttaaacttccttttttcctctaataatttaaaaataaaatgtaacagcttggattttaaatatttaatctggcaaatataggaaaatcatgaactataatgtcatatttggcaaagaagagtttggtaggataaaaatatctgtgttttaacattttagaaggcttttccagtattttaaaaataaaattatttcactgcttcagaagagaagaacggaggtaaaattcgctatttttgcacatgaggttttcatgaagagtagaaaaaaaacaatttttatattcattaaaataaatagttatttttacatgctggcaaaagtccccacagaaataaaatcttcatatttactaatggttctctactatgtcatgaaatttagctatttaagtcacaaaagataggattcccttaaaactataacataagatggtatatataaagttacaacattaactcatttgtaaagaaaaaaatgttggttttaccctacatgtttagtatacagattttttcagtactagtcaaagatttatagtgttaagttcaaaagtcagttgttttcacatcggtaaccaacagcataactaaatttcccacttttacctcatattatgacaataaaatatttttatcgtagcagctgaaaatgctgaaaagtaattattaaagaaaccataaatataaaaagctgaaaagtcaacctcagacgagtgtggaaaaggaaattgtgatatgtaccatcataaaacagagaaactgaaaatctaagcagaaaagatctaaatccctccaaatgccagaatactatgccccacctcttgtagcaaggagggctgcaaatttgtccccatcactgtcagcaaacaaaagaaagtcacttctacagccagaccatgtcaaacagaagacgtagctactgcagacggacgccttgaatccactggtgtgtaaagggcgggcttgggcctttttgtcagctattaccattaaagaataagaggaaacagtgacattattacacaatagaaaggtcaaacagcttgcagccattccatgacccaaacaagtcaaggtcaagggattcaggtagcaacttagccagggcgtaagttacagcgcaaatgaattgttttaacacatcagctttggtcaattaaacctaacaaggcaagttgcatcaggtagcagggttcctgacaccaaggccagaagctgagaccgacctcataaaacaaggcttttaacatagcatagcaaatttaaggtaatccaaccagaaactgcagatgtcagaataataaaatacaagttgtcctacgaaggaacattttttacacttcagaattcactaatagaggggtatagacttcatattgacgtgtcattagcataggcataaatgtaatccaccactcacatgaattacagaatataccctacttcaaataactttttcctaatatctgtgctcatgattagattttttgtcccaagctctaccattccgttagcaccaatacatttatccatgtatttttttcaaaatgagtatgaaaaatcaggtttttaaaaaaacagttcatcttcattcagcatgagactatatatgtgtcgcttaatattaatggatgcttgttaaatgcttttatgtagttttatgagagatgtgtacttcaaaattcaatgaatactattaagttgactattttgagaaatagactattttgaatggagttgaagctaactaaaattttaaaactgcatgtatttaacatgaaataattcttttcttaaaggtaattcttattttatttcgcacttgtttaaacaaattccattttcaactggtttatgcttcatcaataacttactacatgttctgaactgccttaaaataggattctgaaaatacacaacctccaggcaacttttgatagtaaaattacttcatccatcaccccatatttttaattatatagtccttgttcagagatctttaatttgtcagtgattcatcagtgctgtcctgtttaagctatcatcataaacagaatatgtgtatctaagtgttttactataaacaatatagttatgcatgtaatcatctgctttcccattttagaacaattaaattttgaaggttttttaaaaatgtgtggctttcaattcagcctcaaggactttccacctcacttgttagccatttcttccaattttctgaataatataacaaccaaaaagcccaaccattcaagtcctattagtctcactctaacgttcaatctaatacaagctaatcccacagactcactccttactacaacgcacttagttttcacaagttctctgcagtttgatgatttattctctatgccaaattctaacaactaaattcagttaaattaaccgcatcacaaaactggagttcaaggtcccaagaatttactttaaaatgagacaacataccacgttgccacagaaaagtgagcatgatcagaaggaagcgtctcttcttgctatgcttggcactggggcatgcagccgtaataactcaagtttccgatcgcataaccactagtccttgagatttctaaaattattcctccttcacaaggatggagggaaaaaggctggaaaatttgctttgaacattatgttggctaatcatttgctccgccatagcacatacataggaaaaccccttaagtgccgcaagttctactttcatcaacttcaaactggaaaatgctattctttcataaaccaaagagaaacatttacccagaagctagtttcagagccagggatcgcctttgcccataattttcaggtatttaataattgaccattttaatgagtgtttcatgtgctctttgcactctttgcaaacttggagcttcaaacaaagcaataactacttctttgattataagtccattatcatgtaagccaccatgataacagaaatgaaaactaacttatctcaatttttaagaaatcctgtgaattctgacataaccttccgttgggtccctctctcttcaggtgctgaaattctaactggccagcagtgatggcaagagcgctagtgtcagaaagcaaacggttttatatagcctaccagtctagtttttcagtttaatctggctgagtgagagcttatgaggagaaagaccttgctatattgggtatcttggattgctgtttcaaattttaagtgccaaattcaaaagcaaaaagttaatggaggattacaactttaacttccttatgacagcttcttcctaaattccaaatttagggaaaaacaagtaagtaaatgaaaaatcctaccaaatctattacgaatcttcatgtttggaagtgcttcttaggtaccaccttagaaaacagtaactttaaagaactaaagctgtagcaatagatggcctctctcaatggctcctacccagctttaagtctccaggcacaggcactataactgtgcctatcaggaaggcattcttcaggagacctgaccgtcactcctgtcactgcaatgcacagtcctctccaattaccacgattctcgaacaatgcatattattttggttcttacaaatatggagatatttggaattattttaccacacaagagacattgtgcactaaatctgtaaatccaaatacataatctaactatttttcattacaaaatttgtagtgctgtatatacagggtggggggaaggatgcctaatgctgtcagtagaatattttaccaacctttgctgcctccagaaagtggggcactatatatttttaaatatttgaaaatcataattgatgtaacaaataagcgtcccatccctccctccctctctccttctctccccccacccttccctttgaaaaatgagatcatattaactgcaatgcaagagcttagtttgccatatcggaacacagatgccaagcttccccagctggcaactggggcctcagagtttaactcttaaattgtctgttaaagctatcttgtggcagagacctcatggcatagagggtgaacttctggtgggagactgtgttttcttatcagtgagaaaattgctaagtatcttatctcacaatatatgttcccacaaaggtctcattaagcctaggagcaagacatgccaataagagcccttctttatcttgtgaattgtgtatgagccagaatgcaaacaaatgtgcactagagttcacaagttcagtcaaggacaagttgctagatgggaaaacttaacagtgctcccctaaatcaaacatgcataccaagtatttctcctacacacaaactcttatgttcccagagcatttcacagtgcagacacaccaaatcatcctagagagcagcctcattttaatcaattatgaaagcttattttttcccataatgggaaatacctgcagatgaagtgaaatctattaaaatgttaaaatacactgccaacttgcaaacaattatctacttaagcttttcataaagaaataattgttacccaaaaggattctgaaattcagtaactgtaggaagaaaataattcttagcatttgcttcctcactaatgatatgtgacaaccaggaaggcttctatttcaaaaacagtaataatgattatgacttcccctgtaaataagtcacatttttcacaacttcaaaatgtacttcaattattataacatttaacaataaagcaacaaaagtggccacccaacaagagatcataattttaagggttcaacaaggctaaaggaaactactttttcaggatagcaatgaggtttctgggctctctttaacactccaaaacatgtttaataagagtgcaaagtacagtccaaaaatcagttagggtgactcattttaaactctaatctgttacatacacgacaacagttgctatctcttgagatctttaaatgtcttggtgtgttgtgacctctctcttcaaaacgctttcctgcctcagagaaaggccaatcccactcccgccccccgactcccaccaccaccaccacccccttccttttttccccttcagacaggacacagtctggcaactcaaggcctcccataggccagacttccttctgtgcagccctttgggtagaactgctaatccttcttattaattaacgagataacggtggttaactgaaaagcaatattaacgctaactatctaggaaactttaaccaaaattattttaggcttttggttgattttcccagtgtacaaaattgtgcactgagaatttcgtaacagtgtggtgcagaatcgagaaattccagaatgactgattttacctcagaccttaacgcataggtctcctctttaaagttttctctctctctttttaaacatgtattctgttacacatttctaactagagaggaaaactgaagtcctctcaaaatgttactataaaatttgcaagagtggcaagtgagggaactagaaattgcatagcaaataagcagtgatgtgactgagagcaacagtcagtcataatgaatgcatcacatatcattacgttaggtttgtcctccacacacttgtcatagcacaccctgcatcctataggacacttacatcccaggaagctgtgctgtgcaaggcttgcctggtttttgtttggttttgtttttgctttgctttcatgaatgcagtaacaaaggcaatatggggaataggtaacacctgcccaagaatcattggacgtctttaatatctttgggaaaatagataccatttagagctattttttctttaatctgtcccagtttttttagacaaaacctaaaaaaaggaagagttttatattagctaagatttgctgcagcaaacaagcaagcagctttcattcagggattgtcaaaaactttccagtgtgcccactgcaatgcggatgccaaccaacgaatcaaaggcattcagcaactagacaaagagggtctgatgccaacctcggtgccactggcaaccattattggcatcaaacacagtgtctgccttttttttccccctcgcctggcacttcacaaacaaaatggcggttcttgtagcaacgaaacagccgaagcgcagccctctgaatcaataacatcaaatgactttatggatttaaacgcagttactcccaaatgatgtgtacattttaggtgaagtgcagggagacatttaattttataaacaactatattgaacatcagcctttgctaatataaggaaatagcaaaatggactgaattgcggtcaaccagactacatgcatagtagccgaataacaaagagatttagctttaaataaaatactgcctcatggccacgtgatgcaaaagtctaatgaactatatatcaaaaatgatttcaaaaagcataaattttttcccaaaccatatcagatgcagatgtagcactatagcttgtgtcaaagctctggtaactcttcccacatttcagaaagatgaggctgctgggcatgaagaaggaaaaaaagtgtgggttgaaccaaaagagaaagagggaaaaaagaaaagcataggaagttggtcaacaatgaaactttagtacatgttggtctttatttcgtcttccagaagagatgcagtgtgtgatcttgtataaataaccaagaggactattgacatttctagatctggaaattgtcaatatattgtaacatcactccacactgcaatgcggatgccaactaacaaatcacaggcatcctgagctaaacaaagagggtctgatgccaatcctggtgccagtggcaaccatctttggcattctctctgttctttctcatgtttttctcccagtcatttagaagtggggagagagaaaaagggggaaacgtaattttgttgctctttctgctgcaaacattacatttctcttttctgatttttctttcgtgttttcctttatacttcttttcctgatttataaaacagacttaggtgagttatcatgtacttagaagacaaataaaaagtcatcactcgcgatatgcagccctctaactgaccggagaattatcttttaaaatctgccttctttaatcaattgcactataaaatgacataattaacctacacttgacaaagaagaatatataaattttgaaaaggggaaaacacaaaagcatcctgacgtgagtttttcaaaggaagaaccaacagatgttaagagaagatgatgcactggcaggtagcagaggatacaagttatatacacaagataaaataatgaaaagttcttacaatagagattgttgaaccaacaacaaaatcaatgttttatctaaaaccatggtctcttaagagttgcttaaaactttatagttatcatgaccagtggtgcaacatggaaggcatttatgcgttttttttcttttttcaatctatctctacaaatctttattgtcagttcatcaaaactaagagagctggctgccttccccaggagtaaatgtgcatgcaggcaggcacacctcaaaacctagccttcaagcaacttaaaatgtgagcagtagtgaagtggttgcaaatcttccctccctgcactaaaaagttacatgacccactttttgaaactttacttccatccttgactttcacaacacagttacaacacatttatagtcaatccaacacatatatacagcccaccttaaagtgtcacctcctagacatctgtcaatcaaataagtgtcatgtgttactgagttttattttaggacacatgggacaaaaatattattttccccaaaccatcattatttggactgtaattcttaaatgcatggaaatattaaatgcaatgtttcattttttcaggaaaaggtaatatttctaaaagtgcaatgtccaacaccattatttaaaatcagactaaaaattctaaaatgacacttaagcctatctccaaagctacaagaaaatcaagacaaaaagcacatagtgagggcctagaattcagagtcaaaaaagtaattttgatttttttgaataataaagctcatagcagtttattaagtcccacatttatataacaaacctcaggtaacagtctgtcacctggctatctgcaggccatttttcctcccaccaggccaagtttggaaatgacctaccatctgtgacagctcaaacttcagtctacttttggtatgcggctttgtaaaatgattgttttactatggattgttggtaatgcaaggacatctatatcttgatgcatttatttgaagaaaagaaattcttacctacttaaggaaaatatattaagaaaaataaaaataataaacatttcattaactcaaatattcagtaataacatcatcttttttaattatttaggtaaaatgtataccattctccttctcaggtattttaaataataggtatggtatgcagtttctgtattctttttaagatttatcttaaaccagtgtaaccagtccactttctgttttttgttctgtaagcagcgctgcgactttcctcctcggtaagttttatgaatttacatacaagtaaactaacattattaagtgttcccaagtaactctgggaacatactataaataatttaaataataactcaattccatttaatcgacagtgaatattgcacaatcaaaagtgatgatagaaatattaaaattaagtaaatctaggtctacgtaagatatacttttgatattatctatcttaagcattttgtaatagtaaacattagttctattttcagtgcgataccactaagttcataaacaaagtccctctacctcattaattaataaggttaatacaaaaattatctaggatggtttggctattcataaataaagttatattttcaaatcaggaaaagattactagattagatgcaaaaatgtagcctacgacagaaagtatagtgtaatgaactatatttgttagactaccctatgtctttgaaaaacagtattattttaaagatacttgaaaacgcacctctttgtggtctttcttaaatatccaagcctatccaggtacgaaagctctgtgtctatttacatggctcgcacatggcagcggacatgtgagtgaaagcggacaccctactatacccagagagggtggaggatatctaggggccttgaggaccatctaactcaagccagatactctgtctacggagatttgtaggcggtgtttgccgtgctagaaaaaagaacaatctgctcctaccttgctcctgcacgtagtatgccaaaaacaaatcaagctccttaactgatactgtgatatgatgtggctggacacaaagtgctgggtttgtgcaatgtggggatttcatgagccgctctccatcggtactttccaaggggatgcctttgaacaggatcaccatgactagatccagacgccagactttgtctgcctgtcgcaggcagtcgattctcctaatcttacccttctggtcgggattggataagacacagcacgggtgcttcttgccagtcacggtgagcacaaagtcctctcgatactcctggcgaatatctttgcgcagtttggcaaggagcctggatgcccacttctgtttgatttcaggcttttcactgagaagctcatctttgactgctctttcttcatcctttgacattcgcttctcatgctttttaaagtacttgcgttttcgagcctgcaggttgaaccaagtataggcaattgcacggacatgtggaagaagtgcctcgatgaatgggtgaaattcatcctgtggaagacagaggggtgaggaaaagatgtgcatagtcagtttaattttaaaagctcaaaaaataagaaaagaagaccacaacccgtttccaattcagtacaaaaagttatacatgaaaataacattcctttcttatttaaaattatcaaaataacaggacaagaagaaagtaaagtatgcccagctgtcccctttccaccaaaattcacaggtcaattctccctcctataaaggaaataaggtttatattttgtattacactctggccccatcccccttgtttccaccccaatgccatgcattctacattctttaaaatataggcaactaactaaggtgcttggcacctaatatagtatttcaatatttgattgaccaactaacactatgcagtaccattttacaaagaacacagtgagattttttttttttaatcggagtagagctgttcagaaggcaggagcgatgccacagttcatttctcttctctgtggcacagaaacacaaagcatatagatgctcagtgtaatgccacacagttcccgcttttggagcatgctctcagcaagaggctgctggtggcacaaagagcatgcgccattaaacttgatccattttcttatcaaacgtccaacattccaacactgaaacagcaccattccaaaagtggtaactagagaaaccggtatacagtgagggaaagtgggcaaaggacacagctcgtcgtatcagtgtcctgaacagaaggtttccatactttgagcagtgcattctctccccacactaccaacgccagctcccaacacacacacacacacacttgcactctcctgctttctcacacacactcttgcatttttaaatagaagttttcaaactggaaaacaaaaattacatgaatgttcttccatcagcttccctatagaatatgcagccccacagagtccgttaatttgttcaccgatcacatgagtatagcaattattctaaacctcttaaaaatcaatctgaggtgaacaatgaaaaatggcaacttggcaccaactttacattctttgtgtctctgcatgctgtggtggggtgacactgctggtcagttactgcttttgtggaatctatacaattcatttgccatgtagatgaattatcagttagaactgtgggtgcatatatgcatgtgcatgtgaatttgcagatacatagattatagagtaccaatcttttgaattaagtagtttacctttaggctcctgcatttttcctgcctgtttcatccaagccctttttttaagggaggggatcagtgaggaatggtggataatctttacctacagatatttcaagttacttcccagtgcagtcagtttcgttacttcctgatttaggtaaaacctgtcttataagcttaggcctattactgttcaaagagaaagagcttaacgtcctgtacatgcacaccgcatgtacgcaataagccaagatttgaagcaaatgagaacttccaccaccaccacttttctgatcatattgactatactgtcagcccaacgacaaaataactctctgattgtatcccaagttagaatttacatactcatgttaatcaccctgaactacgtggaataaattctatttaacagcagactgactaattaattccattaggtaaatatgatgaaagtacaactaatgactctttaacaaagaaggtgtcaaaaatccaatatagatatgaatacattttgaagaagaaattcgaagttttaatgctacagactgcaacatgttagctgtttgcacttcagatatggaaggagtacatgtcccatccaatcaataatgtagttatcaagtgttctaacattgctgtaagtgttccttcaccagaataagtatgaatcaaaattttataacaatacagaatgctgatgattacatcacagcatgaggcatacccaaatgccatagaggaaatcattaaaccgatcagtagtttccagcagagatttgaacaattcagttactatgcgagcacattaaactaggccatggaaagagttaaaccacaatctgttctttgtgtgggaaggcagccctgctcacagcaaccacatcccatgataagacctccctatctccatacactttctgatgccatgcttttagctttcactgtaactacaaaaactttgtttatcccctttaggaatatatgcaaaaggaaagcctgctcaaggaaatgtggacttaaatgtgctttggaaactcacttcctataatcttttactacgatttattgatatgactaaaaaacacacatatatgcactcacaaaactaaaaccttgagaatgtaaagagcacatgaggtggagtgggtgggctctgtctcactcattttacccttgccatgctttttaaaatgcaatattattttataaatattaagccatgtggtaacacgtaagtacttacaccttaagtactatgttcagtgacatttcattttcttataaagacatcaaacacagttttgattaaatttgagtttcaatatttgattataaatataatctatcacacaagaaagctcaaaattttaatgagttattttaaacaaccaaaattcaaatttgaaggttgaatttgaaaattcttagcaaatgcacacagtttttaaacgttcctttgactttgctgtcaatgctgccaatattgttttaaaacatgctcttttttttgagaaataaaagtagcaaactttctcaggctgccagtttgccttattgatatcgttcagggtttcactattatgtgaattcaagtgaagcacttatttgacaaggggacatatcctccaaaaatgactgtaaattgaggtttgctgtaagtcgcatatatttctgtattaacatgcctaaatgtcatctcccaagtgtgactgtttcctaatgctgagtaacactagagtcttaaagattatgagtgacatgaatatggaacataataactgtcctgatacaaaaatatttttttaaaaggtgattaaggttttcaaatatcctaactagtagtggattattacaatagcattaagcaatcataaattctttaaaaaaagcaaaacatataagtgatttaaaaccaaacaactgtatacaaaggtaataggcaactttgctctttcagaatttttagtaaaatgcattgatgttcagtaattctcttttaaaacttcctttagttgaactaaattgacaaagtaaataacaaagttaccaatttcagatataaaaataaagagtcttaattccactaggcatatttatttttcttccgtttccatgaaagggatggataatttagaccaacatagaggtagaagagtaaatactaggtgctcttggcgcattgctatataacaacaaatcatgcaaaaaatgtacctaaagaacttaaaagcaacgaaagaaaaatatatttaatgccatcatgccaattgaaagttatattattaatggtttacattatttttaaacatatattaaatcatatgatagttcttaatttttcctttatatctgatttatactggtgtataaatattggttattgatatgctgattttgtagcatactattttgctaaacataacatttaatggtaggtccttttaaattaagattttttttctaaaacctagataccttattgcaacaattgagatacttttaaaagtttataaccaattaagaatgatactctattttgcaatttacatgtcctgagacatgtttttctacagctactaggctcttgtgatacaaaactactgatctgatacaaaagtgacactattaatgtggcctcacttttataacacctatattacctgcaaagtcacatggagcttagtgaagtgaaaattcttaagctgaaattccttccctggtgtaggccttgttttaatacataagcctagatttatattattaaaatagtagagaatattagtcatcacaagttattgttgttaagtgtgtatctctgaatactaatgtgatagctgaatgattatgctgtatatgatcccaacattccctgtctcaatgctgcaatattatctttaacttacacaaattaagataaaactagtgacttttcaatacatatttggaggatactaaaaatgcaatgtaattgctagcaatgtttctgaaaagctgatgttagaaatatagagaaatgcacaattattcaatcttttacaggtgagaataagtgatgctatactctgtaagtgaaaatcttgctttgatttgttttatttgatcacggtgtaaaaataatatcaagttaacacagcttatcagaaagagaaaaatatatccagccgatgggtaatattaatggtaacttttacaagtaaaggcaattcgttatacctgaaacagtttcatcatatttattggctattatcattcatggcttttaaaatacaaatagctcagcaactcatttttccagttttgttaaattaaagtgcgtgtttacttgctgaaaatagccatatctaagttaatcatactcagatgccaaacaaaatataaacaataaaaaatgtgtcagccaaaaagctacaggactgtatccaatcactgaataagccttatcattgttttcatcttcattcacaatttatgaatgcctcagtccttttgaatcacaatggcttctaattgtcatacaattgaaatcttaattatttgtccattataaaaatgcatcatcgtgatattagatgtttttaaaattttaacacgcccaagactggctgacacttctttatatgactagttttcatggcaatgtcaaagaaaatagttatcaattaccaatggtgacacatcttccgaaaagctgaaataagctgccccatacctttagaggtttaaaatactgcctcaaataacagttctgggctaagatattttagttactttgtcagttgttagttccctgggcagcgatgaaaactgcccccaggtaagtctgttgggtctcgccgcttttctatttgaccgtctggcttaaagtgatacaaatcgtgtttctaaaaagtataaaaccagtgttttatttcataacattattcctaaggtcttaggacaattctcaaagtcgaaaaaaatgaccttacttctaccagcattacttaaaatgccttacgagctacgcccaaatatcgtcaaatgaacaggtttccacaaaaggaacacgttctaaaaactccttaacaatcaccaagaccaactaactcgtgtcaacgtaaatactgcctttgtggtgcggtcactagaaaccccaaagtgcagcaggtcactatggaccagggtttcagatccccaaataaagcaaaggaatgggtccccggaccacaacctccgactcgattcgtcgcccgcccaccgcctgcagcgcagtccagcggcgcccacacagactcgtgctacagtcccctcgcccaagttcactggctgtttttaaaagcttagtcccccgtaaagtcctccaaagcccgagtccacctcaacgcgcgagctgctgagaggggctacgggcaccccgggcggggatgccgcaccacaacgggcacttgaggggccgcacggggcctcgcacttacaggtcccggccctgcccaccccccggcggccttgcccggcccagcgcccgcgctccgtgcccagggcgcggggctgggcgctcgcagtggccgtggcgaggggccgctcccggctcccacgccgccccgcgacgcccgctgcaactccgggccacttctccaagggacggggatgtgcggaggttaactcaagccgctaattgtccgcaacaaaacaaaacaaaggcatttcgggccagagagaaagctcgagaaagcgaccgagacatgtacctgagtgagacagatgggagaatacatcatgacttcgccttaaaacgcactttccgggagatgcccaagaaaatcttcgagaagcaagaatttcatctattcattttacagtcatctgagccccgcgatgcgatcaatcaggacggggctctgcgctggatcaccgcaacttcacaacaaacccagtcctccttaaatagccaaagattcaagttcactcggcgtgctagatttccaggggtgaaatccaatctacacttttaaccctcttgcagtccgagcgcgctggccgtgcttgccgaggccgccgccgccgccggtgttggctgcttttcgcctgggtttggggatttgttttctattttgcagttgttgttgttgttggggtgtagggggtgcgcgaaggttcggtgtgggttggattggggtggtggttggtggtaaaatgctttttcaaaaaaggcggggaggggggcgcgggagggcgcaggagggcgagcgggcgggcgggagggagagcggggagaatgtgtcaccgcgctgggaaagttcaaggttacagccccaagcactgcggcaggatcccggagtggtgatcgcaggcgaaactttgccgcgagccgaccatgtgtgtgcgcgaggggcagcgtgagcgagtgcgcgcgggtggcggggcgcgcgcgggagagggccggggtgggggcggggtgggatgggggagaagggagaggccggggtgagggagggggcgcgagcgctgatctctggggcggaagaggctcgcggcgcgtggtccccggcagcagcagccgccgccgcccgcgccgggtcttcggcgcccggccgcccgcccgcccgcctcgccccgcgtctgacccggccgagcgtggaggctgctgttgccgccgctgcccagagcccaggggtatcaaaacgatctcctgaaaaattccaaacgataaatcccgctctcccgctcggctccaaactcctctcttttctgctctaggctcttttttttccctccctctcttgctttctttcgttgcaaaacttggaagttgaaaaattcaccggttccaccctctggaccccgctcgagctctctccaaatcagacttaaggattgttttattatttaattacacaatcatcgctttactcctcctcctgcaaacgcgcattccttttgcaccagcctctccacaccccccgcccccccaccttcctcctcctcctccttctccttctctccccccacctctccctcatttgttaaaggtatcctaccggtgctacagaaccatgactttttttttttttccaaaatagctcttctttccgctgccctccccacaccagcacacacatacacacccccgaaaacccgccctggaagaggtatttcggtgctcgctgcggactcttttaagccgcgggaacatccgagtgggagaagcaccgaaaccgtctgagcccgagaaaggaacgagtggaaaattccctcacacccaggccgcccccaggccggggctggggcgcggacactcgcacccggggcgggctcagtccgcggagcctgcggctgccgggaaaagggggaggccgagcaggcggggacctgagcgaacttgggctcaagtagttggggcgcgccggcgtggaccaggggggtgcggcgcccagcccccgacggccccgcccggagcccgggttcgcggatagggagggggtgcgggttcgtcccgggtctgcccaccaggggcccgcacccgaggcagtcgcggcgcgcggcgcttcgccgcggtttgccgccctccccgggggtgccccgtgcacgtggcctcgctctgagcgggaggaccgggccgagccgccgccgccgcctcttgctccctccacctcctccccgcgcccggcttcgctctcctcctcctcctcctgcagccccgctggctggctcccaatccccaccccccggggcccggggcgccggcggaaagcgtctccctacccgcccgggtgcaggcggggcggggccgcggcgcgcccggggctgcggggcgggccggcgggcgcgcgcgcgccgctgcagccctccagaggctgcgggccctgagccgctcggcgcccgcgccggctccccaccgcggcgctgccccgcccccaccccgtcgcccgtgcaggctccgagtgaatgaacttgattccagggattttgaagaaggcggttcgccttgcaccctttctgcaccccccgcccacatacacacaccgccccccaaatccagttttctgcttggggtggatggggacgagggggaagcaaaggcctcccagacaatggagggaggaaaagtgagcgcctggggctccgagtctacctagctgggggatccggggggcgctggggctaccgggtcctcgcgggcccatccccagggcggggccgccccgcttccacgggtactgctggggcgtttcgaggctcgcccccgattccccggtcctctttccaccgcttcccagctcgtgatctgtcccctcaactttagcccctctcactccctctggtttctgtccaccgtcccctcttccctcccccagcggacctggaggaaccagtgactttttccttcaccaagtgggagttatccacatcaagcatttcacaacgacacatcaagaaaagtaggcaggttcaagtcaaccatgaaatggtcactttttaaccccgtcctgtcctcattagggaaatgctcaaacacagtccgttttcaaagagcgctcttaatgaggcgagcttgccaagtttaccagctgcagcccccgtaaacccagagcccaaagaagaaaggcgctggggggtggggagttcgggaggccggggacgggggctgctgggactaggaagacaggtaaagtcggggagatcgcgcggacccctgcgagttaaccctttcggccacacgccctgggagcggcctccctgcggtccccgcccctgccccggcaaatcctggagtcagcgttctgacaacgttaatttcctttgtgcgggtcatttcttctttttgaaaagctgggataaagttggcagtctttatggatgaaagaaatgaggtgacagggttaatccaagtaaatactcatttctctcagaaattttaggcaacctcatcttagattaaacacacacagacacacacacacagagaaaccaccagcacgaaagcatcactttgtattgcacattacactgcatcccctttctcaccctcaccagattctgaggggagggggtggggaagctctactgataataccagctttaactactgcagtttccctttgaacaaatattcaatttaactggagttaatttaccataaaagacattccccttggcaggaatgcactaatatccttgaacacacctctttgaatgcctggactctcatagaagccattatttcggggtctctttaaaaatcgagcgcccatctctccttctctccctccctcccttcttccctccctcctcaccacaccacccccagtgaaatcctggcacccagagagcactcctttcagcctgagagcccagaaccagccgttgtcccctggcaaaaagaggcccagggctgagccctgggcaagtgtctcccgacatcgctacccctcctccctttattagtttccctttcccaacagaaaccatttccttctgccaccaaaactaggttgcatccaaaagtttttcacaagcttaaaaaagaaaaacgaaaaattgacaagtattacacagaagagcccacaaaagcttcagcaacaccaagggcgaagaagcagcgtcagatccaggtaagaccccagagaagtgaagacgtctggggcctcccaggcccatcacttaggggttcaaatctctttcaattgccccacgtttgagggtgcttatggctggttgcactttgatgaccatagaggatgcttgatagtttttggttttgatttgtttcccagaaaaaggaaaatgagataggagtatggtgaggcgaggaaaaccaaaaaggaatgaagagtgagcaacagagacttcctgaaaaagaaggtttatgggggtgctcagtttctatggctttgactgtcttctcaggccttgcagccatgtggagaatggctgacaccccccaaaacacttcttcttgtccagccaatgccaaggtcattgcaggccttccctggaagaactctagggagttgtttggaaagagggactggtggatttcggtgcatgggatgcctggcttctcttaacacaacacttgtccaccacctttggtttgaaaatctcaatcttttaaatcccaggtagaaggaggaactgagaaagtgcctgcattgtattcactttccattttttctagcacgtctgtgtcgtggtattaagagtggaaatatctctgaaaagcttctgatagtatcaaaatgggccaaacacttcttaaactttggtacttaccaatcctaaactcttcatctctccctcccacactgagagggttaaaagcactggtgtgacaggccactttcattcaccccaaaacctggctgaggaggcagaaagaagtgaatgattctctcagcaacaggaaactctgttatttcagtattcttaaagatctcctccctagatctccttgctgccttataagggaaaaaaaaaagtttcctttctaactaacagaaagtttattgatttctaaatagaatgccagtgcttcagctcactggatttttcaaaacccagttgtatatttgaaataagcaacgctaccacatttgagcctttcactacggatctccagagaggagcttgacatctcaagtatctaatattgtttttcttttaaccttttccttcctaaagaaattgcagcgacaggttgcaaatcctgggcagtttcatgaaagatttcttggaacttaacaaagctgtcatttccaatacactcgatgcctttttttttttttttttttttttttggctcttgcatgtggtttgcaagaaggttcaactattctacacaccctggctgcatcaccaatatcaatatttaaaaactaaatgcaaaagagacagatgacctcctgaccccagaaagcaggcctgcaaaactgcaagtatctactgcaccatgccctgggatctttcctttttccaaatgaaccacaaaaatcatacatgtgtagtctggaaaacacaaatttatatccacaaggaggaacaccaaaaatccactcataaatgcatatataaacaatcaagaagtattgaaagtgcctgtacttgatgagaattgcaaaatcaattttaccagctcaggtaatcaaattacccagctcttaaactactactgagtactactactactgtctactactcttaaacaaaaaacaaaatcatacccagcccttaacgtactactgtcaaattagggtagtaattttttccccaccagagaattcacaactggttagtttccccacccccattgctagccctttgcactgaaatgaataaataaccttggacctttttctcctcctctgggagctatttggtgtcccctgaggacaaaagtaaatgagaaaaatgacgctgttaataatgtcactgccgaaatgcctctactccactgtttaaaaaaaaaaaaaaagcatcccactaagtgtgtctacatttctagcatatttacaagttataatacagttctgatctcaacaccaactgagccagattcctccactaaggttatccggttttcacttctcaacagagatgaggccagtgcatcaacagagattcccaacactgtaagacacttgcttcacagattacaaagtcagcagttgccctgtaacttttgcatgatgtattttaaactttgaaaatagaggtaatagttgcctcacttatccacaatgttacaaaggttccatatactctctcacacagtgtctcttgtctgctgatattgagagagttgcagttattgctctttttcaaaatagctgacctataaagtaaaactatatgaccattttatttctacaggtaaactggcttctattacccatatacacatgccttgtaacataggaaaacagatgggtttttaagacaggtatagaaagctctgtccaaaatggctaagtagtctttacattctgtattaagtataaaaagtgcatggcagagcaactcaaactttctgcacccctttctctcatttcttctttgaaaactgcataacaatgcataacaacaaaatttcaaagtcaaagcaatgcataacaacagaattgtgcattttaattttcaaattaaaatttaagaaacaattttgtaattacaaagaaaaaacacaaacaattgggcctaaacaaaatatatgttcagtaaactttatctctgagtgtatctgaaattttaactacacaagccaataaatttcaaagcagtaatattatcaaattgtgtaatgtcaaaaactccaaaaacaaagttacagatgttcatgacatcacattcactcaaaattatgctgctgttcagtctgaccatattaaaattaaagggatgcctatgtctgctaaagaataaaaatttattttggacctcaaacaatgaaaccgtcaccatttcttgtatggaacactcagctaatcaatttcctattaaaatagctttcaacaatacttggctttaaaattcatcagggccagtaaaaacgttttcccagtgcacaagaatgcagtcccaaccaccgatgataattactgttctaataattttattgccaaagtactttttcctgtgttcctcatcacttaggcaggaatctgtagtatattgcgtcagtgagttggagtgcttgacctttgcccacatatgatttaatagggacttttcagcgctagagctttctccatctctcataccattaaatgaaaacatcaaacctcaaatgtaaaactggaaaccacaacgttttgtgtttcacaaactctttgcagtttttacttaggatgcttaaaggtcagtttctttgcctcacaatgcttttcttcatattgtaaatacactggaaagtcacactaattctgattttgattaaatcttgaactcctcagtcatatacacacatacaccctgcttatttacacgtgcattcttttctaaccacataagcatgcgtgtgttactttctggacttattccattttagggctgatttaaatgtctgttcaagtgtgggatcaaaagttaactttttcccgcctattggaagttaaagttacaaggatggtgctataagatccgttcaaagaaagtcagagttaatcttgtgtattttggcgccttttccctgccagctactgtacttggggggtgggggaaaaatacttagagatcttgtctgtcctgtctcaagttcagtggcagttcttccaacccgagcagaagatggccatgttcacagccctaataataattctgatcacgccacttcagcatcttgtgtcaaagtcgaaactggcttccccgcccccttcaatctgaaagctgccaagtcctcacacacttcacattcaaccacaacttaatggatgggatattgtgcattaaaatgtgtctcagacgtattggggaaaagaagacaaggagaacgagagatagagacacacataggaagaggaaaaaaatcggcagcaaaaatagcggggttggggggaaactattaacaggagtggaaagaaatccatcaaaatcggttttaaaaagttggtggggggtgcggaagaaaggctaacaataggatgccacaaattcagggatgaggggatgggggttaggactaaactttagaatgaatactgactttaaacattccaacacaccaatcagagttaaatagtacttctttcacttaaaaatgtatttttaaatgagaatatctgtgaattaaaatggagaaaagaatgcttcaagaggagagaatggcctacaaggtagaactaaagtatcatttgaacagtaatttttttccaccactgaggggagaggggcataaagcagagagttaaagcagaacaaaatgctagattctgcaccgtttggaccacaatgttactcactgattcccgtcataagagtgtgtcacatgtactaaagttgccaacgctaaataataatgcatatttgcaaattagttctgcaaatgcagcactatagcccacaacctgtaaaacaaaaatgacatttaggaaaggggtaaaacagccactttgcaatccacaaacaggaaaagaaaaactgtgccagggataggagggggtgcaaagaacgaataaaagaagcaaacaaaacccatcagttcaaagccacataccatcgcactgtattgcattaaataaaagagatcttgagtctgtaacagaaccctgggccgctgacttgacgtgtctcaggtacagatttgtggattttctcaggggttgttttggtgtcgctttttgtgtttagttaaaaaaaaaaaaaaaaaaaaaaaaaagcaatccgggagtagtcttatgtattttttaattgtaatttctgcactgccacagttcttggcccgagaagaaaaggcggtcaaagtcaagtctaaaagcaggcagcccttcagtctgtctggatttccagctttctttcctctcccttgcagaaggctgtttctcgtgcttgacttgaacgccgtccaggatggtgtgtgtgtgtgcgcccgcgtgtgcgtgtgtgcatgtatgtgtgtgtgtggtgggttttattgttgttttagcggggctgctccaggagtggggctgcgccggtcagatgcagccggcacggccccggggtcgcgcgatcgccccttccccgccctcggattggcctggcccgcggcggggctgccccggaaccgccacccagcagcgcacccttccgcgcccggcccgcgctcctcctgcagtcgcctccctggctttctctttctccggctcgcggcccgccccgccccaccctaccacggccggcctgggcgcgcgggaagcgcggctcttcgcttccgcctggcggcgggaaggaaaccgaaaggaggagccgggggcgggcgcgccgcgatgcatattcatcagggcgcccgggacccgggaggcgggagcgggcccgagtgggtgtggcggcctgcgccgcgcggcgcccctctcgagcgtgggtgggtgcgtgggtagcggtggggctctggtctttgtgcggccgcatggggccggagagcggcgagggcgtgaccgtctcgggggctgctgcccaggctccgcgcgcctttgtgcttcccgaccgtgtgtctgcggcgcgccgcgggcaaggggcccctcgccggccttctggagcaggaacccggccgaaaacgccgcggaaagactctaaaacaacaataatgataaagaataaggaattgctgttacttcctcacttcccgccacgttgctggcttcaacttcgccaggccacgtttgtttccgtgtaggaggactcccgaaatgttcctggctgcgcagcgttatcattaaagcaaaaggaccagaaagagcgcactttgacttatattgataggtagtcacgcgaatatcaaaaaaatagatcagtaatttagaagtgggtgaaacaaccaacaccaaagagataatacaaccccggagttcccagaagtaaacactctagaggagattggatagtgagttaatgttcataaagcaagcagttttgatcagcattttggaaacaaatatatgtagggggattttttttttcttagtttttgagtaatgcaattcttttcatgttaagtatctgtagttatgtcgggaaataatgtttaacagtttaaattgttatacaagtattaaaagtaaaaatataacactagccctaacatttacttagtagtaacccacatacatttagaaaagattttattacagagatcctgactaattatgtaattgcacaacagacgacgatagcttcaggtattctctaaaaaccctgttgaattatgtgattaccagtgagactagaatagctcccgatgaattattcttatctctctactaaatgtgagcacgtcagtattttaatctcaattatgtttaccctcaaagtcctagagaacttaaacgacattgttcgggttcatacctcctacaacacgcagtatttttttttaaaaaaaggcatggccttattaccaaaaaaaagttttttccccttgtatacacatcatacatacgtttggctgtgtgtgaataatatacatagctattttcagtgataataagtgcaaaactaaaagtgggattggcccaattagacttt
